United States Patent 7,745,391 (HUMAN THROMBOSPONDIN POLYPEPTIDE) - sequence listing, part 241

SEQ ID NO: 663222 - DNA, 1984 bp, Homo sapiens
  misc_feature (738)..(738): n is a, c, g, or t
gcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgaccacctggctcaaagaaaacagaagcatggaggccgccaagtattttcaagaaataaccccatgaatattccatcacttttttagaaagaggggcttggggcaggcagaggagagaagggagagcaaactgagagccaagtttccagacagtcctgcaggaggagaggatgcagctgcccagagggaagcaggatcacatttaaggaagtgtgtggggtccctggatgacaccagcacccagtgcggctctgtctggcaaccgctcccaaggtgggaggagtgggtgtcccctgtgtgtcagtgggcagctcctgctgaacccgcagctcactagggagcctgacagtgggtccatgcgcctgacactcctctctgcttgtggacctggcaaggcagggagcagaaaacagagccacttgaaggctttctgtctgcgtctgtgtgcagtgtggatttagttgtgcttttttcttgctgggagagcacagccaccatttacaagcagtgtcaccgtcgtgggtggngaggacagaacaggagcctctgctctctgtacctatctgggcccggtgggctcccttgtcctggcttccatctctgtctcagcgaccattgagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccataggactttttatttatgtaggatgtgtgctgtctaatgatgggatgaccacacttttccatgttctgctacgtcttacccgcctcctgcctcaacagcctgtgtggtggcaaagccggtgtggggctggggaacgcagcgttctccaggagggggacccggctctccttctgcaatgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagaaaaaaaaaaaacaaacccaaaaaaacaaacccaacaccagcacccacacacaacgcacaccgacaggacacacagcgacaacagcaaagcagcgcacgcagaagaggaggggcgcggcacccgcataacgcagcgcgcgtcagaggggggaccgcgacggcatgcgcgcgcggcgcggctcgtagacgcgagcaggccggcccccaaagggcgcggcgccgcaacgccaagaagagacgccgcggccgcgcgaacgccgcgccgcagccgcgaaggagacggcgggaccacacgcaactcggcggcatagagaggagggagaaacgaccacaagcacgccagcggcagacccgcacacacccgcccagacaaaagcaaacgacagccacagcgccacaagccgcaagcccgcggcagggcggaagaacacaaataacacggacgaagcgaggcgcgagcgcgacaagggagggagagaagaacgcgccaaaagcgacgaacaggaggacaagacgatcaggggagacagaggcgggaggcagaagacagcgggacgggacagagaagatcagaaccacgtagacaagaaggagaggcagcaggcggaacaca

SEQ ID NO: 663223 - DNA, 1783 bp, Homo sapiens
  misc_feature (738)..(738): n is a, c, g, or t
gcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgaccacctggctcaaagaaaacagaagcatggaggccgccaagtattttcaagaaataaccccatgaatattccatcacttttttagaaagaggggcttggggcaggcagaggagagaagggagagcaaactgagagccaagtttccagacagtcctgcaggaggagaggatgcagctgcccagagggaagcaggatcacatttaaggaagtgtgtggggtccctggatgacaccagcacccagtgcggctctgtctggcaaccgctcccaaggtgggaggagtgggtgtcccctgtgtgtcagtgggcagctcctgctgaacccgcagctcactagggagcctgacagtgggtccatgcgcctgacactcctctctgcttgtggacctggcaaggcagggagcagaaaacagagccacttgaaggctttctgtctgcgtctgtgtgcagtgtggatttagttgtgcttttttcttgctgggagagcacagccaccatttacaagcagtgtcaccgtcgtgggtggngaggacagaacaggagcctctgctctctgtacctatctgggcccggtgggctcccttgtcctggcttccatctctgtctcagcgaccattgagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccataggactttttatttatgtaggatgtgtgctgtctaatgatgggatgaccacacttttccatgttctaaaagtgctcctctcctgcagggtcccagggctggtggttgctttgggtctacagctacgtcttacccgcctcctgcctcaacagcctgtgtggtggccttctgcaatgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaacccctgagccggtggggtggggctggaagcagcaggtgcagtgatagggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaactccactgagtggggtagtctggttggggcagggaccgctgttgctttggcagagagagaggatccccactggggagaggctgttctgactctgcaggtgggacagggacagatggcccccagggtgacccggctggtcttcctttgctatgctaagccctgggacatggaggattc

SEQ ID NO: 663224 - DNA, 82 bp, Homo sapiens
gcacgagcctgcttgtccctgcccagaattcccagctgtctgtgtcagcctgtccccctgagatcagagtgctacaggggct

SEQ ID NO: 663225 - DNA, 311 bp, Homo sapiens
taccaaggggccattaggtaccagaacggttacatcgccattacacacaagtcgggagggtgctggtgggtcaaagcgacggcctattgaacttggtgaaacgggacgaagggccgtaggaacggaagatcctagaggtggcacaggggtgtcttgtctatggtcagaagtagtctctacccaaggtgttggtgacccgcggcggactaggtaccccccaagaaggagaacagacgttgtctcggaccccccgagtagggtatcgccattacccccccgtctcactggaacctacggttccggtcgtcccg

SEQ ID NO: 663226 - DNA, 378 bp, Homo sapiens
tcgactctgatttcaaagcaaactctggattctgagcagacccttgagctggtaagtttcactacctgcttaacaaatagagagggaaatgcctgccacatggccaggcttaaaaaggtgcttcctggcatcatggtgaagtagtgaagacaggacaggcaccagcaaaggcatatcagaacaggtgactttatggctaggatttgaccagaaacagctttcccttatacatttctgatagtcctgaatctaatatgatattttttttatcattatatcagtgataattttattgccaacagtatgtattatatcattcttaatataaagcaaaattattataactaatcgtagtatatatgtacaaaatgtcgacgc

SEQ ID NO: 663227 - DNA, 376 bp, Homo sapiens
  misc_feature (108)..(108): n is a, c, g, or t
  misc_feature (203)..(203): n is a, c, g, or t
  misc_feature (373)..(373): n is a, c, g, or t
ccttcatctcagtgcagccaggccccacagtggcctcaggagagaacgtgaccctgctgtgtcagtcatggcggcagttccacactttccttctgaccaaggcggganaagctgatgccccacagtggcctcaggagagaacgtgaccctgctgtgtcagtcatggcggcagttccacactttccttctgaccaaggcggganaggctgatgccccactccgtctaagatcaatacacgaatatcctaagtaccaggctgaattccccatgagtcctgtgacctcagcccacgcggggacctacaggtgctacggctcactcaacttccgacccctacctgctgtcttcaccccagtgagcccctgggagctngtg

SEQ ID NO: 663228 - DNA, 796 bp, Homo sapiens
cacgtttggagacactgggtgccttaaatcgcgggcgaaattcggacatctgtggtcaccaatggaggacactcaacgagtatcaagcgatcacggtgagactgggcaaatgaacggcgacaattgccgggcctgtgcttggtgacaattgcccccattgtgaaggtcacatgagccagcccagacacacggtcctcgggcccgagaagacctcccgttttaccaggcattataggtatgacccactgaaaaatctgccaggggcaccagatgaaatcctgagtgacagtgcaggcatgatcaagaacaggagacaaagtgggagcccagcgaacgccagcagaatgctgaacattgctcaacatctcccccgtctacctttggtgctggtcatccagcagagtgatcgacaatggcagcatcatacaacctctagaagtgctctgatatcacagaggaaactctgcattctcgcttcactggagggtgtccgcgatgttgacagtgtctgtctgcagattggctaaccaactggtgcattagtaccccattctatcactcaacgggtacaaacgagtcctggccttgtctggtggagacggattacacctgtcgcacatcttgactgaaaaggtcgaggccttctgtggctgatccatctgcctttgtggctgctgcccctgtggctgctgccactacagctgctccatgctgctgctgcagccccagctaaaggttggaaccaaggaagagtcggaggagtcagacgaggatatgggatttggtctcgtgataa

SEQ ID NO: 663229 - DNA, 648 bp, Homo sapiens
caggtatttatcaaacagtactaggtagtgctgggcacacagtagatgtttgataaatacctgttgatcccatataaataaatacagtgtgcccagcactacctagatactgttgcggagaacatcaatttgcagattgtaggtctctgtcccttagaaggtagtcttcgtccacggaaagttagcagctacttatttgtcacgttctaatgcaatacatgatgcaaatagacggcacctgttcagttaaacacaacattgctgaccttttcttagatttcacactgatgatagtgccagcgtgtacgaacgtgacaacgtaactttgcgcaatttaacacgaagatgcgttcatactatgcgctaagttcaactactgcgctcatcacactggcacatctgtgctgatacgcactgtcaacgcgaacgcagcaacgaccatggagcttattagtcagaagcttcatgcacattctacggtcatcagcatgtgataacacttgcaactacagtcaacttcaacctcttttactctctaccttcttcttcatattcgtaaacttttggcatctcaacgtgtcctatccatcgatacatcacattcaagaacaatcctcttacaccactctcataaccataccagacgaa

SEQ ID NO: 663230 - DNA, 768 bp, Homo sapiens
tcccaatggtagtcgggccacgggggtcaaatttaactacaaatcttggcttggtctacttggaacacttgatctcttaaaagcctcaggtttatattccaaaacgggcctcaggaagtggcagacgggtgcaggaggtggttatggggcacaagtcattctcctcccaattattaactatataggcagctcctccaaaacaggaattattctctcaagctgagcattggctggataaacagcagtgggctacagcaacaaccctcttttctcttatatgataccgcaagaatagtatgtttagatggatgggttataaccaggttttcctacaaatggatggatgggcagttccggtatttatctggtgccaacaatcagccgtggagtaaatccaagactggagatggatatattggggtcccacaaggtctgggcaattctcccagtgggtctaatccatatgtattggacctaggtccacaatggtatagtcagggctaggatcccaagctggccgagcaaaacaccaacacactcattagcagctggtcaacacagcctcagaaaaaaaccccctggtttggcgccgtcacacttctcataactctgtacagaaccggtgtctctgtaggcgcggttccccctcgatttgggcgaacccccggggtcgggagctacgggcccgggttggggtcgggtctcccctccattgtccgctcagggccgtggatggcggtgagaaactgcgtttggcttggcaatccg

SEQ ID NO: 663231 - DNA, 326 bp, Homo sapiens
gcccgcgtcaacgccgacctcgcagcgtcatggatgccgaacgagatcgcgggtcgcttgcgtctggaggccgcagacccgaccgttgaacgcatggcgaactctcccgacgctcagggccgtgagccgcccccttcattcggtccggacgttctgtgagtcgtcggtttccatttgatgggtgcactgccgagcgtactcggctggggttaggtagccgagcgaggagtgccggcggtggtggttgtactcgtccttccagtcgccgatgatgacctgtgcgtgcagcagcgagtagaagctgttgatgttgaggcactcgtcgc

SEQ ID NO: 663232 - DNA, 1232 bp, Homo sapiens
gcaggtcccaggaggtccatataaatagccatgaggagtggctagggctggaatcagctcccagcagtgctggagctggggtggtggggtagcgttcctgcccgactaaagcttgggtgcacacctccctcagaatgcatgtcattggaacgggcattcttggtggtcacgtgtaatgggtttcttgaagcaggctttcatggtacagcgactccgggagcaggccagcacaggaggtttgtgaaagacagagagggatctctagtcacctcctgtgcacccagtctttgcctcgagccccgaggcatccgctctgtcgtctctcctaccgctgccaaggactccaggatcacgtggtgaggtctcgtgcatttgagtgtcctcgcatcgcgccgttgcgtctccgccgtatcaggaaacgcagtgtgccaaggcaggacccgttattagagaatcaccaaagtgaagtcacggaggggactgcaggtgcaggcaatcgtagatcctagactggtagcccgagagagtaccaggagccacgcgtttgaccaaagatcatagtaggcccgaacgcaggggggcgaagaactttgtcaagttgaggcaccaacagtgcaccttgaatgcccttgtctcagaagcttgtgcactccctttgtagggaacaacttccaactggggcagaaccaaatgtcccttgacgcaaacgaggatcaatcatgaactagattaccagattgtccacccattccaacggcaagaaagcccaaagaaaggtttcaaggaacccaaacctattcgaaggagtttgaggtacgtgttaacatagctacttgtgtgccccattgagggaaagttccttaactcacccttcaaggctcaattccccagaattaccttctgaagatacccctttggacacacaggtggcaaacaagcgttgttccattttgacaataccccagggcggtcccggcttctttaccgtccccaggggacattccagccggtgttcctctttcatttatggcgtaaggagcccaaggggacacttggcctccattctcagagggccaggagggggttatcacaggcttttacacgaaaatttcccaaggcattgggccagcaagaaaatttctcgcacatagggcagaatctctgaggtcgagttgaacacgggccaagaattttgggcacctcatttaaaaccacgagatctgggattatag

SEQ ID NO: 663233 - DNA, 450 bp, Homo sapiens
gatatagcagggggttgaaatggaacacacagaagatcatgacaattgagattcagcaactgctgtctcatatcttggttaagacctcattgtgaaccttgaacacaaatcagatgttggagtgatttcaaactctatttcaacaattgggtctgtttctatatggaccctctatttcccagctgaatgtttcaaacccccaaattaggctgcaaccgaaagagcctaattgtgaaatgatgtgcgcttatgtttctgtttatcctttagccatggaactttaaagagtagtgttcctcctacttactttaagctggaagaagagttgagtagtaaatcctgtgtgaacttttagctcagctactctgctgaattaattagaggtaggaaggacttacaagggctggaagtttaaagagaataaattcatattttttgttctgaaaaaaa

SEQ ID NO: 663234 - DNA, 271 bp, Homo sapiens
ctagctaagaaatacaaaacaattaggcgggcgtgatggtgggcgctgttagtcccagctactcgggaggctgaggcaggagaatggcgtgaacctgggaaagcggagctcgcagtgagccgagatcacgccactgcactccagcctgggcaacagtgagactctgcataaagagcatacccatgtgtgtacctatctatctatctatctatctatctatctatctatctatctatctatctatctgtatatagatatattaaaatgtaca

SEQ ID NO: 663235 - DNA, 127 bp, Homo sapiens
tcctgtccccaggcagagcacggtagagggcgcgcaaatatgcagcgccgccagcattgcgttgctgtgctgcccagtctgcgcaggtgagatcgcatgatcatgccgcgtgtggcagcaactgctg

SEQ ID NO: 663236 - DNA, 681 bp, Homo sapiens
ctctaccgctgagattttttgccgtgatggctgacagaaagttttccgctcccagacatgggtgcctcggcttcctgtctcgtaggcgcaccagcaggcattgtggaaaggtgaagagcttgcctatggatgacccgcccaagccgctccacctcacagacttcctgggatacatggctgcactgactcacatcgtgcgggaagacaaccggccgagatccaaggtgaacaagaaggtggtgctggagcctgccaccattgtacagacaccacccatgctgattgtgggcattgtggactacgaggaaacccctcgaggcctccggaccttcaagactgtctttgctgagcacatcagtgaggaatgcaagagccgttcctatctgaattgccatatatctaagaagacgacctttaccacgtactgcaagatatgtcacgatgtggacgtcccgaagccgctgtagatgactcaaaaggcatgaagatggactgccaagccatcctggtattggcccacaaccagagcccctgcttcttacggcccagaggaaggccaacctgtttgagtatccagttgaccgtctgcactgtgtccagctgtactgctctcctctgcatggctccacaggtccctatgaaccaagggtttggactggggagatgttccacggccttcgc

SEQ ID NO: 663237 - DNA, 907 bp, Homo sapiens
taagtaaagacaggtttccacaatggtgggccaagctggtctcgaactccgggccttaggtgatccacccacctccgcctcccaaagtggctggggattccaatgtgtgtgtgaggccaccacgctagggccagtgttggtgcattttggtgcaaagatttactccgaaatgtcctggcttctggcttcaagaccccttagctgagaggggtgaggtggatatattgggtggtgtgtgtttaactacactctgtaggactgtgggctcttggaagagcgctccatattgtggagtgtcaagaggcgttaagtctgggtggtgttgggcgtatggtgggtgtatattctggagtcacaatgtggtgaacagaaacgccctctctctcgtggtggcgcacaccacaaagtgtggacgggtctcttgtgtgcccagagacacttccgcgcgcaccacacagagagagggtaacccctggggtggcgctgagaggcctttttataaaactctctctgtgggtgtaaacacttaatgtgtctttagagaggaatccccacagagagagacccctttttaataaacagtctccttgtggggaaaagcgggagactgtgcgggagtgctgggtgtgcctgggagacgcaagggggaaccaatatgagaacaaggactgggcgtaaaaaaataggtgtttacaacacaaaattattgttgtgggaagtgttatacaacatcgctgtgtcgtggtgttgtccccaaagtggggcagagtagtctcttgggtgtgctgcggaaacaaatattcccattaaaacacgccaattgcggcgtctaaccaactggggggtggcggccaggggtgtggaatacccaaaacgccccctttattatcatcaccctcttatttcc

SEQ ID NO: 663238 - DNA, 209 bp, Homo sapiens
atctgatctagaggatcccgtgtgtcgagtacacatcagcatcactgtgacggtagaatgcagaatccaggccaccccaccccatgaatgcttagaagctgcatccaatggaagctctatatgaaccacacttttgagtagcaaggatctagagttcttgtgcagatctctctctctctctctctctctctctctcttactcgtacacg

SEQ ID NO: 663239 - DNA, 114 bp, Homo sapiens
tcgatacgactttttttttctttcctttttgcttttcctttcttttcttttttctccttccttccttcttttcttctttctttctttcctcttattcttccttccctcctccct

SEQ ID NO: 663240 - DNA, 117 bp, Homo sapiens
  misc_feature (101)..(101): n is a, c, g, or t
gagaagtctgtccgcgagctgtcttcgcgggcgggaacgccgcggggcgcggggtgggcgcggacgaccagaaaactgagtggaaaagcgaggttggaccncccgcgcgccccgcac

SEQ ID NO: 663241 - DNA, 803 bp, Homo sapiens
ggtatccagatccttttctctacatgcgaattaatgtgagtcagatcctccaaatccttctggactatttaaggttcagaatacaacgtgcctatcggaaaattccaatgggatgatgtgctggtgagctagtcttgtgtaccttgcatggttcctgacatcaatgtagttcccatctaaatgaccaagtcatcagggcatcaaagagcacttggtctggacgaacttcatttctgcattactgtgttccgtgtgatagtttcagtaacaactgtctatcgttattcataagaacagacgagttaaatccattataaggctaagccgtatctgttccaatcatttaatgagtaaatcgtatgttcgatatattgtctgtccataatgtatttcgaaaatacggtagtatatagtgtcaggttggtgcgtccgttgtggttacaagctgtatatattcctagttaagtttctatagctgcgtttggatgatattcagatgtatgtaactcatagagaattgtcccaacgatgtagcctgttttggaaacttgcttgttgacactattgaccgacttgtgtgcaaagcgcttggtaaatcttgttttgtctcgcttgtatttggcagataaatcggcttgatatttttgtcattgacttctcggtagcgggttcaggatctccttttgggggatttccggtaaggactaccttttgcgtgtggcgtgtcgggctggggtctgctggtctgcgctcgtttgtcccggcgggggaccgcctttgtagccggggtgtgcggggtttgg

SEQ ID NO: 663242 - DNA, 1368 bp, Homo sapiens
cggtgatgtgtggcggtggaggcggtggcgacgacgccttcgctgcgttcggttgagcgcggatcgggcacaggcgctgtgtggccgacgtgtccacgctgctgttcgattgcgacggcgtgctgtggctcgcggggagacctgccgtgccttggcgcgccttcgaggtcctcgtgcgggtgctgcagatgcccgcggcaatgcgcctgggccttctaagtcactcatatcacatcagcagtcataagacccagcgctgccatacgcctgaggataggctgcggcgcctgtagcttcgtcgtcccccgtagggagcacccgcgtgccagtcactcgagacggctcttcgagcactggcctactggcactcggcgcttcgtaccttcgactcctaacgcagccgtgtccggagcgccctcccgacggacccagagggcgctacggttgcgtgggcagtcgccatgcccgtgaccccgcgagaaggctttgtgaggctcggttggcgacgatcgcgcgcagactgttggcgcgggtggggcgtccgaagtcccacttgcttatcggaggcagggagtccctcggcgacggatgtgggcctttgccacgtgcgcctctgcttggaatggccccggaacggttgcctggcggccgggtgggttgcgctggggacatttatggacgcccggacaaaccttttcaaggtctaaccacttagaaaggccttctggcccataggggcgctcgatggcggtgttacccttggcagggggaagtcccagggacgttggtcgctttgtcttcggatgggggcaccccgaagcacattgggaccacaatcccggggggcattccctgggttttgagcgaaccggtagccgggagtattcgacttcgggccgcggggtctacccgggcggggtttggctcctggggtcccatgaacgtccccggtgggaagagatttggctccaggccgccaaggacagacccatggtgggtccagagagaagtccattaccggagaggaaaaggcccaccaagggcgcggacatttacagtttttaacacggaacttgggggtattgcttccgcaaaagggagaagattcaacaggggtgaattgtcaaaaccccctcgaaaggccgagccaacaccggtccgatttgggattggagtcacagaaacctgggccgttgggaaacaagcaagagaaccattttcctatcccatttaagcggcccgccaagaccctatgtttgccacctttagaaaagaaacccaaattgcgtttagaacgccattcaaacccgaggaacgtcatctctcccacttcctaaaggggcgggattgtcttgcacagacaatcta

SEQ ID NO: 663243 - DNA, 1145 bp, Homo sapiens
ttctcagtttgttctgtctactcgttgtgtgttcgcccgctctgtctgtgttgttcttttgtctcctcttctgtctgtggctcaccctcgttgttgtcagatttcttctgcatattcgcctcgtgttataccgcccggtgtttgttcatccttcttggtgactcgcgtttctcgtccctgatccttctgtggctcctttctctttctctttgaggttatttggggtgtttatataatcttggatgccacccgatctccctggggccgttgtgtaaccccccaattgtatgtgtgagggttcctccaagttttatgcgcccccccctccctatttggtggaagtttttttaatgctctcagggtccccccgagccattttggatggatgggcttccctccccgccgagttgatctccttgccgccaatgaccatttctggaattaccccccgctgttagcccagacgacaatgtgttcctccacatggcgttgagaacgcgcgttttttagggatggccattactatctcagttattctgcttttaattctgttcctctggtcctcgtccccctttgtttaatccatgttcttaagacttcttttcgtgtgccccaatcacgtaaagttaccctctgaagggatatcatcctttccaacgggccatctaaggcagctaattatgccttgccttggggtcttctcctgagagaaaattttgctgacacctggaactcaaaatatttttaaaatttgagattttttttgaaacctaaatatttaatattgcttctccctgcactggccaaacctgcctattctgctattttaaaacccctccatgactttattttctagctgccccctcttttcactgtgccaccccaaatgaaaatgtttaaattaactgtgttgtacccaatggtaccccaccccaactttttttaaattagtaatactctttgtttaaagttttaagtttcgccttttgactttttttgtaaggatgtatgttgtgtgtttacaccctttattaactaaccgttctaaagctcgtgatgtgtgcgtagaatattacgtatgccatgttccatgttctaaagaatggctgttgatgataaaattaaaatccgctttcatttttcta

SEQ ID NO: 663244 - DNA, 95 bp, Homo sapiens
catggatttgctggtgcagtacaactaggcttaatagggactcgaattcgagcctcgaattcgaggggtgacagagcgagactccgtcccaaaaa

SEQ ID NO: 663245 - DNA, 187 bp, Homo sapiens
tatcggtgtattattttgtcgcctacttattccgcgtggtattaatatatattgttttcttttgaaacaaatatatatttgatacgctcccattgggtcatatgaggagacaacccttttttataatataaaagaaattttttgttctatattaaacccttctcttacaatatgacacacacatcac

SEQ ID NO: 663246 - DNA, 625 bp, Homo sapiens
  misc_feature (102)..(102): n is a, c, g, or t
ggaattcggcacgagccttgggggccgttgctggaggcagctgggaaccgcggccgctaggggcgtgttacccagcacgcggccccagccgataaaaaaggngcagcgcgcgataggagctgcgggcggtccaaaccgacaacggagggcgaacacgggctcacccgcacaagctaggagaaacgagcaccgagctaccagcggcgacgacagcggcgaagcacgcacaggaatacacggaaagccgggagagaaaacacagagccatcaacgccaacacaaacagcagagggggccctcgggccctctttgaagcccttgctctagttgccacgacaatgggacagacccactacctgaagagaattttgaaagccggagagtcgtgcaaaaagccccctcctgatggacccaaccaagaagtcaccggtaccaaacacccatggcagcgttccccgagacaaaaagaaaacgcggggaaaaagccccttttaggcaaactacaagggaaaacttgcccgggcggggggccacaaccctcgtcccaaggcgcgccccacctaataggccccccacggaacccaaccccgggagcgaaagcggcgaccgaccgagacctcggccg

SEQ ID NO: 663247 - DNA, 396 bp, Homo sapiens
tggccaagcagtacccaaaaggaaaaaaaaaaaaaaaaaaaggcaaaccaaaaaccaaaaacaaaaccccttaccagaaaaccaaaagttaaagagatttatcccattattaacttatattggacttttgaaattgttcttgtccttttaaagggcagccagggaaggccctgggttgcagaaccattgtcgtggttgtggccctttcagggtccctgtgaagagaaggttgagagctgccctttgaaagggcgttccccttgtaaaaggtctcctgggttgaaaaactttgacctttgaagaaacccacttcacacaaagcggcgttggggatacaaccctttgggcagggataccagagctcaaattcggaaatcagtggccatagactgttcc

SEQ ID NO: 663248 - DNA, 722 bp, Homo sapiens
  misc_feature (21)..(21): n is a, c, g, or t
  misc_feature (461)..(461): n is a, c, g, or t
tctacatttatttgtggaatnattgcatactctgactgtactcgaaagcacagttaagtgacaaaggcatgttgagaagaatgaaagagcactactcacagacagttatcatcgagtggcgcactggatactgttcacgaatcgagtgttaatccaaattcactttacaacataagctgcaattgctataaagcgataagcctcaagcagcatgcagattaatattacgatgtggcgaataataactcactttgggacctagatttctcataatccaccaggattctcagagaagtaccagccacgcctatgctcattgtgtacctcagacgaaatcccatgtgtcgtgtttctagcccgtgtagtgaggccgcatgtatgtataccaccatttcaaggttttgcagtagctgacactcttgttaacaccacacagcgcagacgtgatctctctgtgtgcngcagattgacctctcattagactgttgatggatcgtgatcgaccacgacgttgctcgcaattgtcaattcttttgtgtggactatgccgcagccacttgcagcctgaaggatagataaattctccccgcaaggtggaatctaacacgcttgttgccagaatatgtcgcccaattattcagacttcgtaataaatattttattcgatctgcacacttgtggagagatggtacatttgtgcatacaccggtctattgagtttt

SEQ ID NO: 663249 - DNA, 302 bp, Homo sapiens
tattgacgcatcgtcaaattgtaagcttcatagggatggacaccagtatctataatgcccttctatatgtgctaccatatgatgtgacagtttttgaccttaatatcgtctttgaacatgttacattgagaaccctgttaacttacatttcatggattgctacattgtattacttactgcaatagatatttcatttccagcacagtgcaaaagttcttgtaaaatgcatatgtcttttatgctacgttccgtttagtcttaagagcacattttaaatgtagttctctcatttagtaaaagtt

SEQ ID NO: 663250 - DNA, 108 bp, Homo sapiens
tgtgatttgcatgggggatgagcgtgtcatgtccatttttcgtgctgaggggtacggtggggagaggcgaactgacgcgtgaaagcacgagtgaaagcttgctgactg

SEQ ID NO: 663251 - DNA, 517 bp, Homo sapiens
  misc_feature (190)..(190): n is a, c, g, or t
ccacggatggccttcattactaaggtgttcctggcggggatggactggggcattcaaaaaaggttctccccgaaggtgctgggcctgtgtgcaagcccagcgctggtgtgggtggtgatggaggtgctggccctgctcctgggcctttacctggccaccgggggcagtgacctgagcaccttttacctgntggcctacagtgggtacaaaaaagtgggaatgatcctcagggggctcacggggctgctgtttggcaacgatgggtaataagtggggctggcctggacctcatcgggggtcatggatttcattgtggggttttttgaggaaagcagccctgggccccgacagaatggggggccccgtcccccgggagggtttccaggtttacctgactttggggggggcagccttccagcccctcatcaaaaaaggggtgactttccccctgggccggggaccccctggccccagaggggactgggtttttcattcattgaagatttgatttccttga

SEQ ID NO: 663252 - DNA, 128 bp, Homo sapiens
gatcccccactttcaccacgtcctgactcacgatgaggctgaacgggatgtgtccagggtggcattgtcagggaagctgcagagtattgaaccacttggtcacctttcccaggaaatcccaggtaccg

SEQ ID NO: 663253 - DNA, 347 bp, Homo sapiens
aagaggacaggaggggtatttcctcctcacctctaatcatactcggtgggcactccacgcccatcgcatgagagttgaactggtgaaggggtggatttcacatgtggcattccggtcatcatggcccccaggagggaaggccagactcggcacttgacaccctcaagcctatctcttccacactcggccgggaatttggtatcccaatcatactgaggttgtccgggctctttccttctcagccttcaggtgccagcagggatggtcacggggccagatttctcctctgatcccggcagtgcctcacagaaccacgggaaaacacacggcctcctgggtgcctcggg

SEQ ID NO: 663254 - DNA, 97 bp, Homo sapiens
cctggagcgagccgaaggaaaagctggagggcgacctgaagctgacccaggagagcatcatggaccttgagaattacaagcagcaacttgattgagc

SEQ ID NO: 663255 - DNA, 279 bp, Homo sapiens
  misc_feature (168)..(168): n is a, c, g, or t
  misc_feature (208)..(208): n is a, c, g, or t
  misc_feature (219)..(219): n is a, c, g, or t
  misc_feature (233)..(233): n is a, c, g, or t
tgaataacaaactatgtagtgtgtccctattataaatgcattggagaagtatttttatgagactctttactcaggtccatgcctccctgtgggctgtaaccatggaaggattcgccactacccagaccttgttttttgttgtattttggaagacaggttttttaaagnaacattttccctcagattaaaaagatgatgctattacaantagcattgccntcaaaaaatggggnccaaccaaagtggtggtcaacccctgttttcccttaaaagagggct

SEQ ID NO: 663256 - DNA, 742 bp, Homo sapiens
ctctttcataaggtggggttacccgccccccacaggcccctttaatgttcacactcccccccacgtgttctgccctgtggccgggggtgggtgattatatttcttccccccacagggggcttgtttacgacacgtgttgtcttctggcggggagaatcccggcggggggccgctgctctccacaacaggggggtgctctctcttcgggggagacccctcttttgtgttcgcgccgcggctgtcctctctctctggggcgcgctcttcttgtagagggggagatgtgccgctttctcctatacacgcgggcgcgcgctcctttcgtcgcccccacggttgtgtgcccccacgcgacacggggggagacatctctcgcccctcgtatggttcgcggcgtgtcccttccacatcaccgcgcgcgggggccctctgtgcgcccgcagcatatattcgcggcgcgctctatatgtgcagcactgtgccctctgtgccacacacgcgggcgcccgcgccacaggcacacggcgcgagaccccggggcccgcggcacaccgccgcacaccgagaggccacatccgtgcctctgcgctctccccacacacgcctgtcaagacttttcgcgagaggggcggcgagacgggtccccctggtggcacagaggggctccccctgttgtcgggtggaggcgggtgctttttattttcagaagttgctgtagaaataaaaacgggttaaatttgga

SEQ ID NO: 663257 - DNA, 329 bp, Homo sapiens
atactctagaaaggcgctttccgaagtacttcattataacacaggtgtctctaaaagcgacagatctcctagacccctccttaacacaagaaaccagtcctgatatcataatggtgatcggcagactagaccttctctgcccacagatggtctgagggtgaaactcacagcattgtctctgcagtgagcccggcaaagcgtttaggctgaatttaatcatgaagacatttgcagacaactgcagaatgtagatcattgagccagacagctgacctgtcctctataaacaagtccatgtcaccaccatgcatgacaacaactataagatg

SEQ ID NO: 663258 - DNA, 1279 bp, Homo sapiens
  misc_feature (136)..(136): n is a, c, g, or t
gggtatcgtcacccgaaagcagttgtggactgtggctggctactgtgctcagaacggcttctagtgcactgcgctgtacgaggcgttaccatgcgccaacggatccctggaggaaccgattcatccgactgccagnaccacaggatctgccgcacgctactctcacttgggcctcagaggactggacatccttctggtgtagcagacccggtgacatatgcagcatttcgtaccatcatggaccagtgccccagagctcagtccagtggtacgaacactgcagagaggttccacaccgatcgcttcgtggactgaagaggactgatcgagccgcatagctggggagagcgttacggcgctggactcgcggattcagccacgtcgtcttgaccgtggtccagcacccaatgcgcaagatgcgagtcgatgcgatgagccctggaacgacaaggacatgtgcagggagcaatgcgcatgagtccgtacacatgctcacgaaggaagtgcattcaaatgacggtgaaggcatgggctgtggaacgacgggacacgcttcaatgcttttgggggctggtacgtgctagaagacgcttggctggggtcagatgggcgtgtgaagactgcaccggtgccaggagcaagtatctggtgtacgagagggtagagaaggtgaggcaaggggtggcagcaggatgaccccgaagccatcatgcgagggaccgccaagcggaatcacacacactacacccgcaggaaaaacccgatacgagcgacagccacagagcagagcccaacagccagagaccagctcacacgcaaagccacctggaaggcgacacacaagggagcaagggcgccagagtccggccgaacagcagggcaaaggagggccccaaacaacccggctggagacagagagaagaacacaaaggcaggaccactacggacatccggggcatccggggaaatgagcacagagtgacccccaggcacacgaacccttaggagaccggagcaacaacgaagaacacacgagaggacaaacgcacggggaaagccacccgacccggacaacacagcagaaagcacggcgacaccaccaccacccacgacacaacacaaaatacagtcgcaaaccagccaagagcccagccaccaaaaaagcagcaagaaataaaggaccaggaacaccaggagagcacgccacacgcgcaccctgggagacaacaaagggcccacaacaaaaaacaacgcagcacgccaccaccccgggcagcaa

SEQ ID NO: 663259 - DNA, 520 bp, Homo sapiens
  misc_feature (288)..(288): n is a, c, g, or t
atattattctgcacgttcatatccaagagcccagtctctgcgccaagtaactacatctactctttgttcctttcctcatatctttcccctagtgtaagacacgcccatctttatcaccagaatgaggaatcctggtaagtcaattgcaccatcagtgttgatatccaactctttgaaccagacgtctgcaccctttttcctgatatactgaggacactcggtctctagcaatttcttcaggtcatccctgtagacggcatggaaattcccctttatcagggagtactngtggtagacgtcgataatagagttatatgccactccagccgaggcccaatgaatcccgattgaatgcagtggatattatccagcatggccaaaagcatcccgattgaattcagtggattccatgcagcgtgtttgaatgcagtggattccatgcagcatggcccagtggttcccgattgaatgcagtggttgcaatgaagcatgattgaatgcgagttatatgccactccag

SEQ ID NO: 663260 - DNA, 663 bp, Homo sapiens
ggtccgactgtggcggccggtcgcgcggtgcgctctccctcccgtgcccgcaggctggagaggcgcttcgtgctgcacagccccgtgttcctgcctgtagcgcgcctgtcctctgccgcgctccgacgtgcgcgccgagcagtgacgcccagctgcgggacactggcacacgcaccggcacgctgtctcccgagttgccctggggctcctggggactggcgtatggtgcaaccccatgagctgtggcagctcatcaccggtatcacaggtctggatggttccatagctggctgagttcctgctggagaagaggctatgaggtccatggaattgtacggaggatccagtctcagtttaatacgggatcgagattgaggcatctgtataagaatcgcccaggctcaacattgaaggaacgcatgaggttgcactatggcgatctcactgacaggtacctgccgtgtggaagatcagttaatgcaagtaaagggccaacagagatctaacaagccttggcagcccagagagcacgtcaaacatttactttgaggctacgctgaggtacacatgcaggacgttgcacggagttgggcactctacgcacttctcagctgccagttaacgacttgatggccgttatcagactctgtgcaagttctaacc

SEQ ID NO: 663261 - DNA, 138 bp, Homo sapiens
ctaaatatatgggggagtacgtactgaggtgtaaagggatatatatggggacgtacgacgatttccgggtgttgtaggttactctttatcacggcattatactcatgaatcttgtctgaagctttcgaggcgcagact

SEQ ID NO: 663262 - DNA, 375 bp, Homo sapiens
  misc_feature (275)..(275): n is a, c, g, or t
  misc_feature (352)..(352): n is a, c, g, or t
cacggtcagcaaatgcgcccctgctaatgttggttcttaacatggttgttcttcggactttgataaagaatgaatggttttggctgggcgcagtggctcacacctataatcctagacctttgggaggctgaggggggaggatcgcttgagtccaggagtttgagaccaacctgaccaacatgacaaaaccccatctctactaaaaatacaaaaaaagtagccaggcatagtggcgggtggctgtaattccaactactcgggacactgaggcaccnagaaacgtttgaacctggaaagtggaggtttgcagtccaggtgagatggtgccactgcacttcccagccctggggtnaccagagggagacttttctctca

SEQ ID NO: 663263 - DNA, 875 bp, Homo sapiens
agcggaggtggggccctgcacccgcgcccggcaggccagccctctcctcctacctgcgtggcgcagcacatccccctatcgagaatagctaggggagatgctacgcagatagcaagtccacagtatagcgatagcaccataccgggaaatcacgttcatagatacgatccagaaagaaacaatatgagaacatataaagaacagagacataagagggaacaagcaataccgaggaagcaaagtataaaaacaataaatagacaaagacaagcagaaagaaagtcgttacgaagatgaggacaagaagaaaccaaacgttgaacgctgcacgtgtgatcacagacgaagaagaaaaaacgagaggcgcagcggcacaacagcagaaaagaccaaaagcagtaaaagccgaggcagccagagagacaaagtagcatacaagtaaaaggaaacgatagaaagtagtcaacggctagaacaatagaaagataagagtggccatgggaatcagaaaaatgggtgggatgcgcatgagatacagaacacaacaaagtatggttgaacagataaaggagcgagtaggcgcatagacgcatgggcaccgccaccaaaaggcgaacaacacacgaatgtcgctgaacaaattagcagacaaggaaaactcgaacacacagtcgatacctagaccacaagcgaactgacgagatacgacgcaaaccaaatcgaaacaccagcagtctggggaccgatcacagtatgtaaaacacacacaaggaccaaaataatatcacagaagcatacgaaaagacacggtcatcgcaaaacagacaatagcgcaaaccacaacgatgaagcgacaacgtccaaaaccaacccag

SEQ ID NO: 663264 - DNA, 90 bp, Homo sapiens
tcatacaggatctcccgggagccttaaccctagaggaggaggttgcagtgagctagagatcatgccaggcaacagaatgagactttgttt

SEQ ID NO: 663265 - DNA, 682 bp, Homo sapiens
ctagtagagcctctgttaatcgcacgaggctggacactttacagattttgctggagttccaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagatagctctcctgacttattactgtcatttgtctaaggatacagcttactgctcgatagtgttctacgcagctaacatctgtcctgaaactgtcgataagctgaataatcttacatacaggcttcatgacatatatttaacgcaacatctttttaatcctgcaagaatctgttctaagcatgtgattgcggatcactttgagcttacgttctgagatatttgtatcttgtccttggcttaacccgttgcttcccctttatgccaatctcaacacccaagttgaagcactttgtctttttgacattgtgttgtccctgatgcttgtgtctaattaaatacgggtt

SEQ ID NO: 663266 - DNA, 587 bp, Homo sapiens
  misc_feature (81)..(81): n is a, c, g, or t
  misc_feature (138)..(138): n is a, c, g, or t
  misc_feature (164)..(164): n is a, c, g, or t
  misc_feature (176)..(176): n is a, c, g, or t
ggcaccgagggggtgcgccctcgatgatcactgcgcttttttgtcagcatgtggcctcctatttatgcttcaaatcatcanacagaccccccacgcaggcccgcaccactatagtgagataaattcagatgtcaattngcctaaagtctgctccagaaggcttnaaccgtactttntcctcgaaattacctgccatttacgccttttatgccgccagcgcaatgcgctattagggtgaggagtgcgcgttgtcattagttgcctaactgtctatactcggcctccgaccgccaggggcttttgggcccgttttgatgggggtcgcactccctgggtggtggttacctgaccagtgcactccccaacaactttgccctgattgttaggggctcttcagtgtgaaaaaaagccgtgaatagccaacgacctgtaaacctagacctaaggaccatcaaactccccatcaccggcgtaacgtcgttcctgcaccgtgtatccggcatcatcctgtttcttggcctgggcatcatgctttatgcattgagcaaatccctgggttcgggagaagggtacgccgaggtgaagtg

SEQ ID NO: 663267 - DNA, 535 bp, Homo sapiens
gatgcagataacccttattatggaaacaatagtcacaatcgttcgtcacaaaactctcaaaaggcaggtgcatatatcagataaggcaatattatgcaaggattaaaatttacatttggggaaggtttacaatacagggttatgtaaagaaaacagaataaaaatacacatagatatacacaaacacacacaaaaaaggaaaaaaaataaacacacacaacccttcttaaaaaaagagaacagattacccaaaggtttaaattagaacaaggatgtcccgggatgagggactcattagggttatcttaatttccatcatactttggtgcatttaacttttcaaaaagagtctatgtaacttacataatggacacacgaacggtcggtccggttaagggatgataaaagtccctttgtggagattacaaataggaaggtatttcccggtttacagagtactttcatcggcattacctcatctgagccattcaacaactcagagaacggggtccgatgatgatctccaaagacagac

SEQ ID NO: 663268 - DNA, 101 bp, Homo sapiens
aggtcttttcccctcaaacaattaaaatacagtggcttccttggaaatctgtctcaaatctctgaatagctatagctctggcagctgcgtttcacttccga

SEQ ID NO: 663269 - DNA, 560 bp, Homo sapiens
  misc_feature (228)..(228): n is a, c, g, or t
  misc_feature (231)..(232): n is a, c, g, or t
  misc_feature (234)..(234): n is a, c, g, or t
  misc_feature (241)..(241): n is a, c, g, or t
  misc_feature (243)..(243): n is a, c, g, or t
  misc_feature (250)..(251): n is a, c, g, or t
  misc_feature (254)..(254): n is a, c, g, or t
  misc_feature (264)..(264): n is a, c, g, or t
  misc_feature (440)..(440): n is a, c, g, or t
  misc_feature (444)..(444): n is a, c, g, or t
  misc_feature (494)..(495): n is a, c, g, or t
  misc_feature (514)..(516): n is a, c, g, or t
  misc_feature (518)..(518): n is a, c, g, or t
  misc_feature (521)..(521): n is a, c, g, or t
  misc_feature (524)..(524): n is a, c, g, or t
  misc_feature (526)..(526): n is a, c, g, or t
  misc_feature (532)..(532): n is a, c, g, or t
ctactccacactgagacctactatcgctcattgcctgttcaatcagtcctagcatagacccttctaggtgaacaggcattcttagtccagacccccgtgatgtcttcaccggcgcagctcgttctcatattcgcccaaggacttgcatcctcattattattctgcctatcaaagtcaatgtacgaatgcactcacacgtcgcagtcataatcctctctcatggacttnaanntntactccnantaatagnnttnggatgacttntagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacaccaatgaggctcacncacncaccacattaacaacataaaccctcattcacacgagaaaacaccctcatnntcatacacctatcacccannntntcntancnctcaancccgacatcattaccgggttttcctctt

SEQ ID NO: 663270 - DNA, 645 bp, Homo sapiens
tggaaaggagtctcgctctgtcgcccaggctgtgagtgcaggggcgcgatctcggctcactggcaagctcggtctccggggttcatggccattctccggcttcagcctcccgagtagtcccaggagtagctggggactacaggtgcccaccaccacacccagctaattttttggtatttttagtaagagatgggggtttcaccatgttatccaggatggtttggatctcctgacctcgtgatccgcccgcctgggcctcccaaaagtgctgggattataggcgtgagccaccgcccgggcaaattttggtatttttagtagagatggggtttcaccgtgtgggccaggatggtctcaatctgaccttgtgatctgcccacctcggctcccaaagtgctgggattacgggcgtgagccaccattcctagccttaaggcatattcttaaatatacaaggtagattggttatgaaaatggcttgggggctctaataacctaccttttaagaatgagaaacggggggcttaagggagtccagtatgattcaagattgaaccattcaaatgtggctggattctgcatatatcatagatgggatccttctgagaatactgcatagggattaggacaccagccattcagtgt

SEQ ID NO: 663271 - DNA, 450 bp, Homo sapiens
  misc_feature (118)..(118): n is a, c, g, or t
  misc_feature (121)..(122): n is a, c, g, or t
  misc_feature (124)..(124): n is a, c, g, or t
  misc_feature (131)..(131): n is a, c, g, or t
  misc_feature (133)..(133): n is a, c, g, or t
  misc_feature (140)..(141): n is a, c, g, or t
  misc_feature (144)..(144): n is a, c, g, or t
  misc_feature (154)..(154): n is a, c, g, or t
  misc_feature (330)..(330): n is a, c, g, or t
  misc_feature (334)..(334): n is a, c, g, or t
  misc_feature (384)..(385): n is a, c, g, or t
  misc_feature (404)..(406): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (416)..(416): n is a, c, g, or t
  misc_feature (422)..(422): n is a, c, g, or t
cccgcgccagcatttttattattcgccaccggcctaccttcttattactaatttggcttaccaaactaaacttccaacccccttaccggcggattattattcctttttaagggacttnaanntntactccnantaatagnnttnggatgacttntagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacaccaatgaggctcacncacncaccacattaacaacataaaccctcattcacacgagaaaacaccctcatnntcatacacctatcacccannntntcntancnctcaancccgacatcattaccgggttttcctctt

SEQ ID NO: 663272 - DNA, 256 bp, Homo sapiens
cggacgccaatgagccctccccagtaatttccctgtgcctttctgatgataaaccgctgcctgcaccagcctagcagcttccagaagctgtggatgagacgcaatctcccaccaaaagccagagctcacctgcaaagcttcaatcccaagcagaaggaagcctccgttttttccccccagatgagcctgaattcacctccagaaagtctcaatgcatcacaccaagggtcacacacctgctcattgggttccgatg

SEQ ID NO: 663273 - DNA, 346 bp, Homo sapiens
cttccggggacatcttaacaccacacaggactaggtcatcatgaggtcagtcgagtctttatggatggaacgcgtacttttccctactatggggatgagatcctagacctttacgtccgcgatgagctcgtcataccgtatgatattctgcctgatgcactgcacggcggatgctatgtggatccaatgtgtgcacatctgcgagcgattaccctgtgcatgagagagaagattggatttccagccactagtagctagcctatagctcctgaacatccttccttccatctcctgatccacttattggatgacattatataaaggttgctgcgtgatttatctcatg

SEQ ID NO: 663274 - DNA, 535 bp, Homo sapiens
  misc_feature (228)..(228): n is a, c, g, or t
  misc_feature (231)..(232): n is a, c, g, or t
  misc_feature (234)..(234): n is a, c, g, or t
  misc_feature (241)..(241): n is a, c, g, or t
  misc_feature (243)..(243): n is a, c, g, or t
  misc_feature (250)..(251): n is a, c, g, or t
  misc_feature (254)..(254): n is a, c, g, or t
  misc_feature (264)..(264): n is a, c, g, or t
ctactccacactgagacctactatcgctcattgcctgttcaatcagtcctagcatagacccttctaggtgaacaggcattcttagtccagacccccgtgatgtcttcaccggcgcagctcgttctcatattcgcccaaggacttgcatcctcattattattctgcctatcaaagtcaatgtacgaatgcactcacacgtcgcagtcataatcctctctcatggacttnaanntntactccnantaatagnnttnggatgacttntagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacaccataggactttttcatcaacacagttataacatgaaaccctgattcaaacgtagaaacaccctgatgatcatacacgtatccccgagtttgaagacactcggggatact

SEQ ID NO: 663275 - DNA, 935 bp, Homo sapiens
gggcaactgacacgaactgctgactactaccactccttctggcagctcctgcttcctgcagcccccctcttctccatggcagctaaactgaactggaccaacatctcaaaaatccacgactgtcactcggcacacccgctcagcacacactcctcaccaagcttcaaacacacgcaactggctggcctactgactcccgcactgcagcagaactcgccgcccaccaggccctgccaccacccctacttccaagaacagagaaacagtcccctaaacgcacagagcgacgcgaccgctcccaacgagcacgcacgcgcaccggcccaatgctcatgcgaacactgcccaaacctaacacgctctccgcgcgcagctggctcagcaccctgctcgctccttacctcccagcccccaacgcctgcccagctcccgatgcccttgcgcactcctggcaaaacacacactgcgacaccacgctgcccgcgctgccctgcagcaaccccctcgacacacgcatgccactcacacctgccgcagccacacgaacaggctagccgccggcacaaccaagctttcatcctgaaccggacggccttgaccttctttcgaaacccccatgcccccaaggacccgcccccacctgcacaactctatctggatgatccttcggtacacttctgtcttcctatcttggagccacgcaacacagcacatcccgccaacgaaacgggaccccttttacacgccccttgtcccccccggaccaacgaccaaagcatggctcggcacattgccccccaacccaactaagcttggccgccgaaaaagggcacgggaacgcacctaaaaccctagaacgcccagccacccggacccgcagtcatcgagaccataccagaggaacagccaaaccacccacacgccccccggaaccc

SEQ ID NO: 663276 - DNA, 508 bp, Homo sapiens
  misc_feature (228)..(228): n is a, c, g, or t
  misc_feature (231)..(232): n is a, c, g, or t
  misc_feature (234)..(234): n is a, c, g, or t
  misc_feature (241)..(241): n is a, c, g, or t
  misc_feature (243)..(243): n is a, c, g, or t
  misc_feature (250)..(251): n is a, c, g, or t
  misc_feature (254)..(254): n is a, c, g, or t
  misc_feature (264)..(264): n is a, c, g, or t
  misc_feature (431)..(431): n is a, c, g, or t
  misc_feature (444)..(444): n is a, c, g, or t
  misc_feature (449)..(449): n is a, c, g, or t
ctactccacactgagacctactatcgctcattgcctgttcaatcagtcctagcatagacccttctaggtgaacaggcattcttagtccagacccccgtgatgtcttcaccggcgcagctcgttctcatattcgcccaaggacttgcatcctcattattattctgcctatcaaagtcaatgtacgaatgcactcacacgtcgcagtcataatcctctctcatggacttnaanntntactccnantaatagnnttnggatgacttntagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacaccaatnggctcactcaccnaccanataacaactataacgctaattcacagcgagaaccgtcgattcgagagatctgtagagta

SEQ ID NO: 663277 - DNA, 721 bp, Homo sapiens
  misc_feature (18)..(18): n is a, c, g, or t
  misc_feature (69)..(69): n is a, c, g, or t
  misc_feature (125)..(125): n is a, c, g, or t
  misc_feature (130)..(130): n is a, c, g, or t
  misc_feature (150)..(150): n is a, c, g, or t
  misc_feature (160)..(160): n is a, c, g, or t
  misc_feature (167)..(167): n is a, c, g, or t
  misc_feature (172)..(172): n is a, c, g, or t
  misc_feature (181)..(181): n is a, c, g, or t
  misc_feature (183)..(183): n is a, c, g, or t
  misc_feature (213)..(213): n is a, c, g, or t
  misc_feature (232)..(233): n is a, c, g, or t
  misc_feature (287)..(287): n is a, c, g, or t
  misc_feature (301)..(301): n is a, c, g, or t
  misc_feature (304)..(304): n is a, c, g, or t
  misc_feature (329)..(329): n is a, c, g, or t
  misc_feature (376)..(376): n is a, c, g, or t
  misc_feature (388)..(388): n is a, c, g, or t
  misc_feature (406)..(406): n is a, c, g, or t
  misc_feature (419)..(419): n is a, c, g, or t
  misc_feature (430)..(430): n is a, c, g, or t
  misc_feature (476)..(476): n is a, c, g, or t
  misc_feature (485)..(485): n is a, c, g, or t
  misc_feature (505)..(505): n is a, c, g, or t
  misc_feature (509)..(509): n is a, c, g, or t
  misc_feature (517)..(517): n is a, c, g, or t
  misc_feature (556)..(556): n is a, c, g, or t
  misc_feature (580)..(580): n is a, c, g, or t
  misc_feature (613)..(613): n is a, c, g, or t
  misc_feature (619)..(621): n is a, c, g, or t
  misc_feature (626)..(627): n is a, c, g, or t
  misc_feature (639)..(639): n is a, c, g, or t
  misc_feature (661)..(661): n is a, c, g, or t
  misc_feature (720)..(720): n is a, c, g, or t
gtaataagaatcatggcngctttgctgttcgtgctgctgggattcgcgctgctgggcacccacgtgagnctctcggggctgccggcacagtcttcactaccgtagtaagaccttggctccaatanactcntcacctgctccttgaatganagcgccacanaggtcanagggnaccgctggntnaagggggttcttggtgctgaaggaggacgngctgcccggccagaaaacnnagttcaaggtggactccgacgaccagtggggatattactcctgcgtcttcctcnccgagcccatgggnacngccaacatccagctccacgggcctnccaaattgaaggctgttaagtcgtcagaacacatcaacgaggggganacggccatgctngtctgcaagttagagtcnttgccactctgtnactgactgggnctggtacaagatcactgactctgaggacaaggccctcatgaacggntccgagagnaggttcttcgtgagttcctngcanggccggtnagagctacacattgagaacctgaacatggaggccgtccnctgccagtaccggtgcaacggcancagctccaagggctccgaccaggtcattatcantctccnnnctgcnncactctggccgncctctggcccttcctgggcatngtggctgaggtgctggtgctggtcaccatcatcttcatctacgagaagcgccggaagcnc

SEQ ID NO: 663278 - DNA, 507 bp, Homo sapiens
  misc_feature (228)..(228): n is a, c, g, or t
  misc_feature (231)..(232): n is a, c, g, or t
  misc_feature (234)..(234): n is a, c, g, or t
  misc_feature (241)..(241): n is a, c, g, or t
  misc_feature (243)..(243): n is a, c, g, or t
  misc_feature (250)..(251): n is a, c, g, or t
  misc_feature (254)..(254): n is a, c, g, or t
  misc_feature (264)..(264): n is a, c, g, or t
ctactccacactgagacctactatcgctcattgcctgttcaatcagtcctagcatagacccttctaggtgaacaggcattcttagtccagacccccgtgatgtcttcaccggcgcagctcgttctcatattcgcccaaggacttgcatcctcattattattctgcctatcaaagtcaatgtacgaatgcactcacacgtcgcagtcataatcctctctcatggacttnaanntntactccnantaatagnnttnggatgacttntagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacaccaaggggttctcccaagctacaagaactgtagtaaaataaagcccctattcacagcgagaaacaccctatgatcataacac

SEQ ID NO: 663279 - DNA, 238 bp, Homo sapiens
  misc_feature (82)..(83): n is a, c, g, or t
  misc_feature (218)..(218): n is a, c, g, or t
tttccaagtgattaaatgttaaagtcatttttacagccttggcaacgtagggagacctcgtctctacaaaataaaaacaagnnaaaatctagctgggcattgcggcatgtgctacgggcccagttgcatgggaggcagaggtgagaggattgcttaggcccaggagctcgaggctgcagtgagccatggttgtgtcacacttcactccagcttgggcnacagaggaagaccttgtctc

SEQ ID NO: 663280 - DNA, 209 bp, Homo sapiens
gtgcaggtgaccagctgcagcagccgtggcatgcagccacctgacgggtcgggcagctccgcaggctccagatagacctgctgtgaggagttggctgagaggcgtgctgtcctcgagtacctgttaccagagcatcacgcattgtacacaaaccgcggtgtttggctccgcagcataaaagaaccacgcgaggatacccccttaggtgg

SEQ ID NO: 663281 - DNA, 129 bp, Homo sapiens
cgccgggatatgactagacagcaaaaaaggaaaagttaaactaaaaaaaaaaaaggccgccgtgacctattcaccctccacttcccgtctcaaaatctaaacgtggtcacgagatggggatcctctaaa

SEQ ID NO: 663282 - DNA, 99 bp, Homo sapiens
acctctctgtacttctgtgccagcagtttatccctttttccgaaagggggtctactttggggctacaccttcggttcggggaccaggttaaccgttgta

SEQ ID NO: 663283 - DNA, 726 bp, Homo sapiens
ggattatggatatagtgatccagcgcctgcgattctacttaggtgcctgcatacatttaatcacgatgacaggaaacgatttagagtcaagaagacttttatttatgaacctttgaaaggatcgtcttgtatggtgaattttctaggagcgatgatgtactgtaattttatattaatgtatttatgatttatgattatttattagattttatttgtaaatgcttgttctaagacatttctgaatgtagaccattttccaaaaaggaaactttattttcaaaaagcctaatccgtagtaattcctaatcttggagaatacacaagggcggtggaggggaaaacattaagaatttattcattatttctcgagtactttcagaaagtctgaccactttcattgttgtgccagctggttgacacttaacaactctgatattacttacaatgaggatttttatttattgttttttgcttaaacatatagtaagtctagaagtttaaaaagctaaaagttcaaaatggtgtaataatgacaatctaacactcaagatagttctaaaaggacatcagtagttaaggatcactgatttcaaaatattgtaaagcataacctaactgatggtagggatgattgtatcttgaatatgtgaaagggccaatactatagtaggacaaaccttgcattgatatcatactgtgtgtaaagggcttaattaaggacaagag

SEQ ID NO: 663284 - DNA, 122 bp, Homo sapiens
agcgggctatttgcggcgccttccagctatgatcttagcttctcaagtcatttcatgcaagaatatgaaaaattaaattgagatccaggttcttctctcattttttagcgaaagggcaccgc

SEQ ID NO: 663285 - DNA, 196 bp, Homo sapiens
tgacgtggtgaagcttagcatgtactgcccggaggttggatctgcatccgaggtcgccccacactgaaatttttaatgcaggtttggtagtaaaggacctgtgggttagtaaggtactgtattgcatataataaacttaaaggctccattagggttcttctcgtacctgtgctgtgtcagtgcccgccgtcttcac

SEQ ID NO: 663286 - DNA, 388 bp, Homo sapiens
  misc_feature (341)..(341): n is a, c, g, or t
  misc_feature (369)..(372): n is a, c, g, or t
agggccctggtaaagcccaagagggttaagcccccagtttccccccaagtgtcaccggcaaggtcggattgaatttgcctacattggccccccccaagttgggaagcgtgctcgtgcccgtattgccaaggggctcaggctgtgccggccaaaggccaaggccaaggccaaggatcaaaaccaaggcccagggtgcagccccagcttcagtttcagctcaggctcccaaacgtacccaggcccctacaaaggcttcaaagtagatatttttgccaacattaggacaaaaggactggtgcgaccccccccccccgcccctggggtaccatttgcatgggaanaaaggtcctcctgtgctatttgtacaannnnttttttgaagcccaga

SEQ ID NO: 663287 - DNA, 541 bp, Homo sapiens
ttgtgctgaggtgatctagaggatcccatttcagttctcacacccagagctctacacatgtgaggctaacactgcagccacacccatcatcacattgtatggggcagttcttgacctgtgtgagagcagagaagacacctataaatgggcaaaaccaaggccttccattgaggggattttaagtgttcaggaaatgagatgaggtccagggggatttgtattatagaaactgcagctgaatttgagataaagtaaaaccaccaaattgtttagtttggggcttccattccaatggttaaaggaactaaacattgtttgtgagtaatttaaaaccgggaaggggaagtgtaggatgtcctaattgggggtagggcggatacataatatatattttaaatttctggtaggcactggccaagtcttggaattcaacattcaagtacccctgggaatagggagctataccaagggaaacttgaaaatggaaggcccggggtacccggagcctccgaaatttcggtaattccaatggttcataagc

SEQ ID NO: 663288 - DNA, 442 bp, Homo sapiens
aatacagcacttacgtatggaggaaatggcatctttcagctatcctaagagcgtgtggatggcaaataccatgggaacactggaaactacaaatggtgccagacctagagtatagaggtcgcacacaccctctataaaaaacttccagagactctagcacttcctgaataatattaagtgtcaccataagagggcactctcaatcacagagagacaccatacccatggcaagctaccggtaatctatctagaaaggacagggctacaaaaagtttcctagtaaacaactttaaaaatttacaacagtaatctacccccctcatactttggagaaagaaaaaaatcttttcaagattacaaataggaatccatattacaagtaaggggcaggccatgcacagtgggccacacctcttgaaggaacccacgccgggatcctcta

SEQ ID NO: 663289 - DNA, 318 bp, Homo sapiens
cggaggaactgtacaggatgggtgagcggtagatctgtattataacttaatcaagtaaataactagccaggtgcatggatcaagcctgtaatcccagcactttgggaggccgaggtgggcagatcacttaaggccaggagttcgagaccagcctggccaacatggtgaaccctcgtctctactaaaaatacaaaacaattagccggacgtggtggcacatgccagtaattccagctactcaggaggctgaggcacgagaatctcttgaacccaggaggtggaggttgccgtgagccgagatcatgccattgcactcca

SEQ ID NO: 663290 - DNA, 426 bp, Homo sapiens
  misc_feature (211)..(211): n is a, c, g, or t
  misc_feature (213)..(213): n is a, c, g, or t
  misc_feature (313)..(313): n is a, c, g, or t
  misc_feature (324)..(324): n is a, c, g, or t
  misc_feature (347)..(347): n is a, c, g, or t
agtagatctcccgtttgatccagcaatcccactactgggtatctacccagaagaaaataagtcattatacaaaaaagatacttgcacacacgtttatagcagcacaatttgcaattgcaaaaatatggaaccaacccaaatgcccatcaatcaatgagtggataaagaaaatgtgagatatatatatatatattatatatatatatatgantnctactaagccataaaaaaaagaaataatggcattcgcagcaacctgggatgggaattggagattaattattctaagtgaagtaactcaggaatgggaaanccaaaccagtngtatgttctcactcatgtggggngttaagctattgaggacgcaaaggcattaaggtttggtacctttggtctttgggggctcaggggaacattggggttttt

SEQ ID NO: 663291 - DNA, 224 bp, Homo sapiens
atatacagactcacttatataagcaatcaaagactaagttccttcctaaggaatgtgatttcgaacacaaggctttcatttgacaacttgtgtttgtatacagaacacagacgtacatgtacacacacacacacacacacacacacacacacacacacacacacataaaagagtgcgaggaagtgtgccacacatgtgtaagcgccatctactccccgacaaca

SEQ ID NO: 663292 - DNA, 430 bp, Homo sapiens
  misc_feature (1)..(1): n is a, c, g, or t
  misc_feature (3)..(3): n is a, c, g, or t
ngnttcgagctcggttcgggaccagcctgggcaacatggggagaccctgtctctacaaaaaattaaaaaattggcttggcatggtggtgcacaactgtagtcccagctactcgggaggctgaggtgggagaattgcttgagcccaggaggtcgaggctgcagtgagccatgaccacaccactacactctggcctgagcaagagtgagaccctgcgtttaaacaaaacaaaacaaaaacaaaaacacaccaaagctaaaagcttctctgtgatttaaaagatgtagaactagaccagcctgtccaacatggtgaaatgccacctctactaaaaatacacaccaaaaaattagttgggcatggtgggcacgtgcctataatcccagctactctagagatgctgaggcgggagaatcgcttgaactcgggagg

SEQ ID NO: 663293 - DNA, 130 bp, Homo sapiens
ataggccgcaaagcactccaaattaacttgcagattctgcagaaagagtttttcaaagcgtgctcaagtcaaaagaaaagttcaactctttgagatgaatgcccgcaccgtggtaccggagctcgatatt

SEQ ID NO: 663294 - DNA, 347 bp, Homo sapiens
tctacggatcctcacactgggttcgagttcgagaccagtctcttacacgggaaacctcacctggccacagcaggactacagtcaatgacaatcacatgtctctgcggagttgcccaagccctccatctccagcaacaactccaaacccgtggaggacaaaggatgctgtggcctttcacctgtgaacctgaggctcagaaacacaaatctacctgtggtgggtaaatggtcagagcctcccagtcagtccccaggctgcaaggttgtcccaatggcaacaggtacctacactctattcaagtgtcacaagaaatgacgcaagagcctatgtatgtggaactccgaaa

SEQ ID NO: 663295 - DNA, 153 bp, Homo sapiens
atcagcaacgcaccactgcactccatcctggggtacagagcaagactccatctcaagataaaaaaagctaaaagtacatcactaaacaatcaaatgaagactatgctgggcgtggtggctcacatctgtaatcccagcacttgaggaggcaga

SEQ ID NO: 663296 - DNA, 206 bp, Homo sapiens
gacaggacgctcctgcaactcatgctcccgaaattcaaaggatcattagtggctgctagtgcgtcactatatgccaatcaactggaaaatctagacgaaatagataatacctagaacctacaacccagcacgattgaaccatgaagaaatccgaatcctaaagagaccaataataagtgatgaggttgaagctgaagtcatgcaaa

SEQ ID NO: 663297 - DNA, 496 bp, Homo sapiens
  misc_feature (29)..(29): n is a, c, g, or t
  misc_feature (32)..(32): n is a, c, g, or t
  misc_feature (494)..(494): n is a, c, g, or t
  misc_feature (496)..(496): n is a, c, g, or t
ctgctgagggggcgggggtatattctcangtnagtttttaatctcacgtttggtttccttgtgaaggtggagggaaggttataatagcctaacactaccccacccccaactaggaggaacctctggtttcaagagagatgcctgtcctgtgcttggatgggggggcaattatttgggtgtgaaacaagggacaaatcaatggtttgaaaataatgatctcagactttctaaggtaaattttaaaaattttgattggttggcatatggggtgggtttactcttagaatcggatgctggagaaatgctcaaaagggcatatgggactcaggccttagggggtctttttcttttaagaaataacctcttacaggtggaaccattgggggtctggccacttctcggtggtggtctggggcacatatcggaaggagtacagcgcgggggtctacacggctgggtagggggataaggcactggtttctttatttctttanan

SEQ ID NO: 663298 - DNA, 203 bp, Homo sapiens
gctcaggttgttctagaggatcccagcactgtttgagtctgctctacacctggtcagtcctggcagctgtcatctgtgtggccatgagcctgagccaggtgcttgatcttgggcttcctgtgcctgctgactccactgggggtgtagcatggcctggaatggaggcttggcatggcctcgtggtaggtacaccattgcttgat

SEQ ID NO: 663299 - DNA, 276 bp, Homo sapiens
gggcccccttgtgaattgcttgctgcttgtggcttcactgtgtctggtgttgacagtgcatacctaaaggtgcttgtttgcactgtgacttcacatatctactagggttattttcaactgctgaatttggaatgatttttatctcttttctgctttctgcccatgtacatgtgtttattttacactgtcgtgattggtactctctgtgtggggacacaattacttgcggctgaaataatccacctgttcgtggttgggcgtcctctggaggcattc

SEQ ID NO: 663300 - DNA, 299 bp, Homo sapiens
tttttttttttccttagtctagccaatggtttgttgattttacttatcttttaagaaaatccactttccatttcattgatcttttttattttttagtctcaatcctgttaatttctgtttatctttactccttctttctaattttgggtttggtttgttcttgcttttctagtttcttgagttgcatcattaggttgtttctttgaaatctttctactttttggatgtagagcttattgctataaacatgcctcttaatactccttttactatatcccataggttttggtatgttgtgg

SEQ ID NO: 663301 - DNA, 337 bp, Homo sapiens
  misc_feature (4)..(4): n is a, c, g, or t
  misc_feature (17)..(17): n is a, c, g, or t
  misc_feature (59)..(59): n is a, c, g, or t
  misc_feature (86)..(86): n is a, c, g, or t
atanccctgtgaggtgntcaaattaatatttcaaagacataacactgaaaatcatatantttaaattcaattatacatgattatcnttcaggaaatgagaaattaaaacataggtcaacattattttaggctcatacatgtaacttccttatgcattgagagagaaaatttaaaaaaaaataatatgaaaggatattgtcactagctttcattctttttgcttttttacttcatttataaaaacatgcatatggaatagtacctagggtcaaacagtgtcaaatatagttttgtagccaggcatgtttgctcacgagtgtgatcctagcattttggg

SEQ ID NO: 663302 - DNA, 349 bp, Homo sapiens
cgctgttgcgcgtgccgtcgcgattcgcatcgccttcgatgttgcgcgtcgccggatcgtcgggtggaacgtcggctagaatctcgttgatgacgagcggaagacggacttcgagcatcgcttcgtccgagattgtgccgcccataccatcgggcgcgctcacgcgcactttcgcacgcccgacgccgacgccgcgcgcttcgccttgcgcgttcaccgccgcgatctcggcatcggtggtggaccagtcgaaacgcacgccggtgatctcttcgccccgttcattgaaagcgcgcgccgcgaactgccgaacgtttccgcgattgacgctcgcttgtttcggttcgat

SEQ ID NO: 663303 - DNA, 280 bp, Homo sapiens
ctctattaaaaaataaaaaatttaaaaattaaaaaaaaattttggctgggcgctgtggctcacgcctgtaatcccagcactttgggaggcccaggtgggcgggatcacctgaggtcgggagtttgagactagcctgaccaacatggagaaaccccctttacagaaaatacaaaaattagccaggggtgggggcatgctcctgtggtcccagctactcaggaggctgaggtgggagcccccgcgtccgatcccctcttccgctgttttagctgaagaatta

SEQ ID NO: 663304 - DNA, 550 bp, Homo sapiens
gaaatttcaacagggcataatggagaaggctctctcttctctgggtgatgtccgctggggctgaaatgttctagatagcttcttcactcacatgtctagcacctagctaggatggctccaatggccgggggttagaacagcttgactgatatcatatgtgtggggccttggttctcacaattgattgggttctttggtttttctacaagtagttctaggacttctgttccacatggccaatccatgtagcctctacagaaagatagccgacttcttacatgcaagctcagagttcccaagaagattaggtttagaactaacacactgtcacttctgttacattctatcagataaaggaaataacaggcctagagtcaagaggaggaaactacataagggtgtaaatactaggaagtaggatgaacctggggccaccaattgatgtaaccaactaccacagattgtcactgggcaaaaataaccacacgctctttacaaggggcataatctagaacataaaaatacagaaagtttgaaagtaaaaaaaaaa

SEQ ID NO: 663305 - DNA, 377 bp, Homo sapiens
agtcagagtagttctagatacaccacctgataaatcagagtagttctagctacaccacctgtaaagtcagagtagttctagctgtacctcctgataaagtcagagtagttctagatacaccacctgataaagtcagagtagttctagctacacctcctggtaaagtcagagtagttctagatacaccacctgataaagtcagagtagttctagatacaccacctgataaagtcagagtagttctagctgtacctcctgataaagtcagagtagttctagatacaccacctgataaagtcagagtagttctagctccacctcctgataaagtcagagtagttctagctgtacctcctgataaagtcagaggtcgacgc

SEQ ID NO: 663306 - DNA, 531 bp, Homo sapiens
ggtgactctaccgagcttattacagcgcaggcaggcatgaacttgatggaaaggagacaagtccaactacccgagtccgtgtctaccagattcctgggacgcagaaattgtagattactgcctctgaactcacggctggtgtacccaataacggtggggacatgtgtgtcagagggacgctaccctgcaggaactcttagactggcacttggattgggaagcccctggttgcctaactgagcaagggacgtatctagtgaagtgaacgagaccagagagacaccactgaggacagggctcattcacactagcatgtcggagcataataggttgaccccatggcccggtggaggagatccccgtagccacctatctccttgtagctatcagcccatggccttaccccgacacacgggccttgctgcacaagaccccataccagcaccccgtgtactgggagccatgtgcctcttggatggaggtccaacttggtgtgtggatcccagaaggtggcagcagcaagctccatgg

SEQ ID NO: 663307 - DNA, 651 bp, Homo sapiens
aagtagcgattttattatcaatgttattcattcttttgaaatataaagtacttcagctgaattaaggttgcagataatttttaaaatacaacacacatcatgactagtatattaaaattatttatattcagatatttatatctaatatcaaatgaaaatttactaccaaattttcacagtagacattaatcagtctgacatgcttattgatcccataggtgtaattatagatcaacatgattttagtgtctattcttttattttactaaattaggaacgcagcatttacagaacaaataaacacaagtgacgtggccaccccaggatctaacagctcttcagtgagctatgttgcaagctcagaagtaatccactaacgaaccaagtcagactccagttcttcatcaaaaggtgctggtggaggttgtcagacgccttccaatatagatccccaatccgatggccagcaaatgagagagcagcagagatggaaggaaaactttcagaaattctgcagagaatatgccccccttcttcatgacgctcgtgttcctcatgctgagggtggccgtgcgccttgggtgttttaaaaggaacttctttggggggatattttccggccgaccttgacaatcccatttccaaactgag

SEQ ID NO: 663308 - DNA, 202 bp, Homo sapiens
cttcttacaattatattagcctgtcacaaaatgtacttgtgcaaaatcatgtgaatctctcaggatgagcaccgatctagtgaaggagtccggccctgtcttggacagttcgtaaatcagctccttcacgtcgtcagatgtcaacttcaaccaagtggggacgctgcgtcgatcgggtacagccgacctgcgagcaggcgta

SEQ ID NO: 663309 - DNA, 595 bp, Homo sapiens
ctccacgagggtgcagcgtgtctcttactaataaccagtgaaattgacctggccgctgaagaggcggtcatgacacagcaagacgagaagaccctatggagcttgaatggtattagatgcaaacagtacctaacaaacccacaggtcctaaatgtaccaagagttcgtgcattaaagagatctcttcgggtgtggggcgagcatcgtgagctagaatgcgcagtcctccgagtcagtacactgctaaagacttcacctagtcaaaggcgaactactatacgtcaatggatccaataagctgggagtcaacggaagaagttaccctagggataacagccgcgaatcctattctagagtccatatcaacaatagggttctaacggagctcgatgtaggatcaggacatcccgatggtgcagccgctattaaaggttcgtttggcaagcgattaaagtcctacgtgatctgagttcagaccggagtaatccaggtcggtgttctatctagcttcaagattgcctcccatgtactgaagaggacaagagaaataagggctacttcacaacagcgccttcccccgtaaatgatatcatct

SEQ ID NO: 663310 - DNA, 441 bp, Homo sapiens
ggttccattcacggatttcccctatttcaagggtacccccctagaccaaaccttacgccaaaatccattttcctataaaatttatgggggtaaatttaacttttttcccccaacactttttgggcctatccggaaagccccgaggttactgggactacccccgagcaaacaccacatgaaacatcctatcattggtagggtcattcatttttttaacagcaggaaaattaaaaattttcatgatttgagaagccttcgctttgaagcgaaaagtcctaaaagtaaaagaaccctccataaacctggagtgattaaatggatgcccccccccctaccacacatttgaagaacccgtaaaaataaaatttagacaaaaaaggaaggaattgaaccccccaaaggtggtttcaagccaaccccatggcctccatgattttttta

SEQ ID NO: 663311 - DNA, 183 bp, Homo sapiens
aagtctgcaaccatctacttcaagtccagaaacatgatggccaggatgagattatgaaaaacgcgcctttgaagaagatgtcggagagaagccgcaagttccagattctcaatgatgcgatcatcaccatcctgcataagtccctgaagtcaggcgacggggagcgcacgccagtggagcatg

SEQ ID NO: 663312 - DNA, 439 bp, Homo sapiens
  misc_feature (189)..(189): n is a, c, g, or t
  misc_feature (218)..(219): n is a, c, g, or t
  misc_feature (262)..(262): n is a, c, g, or t
  misc_feature (312)..(312): n is a, c, g, or t
  misc_feature (315)..(315): n is a, c, g, or t
cgggaaggaaacaggtgtcccgcggcggccaaaccttcggcagcaagcccaaggtcgccttgctcaaccccaaggcggtctcatggcacgggcctctcgaaactgtgggcaagaaagggtcctcgtgagaactaggctcagaagaagagcggggcggcgccacctcggggggagcggaccaggctgtgncgcaagggcgcgtccgggtccgcgtgtgnnttcgccgtgaatgagctggtgccgcaccaggtgggtcttgcgnctgaagctctttccactgcgggcaggagaagggcgggagcctgtgtggantcnctggtggcggactaggttggttttggagctgaagctgcggggcagacggcgcaggcgtggggcggctgccagtgtgctgcctggtggcggcccaggtgcgacttgcggctgaagcggcggtcgc

SEQ ID NO: 663313 - DNA, 636 bp, Homo sapiens
catggtaaaaccccgtatctactaaaaataaaaaaattagctgggcatggtggcagatgcacctgtagtcccagctacttgggaggctgaggtaggagaatcactcgaacccaggagcagaggtagcactgaatcgagatcgtgccactgcgctccagcctgggcgacagagtgagactccatttcaaaaaaaaaaaaaaaaggttaaaaagacaatctacttaagggggaaaaattttttaaataatatttcttttaatatcagggtcctggtatccagatttattataaagaactcttacaactcagtaataaagagacacccaattaaaaaccggacaaaatactttaaatttaatatttccttcaaagaagacttttaagggctaataagcacttgaagagattgttcaccattcaatagtcattagggcaatggtaagtcaaaatcataagggagcgggcagttcaaacccacgtgggatgggctataatcaaagagacaaacaatagtgtcagggtctgggagaattgggacctttttatacttggctggggggattgtaaattggccacagccactctagaaaacactttaatagtgcctgaaaatgttagtaagttagatatgaccca

SEQ ID NO: 663314 - DNA, 988 bp, Homo sapiens
  misc_feature (15)..(15): n is a, c, g, or t
tcttgttgtcacccncgctgtacggatatcgtcgacccaggcctctgccacgcgtcgggtcccgctgcttgttgagatgctccaggggtgctacctggctgctccgacaggcgctggccgagtgcctggggaccctcatcctggtgatgttttggctgtgtgctcctgtggcccagtgttgtgctcagcctggggcacccactggtggtttcctcaccatcaacctggcctttggctttgctgtcactctgggcatcctcatcgctggccagtgtctctggggcccacctgaaccctgccgtgacctttgccatgtgcttcctggctcgtgagccctggatcaatgctgcccatctacaccctggcacagacgctgggagccattcttgggatgctggaatacgttcatgggctgtattatgatgcaatctggcacttcgacgacaacacagacatattaatgtaatcgggccccaatggcacagccggcatctatgctacctacccctcatggacacttggatatgatcaatggcttctttgaaccagttcataggcacagcctcccttatcgtgatgtgtgctggacattgttgagccctataaccaacccgataccccgagtgcctggaggcacttcaaacagtgtggcctggtggatcctggtacaatatggaacctcccatgggcttcaaacatccggctattgccgtaaaaccttgaccaggagacttttggcacacgacttaatacaagaccttgcagcggcttgagaggcatcattgaatgtacttacaacgaacacgtgcaagccataggactgcaataggagtgaccaaattcgagatatacaccaacaaaccattgaaggacaacacaatagaagagaattagacacatcaaaagtacccaagcataacatgaatcagagatagccaccctgaaggcaaacaacacaaacgccaacaaaacgaaagacaatacaaac

SEQ ID NO: 663315 - DNA, 498 bp, Homo sapiens
cgactctagcaggatccttttgatatgctgtctaaataaaaacaaaaaaataaaaaaaatttacgggcagagtgagataagggcacaaaaggtcagggaagcagcaggaaccagttgacttgggggtggggaggtaaggttggaataatttctcagttctaagggaagagagggtgaggttggagcagcaggaataacaggtaagttttcagatgagccagatggtgggtggggtgcagtgggactacaggcacgcgccattacactcggatttctgacagtcagatttgtccacaaaactctcaattgggcagggctgctttcctgtgctaaaatctgggggagctagtggggccccatgaagatcttctgcagtcggcccaatccgaccacggggtcgggggagtggttggaggagctgggtgtagaccccgggggtgtggatcttgcagtgagctgaaatcgcgccagagcactccagccggggcgacagagcgg

SEQ ID NO: 663316 - DNA, 123 bp, Homo sapiens
gagcagctctcagttcgctccttcacagatcaggctggcagggccctgttgtccggtctcgctttgtctgcagagtttgctaacgctcagggggctcttaggtcctcgggagaagggaccaca

SEQ ID NO: 663317 - DNA, 176 bp, Homo sapiens
  misc_feature (55)..(55): n is a, c, g, or t
  misc_feature (58)..(58): n is a, c, g, or t
tgcctgggtgctctgaggactcccggtccgctcggaccacccgatccggatagtngtnccgatacctacacatgtcctcgtggctcgccagtttctggaccctgtcattctggactggaacgagctgggccgcgccgtccgcggctcctccgactcctcgtcctcgtccgagcgga

SEQ ID NO: 663318 - DNA, 859 bp, Homo sapiens
atgacgtcccatccacagctgggatgccgatggaaatggcatctgccataaaagaaaagcgagggataaaaagcccaaccgatgtggggcatagatgccaaggcgcgaagagtcagtctacggtcttgtagagaggctggtcgctttgttatatgtttagtcccgttatatagaacatttcgctcctccttggatacatcggaagcggaactgtctgcccagcgagcctgagccctcaggctgttggaaaagcatctgatgccttgtattcctttgactaggaggagtcattctacgtgaggttccttgatcgttggtttaagcgtcaactccagcactaaatacgagcaaccagtgctggagcttgtaatggtgtcgactgctgctgcaagtgcttgtctcctgtcggtgcagtgacactgtcattgacagcatctgtgcgttgcgtgttagtgtttgcaagatcctctgacaatgatctggcttatgtcccagggacgtggtatgtgtacttagctgagcaagccatagtacaaggacagcctgagaaatagttagactcttccacttcccttcaaggagctgtgaactcagatatgtaagtcagcttctcaggtggtcggacgtgtagagcgtaccactaggtaaaagagagtccagcacctcagggctctctgccttctatgtggcgaaattaaggtcttgccaatataatcttcctcttccaaaccattggtttcagtgcccctgctgggatcacagaatgcgcacaacggggtttggatcaagcggggaacccccgacctttaatgttgccttgccaaagccccttgggggaaaaacccgaaaccaggaaaga

SEQ ID NO: 663319 - DNA, 403 bp, Homo sapiens
agtaaaagggttcgtggctggcagcattatactatgaatggagaccgatgggtagtgaagcaatggttggccgtccaacttcagaggctgcgtggcgggggtctagttctgcatctgctcaaagaacttgtaggtaggattttcgtagccgttctgctgcatcttggacaggtggcgctcctctggggtgacagcggcgtcaacctccaccacaccaggatgaatggatgtgtactgtttcttcttcagcatcaccaaggtgatgacgatcactgtcgctatgacaacaccgcccaccatgagtccaatgatggcacctttgtttgaacccacatcttctgcaaagaacaccaatttttgatgatgaacttcatatcctgagtcatgtcggaattctgcatcc

SEQ ID NO: 663320 - DNA, 151 bp, Homo sapiens
  misc_feature (52)..(53): n is a, c, g, or t
  misc_feature (90)..(90): n is a, c, g, or t
  misc_feature (102)..(102): n is a, c, g, or t
gtgtccctgatgaggatgaggggtggctgtctgatggcactggggctttctnntctccagggcttcaggccaaaaaggacctggagagtntcatccagagantatcccagctggaggcccagctcccaaaaaatggactagaagagaagct

SEQ ID NO: 663321 - DNA, 136 bp, Homo sapiens
aaccccgaattcccgctttttgggcggctgaagcaggagaatggcctgagcctgggacgtggagctcgcaatgagccgggatatcgccactgcactccaccctgtgtgaggtaccgagcctccatttgtaatcatg

SEQ ID NO: 663322 - DNA, 531 bp, Homo sapiens
gagcggggcatcgcggtggtcgctggacttggggatgggcgtgagccccagccgctagtgctggtggccgccgctgctgccccgagctggagcccgagccgccgcctctgtgtccgctgcgtcgactgtcttcccagggcggctgcgtatgctgggcgaaaggagtagtcggcggtggcaggcggcaccaaggccccaagccctccttcgtgtcgtacgtacgccctgaggaaattcacacaaacgacccacggaagtaacaggagaacggacagtaactcttcacttgttgccaggtgaccaggctgcttggtgaagccagtaggagtcacccgtatgcggcatccaccgcacccatatcccagagcaccagccaatgcgagcgctacacaatgcggcacgcgcaccggccccgcccgcaacgaccactacccaggcacgaagcgcacacaacggccttgccagacacaaacccacacacaggacaaacaagcaccgacaccgcacacaagaaaacacaacccggctacc

SEQ ID NO: 663323 - DNA, 433 bp, Homo sapiens
  misc_feature (48)..(48): n is a, c, g, or t
  misc_feature (78)..(78): n is a, c, g, or t
  misc_feature (96)..(96): n is a, c, g, or t
  misc_feature (297)..(297): n is a, c, g, or t
  misc_feature (330)..(330): n is a, c, g, or t
  misc_feature (392)..(392): n is a, c, g, or t
agaattcacaagcgcacaggaatttcttgaagatggagaaagtgatgncttttaagatgccctctcttaactctgggngattttaactacaactcntgtctctcggtgatggtattgctttggatttgttgtgaactgttctacagctgtggagcagtatgtccctctgagaagctgagtatctatggtgacttggagtttatgatgacaaaagctaaacagatatccagcttcttctcttgtggttgtagatctaaaactgagatcatgaagaagaggcctctacctacaaaagtnatcttgctcattctgaatttagcattttctttnaaagacaagtgaatagacatctaaaatccactcctcatagagcttttaaatggtttcattgntatagccttaagaaatcactataaaatgcaaataaagttac

SEQ ID NO: 663324 - DNA, 213 bp, Homo sapiens
actgatggaggagctgatgcgatcctcgaatccgaggcggatcaggccggcggccgcaaggatgatggcgtcatattcgccggcgtccagcttggccagacgggtatagaagttgccccgcagaaaacggatctgcaggtcggggcgacgggtcagtaactgagcctgacggcgcaggctggaagtgcccaccacgctgccttcaggcggctc

SEQ ID NO: 663325 - DNA, 107 bp, Homo sapiens
gtgtgtgagcggcatgcaatggcagcaattgcatttttgtcatctctgccttccccggacacctaggctgtgcaaaataaggcttcaatctctgtcaggggagaaga

SEQ ID NO: 663326 - DNA, 306 bp, Homo sapiens
gtgagcccaaccccgttccatgagttgcttaagcagtgcccgaggtctccacacaggccagtcacctgctgtctcactcgagacagaccgcccatgggccatgcactctctcccagcctccattctcacggggtccccagtagtcacctgcctcccgctcatagctcaccaggtctcctcccatggccttccgcaggctgcccggcctccttccccttgcagccatcccaaggctcctgacctacctggcccctgagctctggagcaagccctgacccaataaaggctttgaacccaaaaaaaaaa

SEQ ID NO: 663327 - DNA, 126 bp, Homo sapiens
gatgaggaacgtcactttaagcatatgtggataaatgaccccagtgatacatacacaggcaggtgggaagatgggtgagttacttgggttctcctatctcattctatgctggttcctgcacctcat

SEQ ID NO: 663328 - DNA, 157 bp, Homo sapiens
gagtgatccctgctagctagataatagctggagcatatctatgagccaggaccagaggaatggcaggaatgagaagcagagaggagagcctgcagtcgcagtcgcagccggcagcaatgagtgagaggagcagaaagcgaggcagcaagcgagacag

SEQ ID NO: 663329 - DNA, 779 bp, Homo sapiens
  misc_feature (106)..(106): n is a, c, g, or t
  misc_feature (290)..(290): n is a, c, g, or t
  misc_feature (293)..(293): n is a, c, g, or t
  misc_feature (300)..(300): n is a, c, g, or t
  misc_feature (391)..(391): n is a, c, g, or t
  misc_feature (401)..(401): n is a, c, g, or t
gggaaaaggtggctctggccggggtggctcggtttcctggggctatgtaactgagctcgtctgacttaggggtccttcttcgctgccctcgccgcgtgctagcagngaagtttccgctcgggagagagactgtcctcacgcccgctgcgcctcctcgacgtgcagagcaggcttgctcgccgtgggagcgtcccggccgagaagccctgaggggggatggggaggccattttgtcccgaccgactccccggaaccgggcggagcggcgtgggagaggctgcggagacgcnggntcgccgncctcggaggcactggacgccgccactgtcgggggcttcctcaaagctgttcgtaggtcgcccgcgccgtctcgagcctttttcccacgctntccccggtcnctccggcctgagaacgcccgagtgaggagttggccgtagtgagagggaccgatcccttggggccagccggggagaggagagcccgagccggtcctcccaattggcgaagaaaacgtaacgatctgcttatcaggctagcttcctgatcgggggatccggagtgaaagaaagacctgcggatcctaataacggtacacccgagattgatgcctttaaatactacctttgaattaccaccagtagggaataaacgttcagataagaacagttgaattacaggaaagaaaaacaggtaagatattgggatcaacaggcagacacgataacacaaaaaaaccctataaagggcagggtacaagcaaaatacacccaggtaat

SEQ ID NO: 663330 - DNA, 130 bp, Homo sapiens
cacgaggagcatctgtgagcggctaactccccgggtatcccatgccaactcatcagtggtggtttcatcggtaaaagtcctaatgaagtttctataattgttacctaaggattctgactactacaatatg

SEQ ID NO: 663331 - DNA, 847 bp, Homo sapiens
  misc_feature (106)..(106): n is a, c, g, or t
gggaaaaggtggctctggccggggtggctcggtttcctggggctatgtaactgagctcgtctgacttaggggtccttcttcgctgccctcgccgcgtgctagcagngaagtttccgctcgggagagagactgtcctcacgcccgctgcgcctcctcgacgtgcagatgcatgtgcttgctctgcacctgtgtggatgctgtccctgtgcctgacgaatgcccttgatgtggtgtgtgatgtgtggtgatgtgccagtttattgtcacctagacctgagcatcaccctgtgatagcctgtgtgctgtgatgctgtgcattgtgtgatgatagtgcgttgctggtgatgcccatgctgtgatctgcactgcaccactacagtgaatggtggcacaattgtgaactgccatgcacaagcattgtcatgtgggtgccatatccattcacacatggctttgtatctagtcagtaggtcattgcacacttgctgccctgttcatcaagattgacacatataatatatcaccacaagctggtcgttaataccgccacagtagtccacttacacaggaggccctttggattgaaatcatggccctctggaaggatcgatgtgtaaccgcttattgcgcaccatgctcatctgtttgactggatggtcgggagccccagcagctccgccccttttggcgatgggccacatggctcatgtgtcaggtggcctggcaaggacatgcccccctgaggccactgggtttccatttcaccacaaaggttggagacctcaaacggcagatggaccagattacccgaacctccataggccatttcacatcagaaagaccttgg

SEQ ID NO: 663332 - DNA, 422 bp, Homo sapiens
  misc_feature (1)..(1): n is a, c, g, or t
  misc_feature (81)..(82): n is a, c, g, or t
  misc_feature (86)..(86): n is a, c, g, or t
  misc_feature (93)..(93): n is a, c, g, or t
  misc_feature (99)..(99): n is a, c, g, or t
  misc_feature (131)..(131): n is a, c, g, or t
  misc_feature (157)..(157): n is a, c, g, or t
  misc_feature (172)..(172): n is a, c, g, or t
  misc_feature (174)..(174): n is a, c, g, or t
  misc_feature (181)..(181): n is a, c, g, or t
  misc_feature (208)..(208): n is a, c, g, or t
  misc_feature (213)..(214): n is a, c, g, or t
  misc_feature (252)..(252): n is a, c, g, or t
  misc_feature (275)..(275): n is a, c, g, or t
  misc_feature (286)..(286): n is a, c, g, or t
  misc_feature (296)..(300): n is a, c, g, or t
  misc_feature (305)..(306): n is a, c, g, or t
  misc_feature (308)..(308): n is a, c, g, or t
  misc_feature (311)..(312): n is a, c, g, or t
  misc_feature (314)..(314): n is a, c, g, or t
  misc_feature (319)..(319): n is a, c, g, or t
  misc_feature (322)..(322): n is a, c, g, or t
  misc_feature (324)..(325): n is a, c, g, or t
  misc_feature (327)..(327): n is a, c, g, or t
  misc_feature (330)..(330): n is a, c, g, or t
  misc_feature (338)..(338): n is a, c, g, or t
  misc_feature (350)..(350): n is a, c, g, or t
  misc_feature (352)..(352): n is a, c, g, or t
  misc_feature (361)..(361): n is a, c, g, or t
  misc_feature (379)..(379): n is a, c, g, or t
  misc_feature (383)..(384): n is a, c, g, or t
  misc_feature (388)..(391): n is a, c, g, or t
  misc_feature (393)..(395): n is a, c, g, or t
  misc_feature (397)..(397): n is a, c, g, or t
  misc_feature (399)..(399): n is a, c, g, or t
  misc_feature (402)..(402): n is a, c, g, or t
  misc_feature (404)..(406): n is a, c, g, or t
  misc_feature (409)..(409): n is a, c, g, or t
  misc_feature (412)..(412): n is a, c, g, or t
  misc_feature (415)..(415): n is a, c, g, or t
  misc_feature (418)..(418): n is a, c, g, or t
  misc_feature (420)..(420): n is a, c, g, or t
nactttatcaagccttaggaaaaaaatgaaagaaacacctttccaatgatgcatcaagttaacgtctaagcaaaagatcannaganatcaganattgtngggtacacacgtatcttgtgatgtcttctganaaccaacttattcctctttctctganaagaacttgaccccncnccccggngctgagtgcttggcagccacatttgtnttganntcttgattcctgccctaactacacagggctgggatggncacctgccccaagtttggccagncatttattttnccagtaattnnnnnccgtnncnagnngncacanccncnntnggntgtgaggnttgacatgctananccccaggcnccgccgggtggccctgtncccnncccnnnncnnncngnccncnnncanccnccnccncnac

SEQ ID NO: 663333 - DNA, 701 bp, Homo sapiens
gggtggaggtgatgatggagggggagattggggggtcgtagcggaatcgggggtatgcgggccgaattcataaaaacagggaggttaaaagtagggtctgggtgacaaaattatgtggtgtagagtttcaggggagaggtgcgttcatatgtgttgtgtccctaggaaggatggtgtaggtgggtgaggggtgtttattataactaagtgttgggtgtatctcggctattgaaaaatagggcgaaggggccgtggcggcgtatccgagtgttgaacccgtgagaactagttcgcggactctcccctttcggcagaggcctcgaagggggttctgcggtgggctcctcgtggcataggtggtggagattaaatctcattatttagtgggccaggggtctcagtgagtggccgagggagttaactcagagagggtggtccatggagtgtgggtgactagggggtgggacgcggcttaaaggggagccccacttatatttaagatacagggtgtgcgcaatagtctacccacacggagtggcctaaggggtgacctctcatttattgagaactgcgtgggggggctacacggctcccgcaagtggcgcgcccgactcaaggggcagtaaagttcgggaagttctggatgcgctccacccctggatccagaggtattggaggtaacacggggcgctcaaaaccct

SEQ ID NO: 663334 - DNA, 108 bp, Homo sapiens
tccccaatttttcactccagcattttttttccctcttcccctcaattgctcaagcatttaaggcacgttctttcattcatgcacaactattcatccacattacgcaaa

SEQ ID NO: 663335 - DNA, 169 bp, Homo sapiens
acactgcgaaaacatcattaaagaatagagggcataccctcttttttatttcttaatggcttttggcggcatgccgtattacaactccatagtggcaattcgagataatcaattttggaggttagtttcactatgtgaagaaaaccttttctccattctcgagtttctc

SEQ ID NO: 663336 - DNA, 224 bp, Homo sapiens
gactccgaggttacaggcgttgtcagtgagcccggagttacgccttgccttctcttaggctttgaagcattttgtctgtgctccctgatcttcatgtcaccaccatgaagttcttagcagtcctggtactcctgggagtttccatctttctggtctctgcccagaatccgacaacgtgggtcaccgacgctcgacacttcgtaactccactggtcactagctgt

SEQ ID NO: 663337 - DNA, 116 bp, Homo sapiens
cccggggttttacccccgtcaccccccccccctttttaaaaagggggggggggggggggccccccggttttgggccttagtcccctttcccgcttttttcccccccctttggggga

SEQ ID NO: 663338 - DNA, 139 bp, Homo sapiens
ttatgcgggtgtaccgtggcagtttgctctgctgacctgatggctggtgtgacgggaggatttaacctgtgtgatggattggcctagagacaacctgttgagatagtcttgccccttaaactcgcccgctaaactcgct

SEQ ID NO: 663339 - DNA, 1029 bp, Homo sapiens
gagcgaaattgaggtcccagtgcgggagcctgcagaaatccaggaataggactcagggatctagggctgggatgttggtggttctgagcgcccaggaaataggagttctatgggagagacaggatcatctggttcagctgctcattataattatcctgtgaaagaagatgtacaaatactactgtatcaccgacgtacaaggcttgtccatggacaacttcatgacacatggttcggcaccgacagtctacacgatctaaacgcacatggaccgacatcccatgttcatgaattgggaggcttagctattcataagatagaagtactccccaacatgatgaatttaacatagtccctagcacaagcccagttaccttcaaggcgtaaattgacaggatgaccctaaaaattcctgtggaatggtagaggattcacaatagtccaagaatcttggacacgaagacgcaacttgcaagcctcccatttcctgcatttacacacttactacaaagctaccagtatcaagcacagagtgcaatgggccatacgggattagaccatatacgccggatgaactagaatccaggagtacagaacatcaactcctcaccttatgggctatagattgcaacaaggatgtgcagacaatcctgggggagacaaggactggctacttaagcacagtgttctggggaacaccctgattaccgcaattccaaacgaacgtaagtttacactctcggcatggaggcctggcacagctgcacatttgacttggcacctcgcggaccccagaactggatgggcctattcacacagttcgacgaagcatgtggcggataacctgccgcaaaatatgctccgagcgataaaattgaacatcggtcccagacacgtgtgagaatatcagggctagcggtaatcctagttcaggtcaccaataatgagaggcaaaagacttatataacaaagcggtatagtagccgacagcacatataccgatgggaaagaacaaatgacagatcatgg

SEQ ID NO: 663340 - DNA, 766 bp, Homo sapiens
cgcccgggaatggccatttatattaatacctctccccacacgttttcccattttaaagaggcaattgggccaacgatttttaatgtgttttactcccctatgggcaaccccaagtttacaatattatgcccccgcctcgaaactccggggtttagggtgggaaaccagtttcccaccggaaaggatttgtaagggtttacaaattaataccagaacccttgggaaattggtcccaggtccagagatttcccaggggaacctcgccccgacgcacaataaaaaagccttaggaccattccggcgacgttttttccaaacgcacattccgcgtaggattacatattttgccccccgggagtttcttcgcctatcccccagtgggactcagggggaccccgtcccgaaccgctgtagtgtgtccgatgccataccgtagaaaacctacatgcgtgactccaatcgatagcgtggaacactaggtctgtatttccactcggccgctgggacctcacgcagttggtaatcaaattgcccgggcaccacagacgcatttttgaattattctgggcgtcaaggagagacccctcctttccccccttccccattcagggtacaatgcccaatgtcggccccaagcccactcatggtccatccctcagccccttccccaaacctgcccaagtagactcccggcgccccttccccccactttccggagaacgccttccttccccccagaaaccccctttgttttaaacgggcggtg

SEQ ID NO: 663341 - DNA, 881 bp, Homo sapiens
ggagcagtgtggggcccggtgcgggctctggctgttcccgctggacgaggtgcactgccaagatggaggccaaccgcaacgcctgttacacagagcatcctgggaggcccgtgacgatcttctacaagacccttccacggcgatatgcagtgcggcgtgcacgcgccggtgctccaggcaagatgcttcccatgtggctcggagcacctgccctacccgctgtggtcagccgctgacgggctcagaggcacagccgtgctgcatctgtggaggcctgaacctcacggcgtgacggtcgctcgtcgagaacaatcacagctgttgcttttctgggcacctctgatggccggatcctcgaaggtgtacctcacctccaagatggcacctcctcagaatgtactgactctatccttgtggagataaacaagagagtcaatgcgctgacctggtacttgtcttggagagctgggcagtctgtacgccatgaccaggagaaggtgttccggctgcctgtgcaggagtgcctgagctacccgaactgacccagtgcccgtgatcccaggacccctactgcggcgtggtgcgtcgtcgagggacgatgcaccctggaaggccagagtgtccgcgggcctgatgtaggccatgccactggtctgtggaagccggatagcaaggtccttgcgtgggcgtcagcagcgccagtcacagaagatgatgctggtgggccacgggaggtgccgttgaccgttagacccctcctgtctgacgagggggacgacttgtggtcccttttgggagttcgcggcaacccggcgtttaaggcagcggattgaacccaggagcgatcccgtcaggcagcagacagtgggggcccaagctca

SEQ ID NO: 663342 - DNA, 110 bp, Homo sapiens
aatctgtgacgaagacacccattgtggctgttaactgctgctgcattgtgagctcgtcgcaaattacgaactctgggtagtgtgccgtgtgtcccactggcccgactgca

SEQ ID NO: 663343 - DNA, 1189 bp, Homo sapiens
ttaaatatctaaacaatagtgctttatggataaagggttagttataaagggatacaaaatggcctggtgtaaaataagtgttttcaaaatacatttctatgaggtagaagactatgtcttgagtaaaagaagcagttatctattatcaaaagtatctattcgaattggggtagtaaaaccaagaggggactcaaaagtgtggtagcagtgggtgggctcctctcccctcccgtgaattagcgtggttaccaggaggcaggggtgccgtgaagtatacttttaacctcacattattggggggcattagctcactagcaaacgtgtggttttacttattttcaacgagaattttctccagcaaagaggttatttaagagtggtcaaacctcaaattaaggggacctcgcgaaggggggtgtatacgtcggaaagttcggtgggaaccaccatttctttagtttcacctttcaccacaattgaggccaataacataataggcttgggggggtggtccaccaatttaagccaacgggtgagggggcaaagtttaccagagaaaccccagaatttattttgcggggagcaacacccttcatataacctatatattatttaaacggggcatcattttaatggtgtttttcatagcccgccaaaaaaatgggaaaaaaacccggggtctacatccctcaggatttaacggccttttgctcgcaatttcccctaagaaaaccattgggtgccctttacaccgggtccaacttcgcggggggcgaaaattcccccaacttcacgctgacactgactacaacacggggcacccccggggagggtaccccacggggaacccaagacagacaagggtacctaagggctaaagcgccaagaaacacgccccggggggtccacacgtggcggacggcccaaaactgggtccagattgaaagcgtcccacttgaacaacaccccgggcaattccacaaggatgaacaacaggcgctaaaacggacagcgctcccaaaacgaggggaggtcgtccccaaaaaaacccagggcgttgtaccacagagaccggactaagaaccgccaggagggacaaccacgggacacaacgcgcgttagcacaacgacaaagaggcgcccccccctccccctcccttctcacctctctccacctctcacaggggga

SEQ ID NO: 663344 - DNA, 1020 bp, Homo sapiens
  misc_feature (296)..(296): n is a, c, g, or t
tggaaacggattcttgctttgtgcgcccaggctgaagtgcaggggtataatctcagctcagctgaaaccttctgccccccgggttcaaaaaattctcctgctatcagcctctcccaagttagcgtggaatttacaagcgttggtgccaccagtgcccagcataatttccgtgataatttaagataaaagacaaggttttcaccgtgtgttgtggccaggctgttggtctcttcaatactctcctgtggccttcaagtgtgactccaccgtgcctttggccctcccaaagtgtgccntccgaattacggggtgttgacgccacaccggggcccaagcccctctccctgttgtgtgtttcacaccaactgggaagttagatttatacactagaagtgttagttaccctttttttactctttaactttcataaacacagttacacggcttcactaataaagtaacagactcgtggatatcgtgctccataagagagggaacaataaaattccacttattataatccagtgtctctttaaagttacacttgggggtttacaaaaccacttttattcaagccaccccgagattttaatcttacagcggtgggaccccgtggagagccccctgtggcgtggggaacagtgggccctccaaaaagagagccaagcttgcagaggccagttgtttacgtggggctatagccaacacaggatggccaaccaaaggggcacgttgggtatttccccggggaaacacagcggtgggattacgagaaggtatttctctttggaccaaaatggagaggtactcctattatcccccttttattaaaaacccccctgggtggccacaacgtgaccatacggggattatcgcaaggtggcaataagaacgtgcccatgttgcggatacaggtgccacttcaaacgtccctaaagtctatggcattcgcaaaaaaaaattttctgaaatataggctgggaaaactttttacacgggcatttttcagaaacgctttgt

SEQ ID NO: 663345 - DNA, 435 bp, Homo sapiens
cgcacctgtagtaccagctactcagaaggctgaggtgggaggatcgcttgagcctgcgaggtcggggctgcagtgagccgtgatcaaaccactgcactctagcctgggcaacagagtgagacctcatctcaaaaaaaaaaaaaaaaaaaaaaaaaaaaaaaagaaagaaaaaaaagaaaagaacaacaaaaaaagacaaatctaaactctttagcctgatgctcaagggcagagattctagagcctggggtcttgtggtggccccctagaccggtccctgtggagggaggaaagagcccaccaagcagtgttttgtaaaagccccagtgacacacagtgagggtgacaacctttcccccaggcctgcactgtccacgccagtagctcccaagttcgagaccagcttgggcaacatggcgagaccccgtctctact

SEQ ID NO: 663346 - DNA, 469 bp, Homo sapiens
  misc_feature (96)..(96): n is a, c, g, or t
  misc_feature (101)..(101): n is a, c, g, or t
  misc_feature (201)..(201): n is a, c, g, or t
  misc_feature (299)..(299): n is a, c, g, or t
  misc_feature (372)..(372): n is a, c, g, or t
tgaaatacttgtaatttcttagatctattatgctttttcttgattctctgaatgtatagtagtgcttctttagctaagaatatagttccccatcancaagntttgttttgcccaacagaccctttttcctttaggatgagattcagtggataattacattataattatgaccttctgggaagctgcttctcttatttgggnttgtgtgttgtgtgtttcctttccacactccttcagcagcctttgcctcccacttttatagaatttaccatatgggattttaactgtttgtcttccantagacaataagctccttgaagactgaatttccaggaacttttgttggatttgcatgtttgtgaagtgaattantgaaggctgcccagtttcatctgatcctagtcaaaacctaaatcccttatttctacgctaccttttgccaggtaaaaataaaacatgtaaaccatca

SEQ ID NO: 663347 - DNA, 146 bp, Homo sapiens
gaacaaaagcgggaattgggcccgccctcaaaggccaggccctaagggccgagaccacccaggagcccccttggggggggaggctgccggcaggggctgcgtcgggcgggcagacgggcccagaagcgggggaaggggcccggaaa

SEQ ID NO: 663348 - DNA, 152 bp, Homo sapiens
agcggctcaagagactggagcctggacggggacggacctcaaggcctcgatccagagacccccttcgagcagatgcatgggagaccctgcgctgctcaccacccccaacagtggcttgacacgaccatcacgaacaactagaacctgtacag

SEQ ID NO: 663349 - DNA, 405 bp, Homo sapiens
gtgaatgctgcaagtcgaatctagagtatcccacagtgactgtatcaagtggctatcttcacaagtgcttatcataccacattcacttctgaaacacccttgtttgcgatcgctaacctcactgggactagagcaaccgcagtctattcagagaatggaggctcttcatttctttaattcctttactccaaactcagccctccagtttcttcagaatgttacaccctgttaatcgtcactgtttccaataaggaacaaaattagtcagtttttggcagcaccttcatctttctagacctcctcctattctgtccttgtggacttatgtttaacatagaatatgaatgcgttcataacaaaaccattttctgcatttaaccagtcctggctctctctctgctgcct

SEQ ID NO: 663350 - DNA, 400 bp, Homo sapiens
gcaacaaagagtttaatggacacaaggccagccatgctgtatgggagacagagttattacccaaatcaattccccgaaaattcaaagtccagggagcctgcttctgactggggcctcaggacttgtggggtggagggagagcaggtccaggtggagccatcagtcgtcagaaatgcaaaaacctgaaaagacatctcaaccaccaatcttaggctctacaatagtgatgttatttgcaggagcagctggggagttgcaaatcttgtgatctctggaataatggctggtaatcttttatgtctacaccttagcagaattcaggctcctcacatcctcctaacctggtggcctttcattagcttcgcaaaggtgatttagtttgggggaagactgttatcat

SEQ ID NO: 663351 - DNA, 212 bp, Homo sapiens
agtcgagctgttaccagatatcagagacccagagacagaggtagacagatacccagagacagagggagacagagacccagagtagagagagatggagacccttagacagagggtagagaaagacccagagagagagggggacagagacccatagagagagggggacagagacccagagagagagggggacagagacccagagagagaggggg

SEQ ID NO: 663352 - DNA, 208 bp, Homo sapiens
gccacgtttcgcatggaccttacgatgtgatgaatggttttggcatgagtgtcttaaggattgctttcagattcgggttacagggcaaccagcgctgagcttcctattgcagagacaaagtaggatctagaactttcttgctaacaggttccagctaaaacaccaagttagattcttaaatgatgttcttttctatcattatttagat

SEQ ID NO: 663353 - DNA, 461 bp, Homo sapiens
  misc_feature (65)..(65): n is a, c, g, or t
  misc_feature (160)..(160): n is a, c, g, or t
aagatcactatagggaatgggcctagtcgcatgctccggcgcatggcggcgcgggaatcgattgncagttgaaacggttcccgatgttctctgcccagaagggcaggcccaggacaaacaccagatcggaagccgccaagttagccaggtagatttccgntatggttaagcgctgctgcctctgtcgttgctgccaccaccactgtcgccaaggcaaaaggaagaaggacaagactaaaaggttccccaagaggccaaagaagcagatagtgatgacgaaccctggcagcacccgatacagcaggtcccagtcttctagggcactctcgcaggaggtaatgttggcaggggcctgcaggcttcggttagagggctggagctccaacaagacctcggacgccatccacagtgacccggatagaaaagcaaagagctcacagcttcaaatcactagtgaattc

SEQ ID NO: 663354 - DNA, 145 bp, Homo sapiens
tctgtaatgctgattgtgtatggcattgatgagatgatgagacgcctcctcctcactctggactccagacgaggaaggtgatcccagtgacagcggggggcactgtgctggcagcagcgctgtgacgtgtcgcctatggcaaatc

SEQ ID NO: 663355 - DNA, 802 bp, Homo sapiens
ctacgcctgccgggccgggcgtggggcctgtgggaggttgcgcggccgggcccagctgcggggcggaggcggaggcggagtgagaggcctgcggcggcagggagcggcgtggactgggagcgggcgcctgtgagcctgaccctgagcctgagcctgatgcctgatgcctgatgcctggagctggtgctgtgcgaatgtgcctggcgctgtgctgatgcagcaaccattgttcggttgttctgggagagcttgttctgggggcttggcaggggttgtattgtgcctggcataggggctgtgccccttgaccccgccatggtgaggtgccattccattctggtcttgcgggacaccgtgaaggaggattgtttagacgcaagaaaccaggagtttccttgtgagaagaaaattcgagtcaggagtcttgacgtgcctgccaagaagtcacggctaccaaaaaacagagcgcgtcgggcccttccaggcactgaagcgttaaggaagaggtttgacgaatgcagcttggcggcatattcgagcgggcacttttatcaagccactcgagttttcccagcggggaggccccttggagatttgccaatcaccaacaccgagggtgctcaaggaacttgggcctattcccggccaagggccattaagggcggccccttaccaacttttgaccttcgataggttgatgagttatgcgggactttcttgaccagcagaacttgcggggggattcacagcattcgaacctttgttttgggaagatttgcgggttgctctgggatttgagatt

SEQ ID NO: 663356 - DNA, 129 bp, Homo sapiens
ataggttgcagcgagtcgatactgggccactgcattccagcctggatgagagagcaagactctgtctcacaaaaaaaaaagaaccaaatgagagagattcggaggctgagaagtcccaagttatatgtt

SEQ ID NO: 663357 - DNA, 259 bp, Homo sapiens
ctggttttgtttttgactttgctcaagggctgaaccctaatggtagtaccttccttttcttcctgtggctggtgccttctgatggggctggaatcactgaggtggatggttctaccctttctgccttctgtttgggacccagctggtgttctttggtttgctttcttcaggctctagggctgtgctatccaatacagtaaccacatgcggctgtttaaagttaagccatttaaaatcacataagattaaaaattccttc

SEQ ID NO: 663358 - DNA, 416 bp, Homo sapiens
  misc_feature (9)..(9): n is a, c, g, or t
tcctaaganaggttttttttcacttaggcatgcctaaacggctggatcactttgtggcgaggtcataaggaaccgccctgtcaatgtgggaggcccgcgggtttgctcctacagcaaatgatccacccgtgctggtgcttacgtgaccgctgatccagtctgtgctgtggctgaagcacatgaagtacccgctcttggttcgcactggccgtgggaatactatagctggatcccggaatgcactcttgaacgcgggtctaggggcacatagcgatatgatttcagattgccggataaggatatggaagatgcatatacatgctgacgccacaataagaaagtctactggagatagaagacaagcctctgggagctggaacatcacagggccttgtagacagggtgtgggctgcccg

SEQ ID NO: 663359 - DNA, 105 bp, Homo sapiens
gggaggaagattactccccaggttcctaggcattgcaggacttgggcacatctagctggtgggtggcccagagcctctgctgtaaggggcagcaggaggagtgga

SEQ ID NO: 663360 - DNA, 425 bp, Homo sapiens
  misc_feature (1)..(1): n is a, c, g, or t
nacgtctagaggatccctactggcattgttactgatgaaagcaaaattgcagtatgtgtatgatctcactgttatcaaaaagcatttatgcatgcttttatatatacatacacacttgcacacatgtaggcacatacaaacacatacatacatgtttctacatctatacagaaaatgttctggtaggaaaaataccaatctgtaagtctgtggggtaagaacagtaccatgtatggggaatgggactaaagagacagtagggagactttcacttttcaacttatacatgttgtacaataagcatattacatttgaaattttaaaaagagagaagaaaaagcatcatctggaatgtagacttctcaaaagactagtaaccagagttaggttttacagaaaggatggacttttttctaaaactctga

SEQ ID NO: 663361 - DNA, 818 bp, Homo sapiens
gggagcttgttactggttacttggcctcatgggggtccgagctctcggtgtcgagaacaagcggtgagatcggctgcgtatgccaggctcgaccaacacctactgtctggtagcgatcggaggctcaggagaacttctacagtgtgttcgaggggcgagctctccgataccatccccgatgagtgcacgcagtcgtatcgccggatgccgcatcatcgggcgcatgtgtgtggggaacaggcacggtctcctggtacccaagcaagtaccacgcgacacaggagtctgcaacagcattcgacaactagcgcgtcgcgcagagcagcagtgtcatgattagagcgggtggaaggagcggctctcatgccttgggcaaagtgtcaccaggctgcagtgactactgtggcctctggtccacccagacgtgtggacaggggagaccagaaggaacattcgtggcagagtgtgctcaagggtggaacgtgctgtcagtacgagacagctgcgccggaaccaggtggctaggtagggaacgcgtgaactgatgtcttcacgtcgaaatcagggacgggctggaagcagtcccgaagacgttccaagttgagaagatgcaggaatgaggctgtcctcatcgttgcttgaagtcgccaccgtggtggccggggactagtgaaccgaaggtagagaggtgattgatgatgaggatggttgggtcgacatgaggtggctgtgacggttgcgtagtggccatggacagaaagggaggagagaagactgtgaggatggttggagaaggtgtctgtcaaagctgaagtgaa

SEQ ID NO: 663362 - DNA, 232 bp, Homo sapiens
ccctatctcaaataaataaataaataaataaataaataaataaataaataaataaatttggcctatgaatggctctcatgcttgttaaaaaaaatagattcctgtgcctgtaatcccagcacttcgggaggctgaggtaagagaatcgcttgaacccaggaggcagaggttgcagtgagctgagattgcaccactgcagtccagcctgagcaacagagcgagagtcagtctc

SEQ ID NO: 663363 - DNA, 916 bp, Homo sapiens
gcgggcttaagggagcctggctagtgcctggcagcctggatggtccctgcagctcgtgggcctggccatgcttcgctggtcctgtggcgccagctttggctctttttcctgctgctgctcccgtggcgcgcctgagcccctgctgtgctgcctccatggcctgtgggatgtggaacctgacgatgcctgtggctcgtgcctggtgcctggcctggtgcttccatgctgccttgcagcgacgcagctcagtggctgtgcggtgtgccctctccaagcggtacttggacgctcttcagcttgccagtgtgtggccctgacgactgtgacgatggacgagtgatggcagccactgtgtggcccctgggctggcgccttcctctgtttgggccaagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaaccagtgaggggctacttagagacgccccagccagaaaacggccttgctctgtcgttccacggctggtctggcacaggcaagaacttcgtggcacggatgctggtggcagaacctagtatcggggacgggctgatgaagtgaactgttgtccggcgatgtcccaacgccacgcgtcccacttctccttcaacacaagaccatgtggaacctgtaccaccgggacgcagcctgtacttcatgccataatcccggtacaaacgcatcacgcctcttgccatcacgcaccctgctccctcttcgactgaaccgctagacgctgcaaaccaggtatgcatggaaggcctcgcggcacccacttaaaaacgcccgc

SEQ ID NO: 663364 - DNA, 936 bp, Homo sapiens
  misc_feature (283)..(283): n is a, c, g, or t
  misc_feature (666)..(666): n is a, c, g, or t
  misc_feature (674)..(674): n is a, c, g, or t
  misc_feature (677)..(677): n is a, c, g, or t
  misc_feature (679)..(679): n is a, c, g, or t
  misc_feature (682)..(683): n is a, c, g, or t
  misc_feature (686)..(686): n is a, c, g, or t
  misc_feature (692)..(692): n is a, c, g, or t
ggtacatgtaaatgtttgttacatgagttgtgaagaattctgaggccatgcctgagatcagtgattcagaagtcctgtcactgaatagtaattgttgcaggggtgacatatgttccacatatttaccttctgtaagtgaagcagagtgaagaaccagaccaatgtagattttctagcacttatttttgggcaagttattttgttctctgggcctctcaatgtccttatctggaaaataggaggtcacattcttgctaggattaaatacattaatgcatgcaangtatttcctgattgccttgcagatagataataggtgcccagtaaatgttagttctgtcccttttttttgtatgggagaggagggacgaggagggagtgggctgttcttaaataggaatatttttaaaacgtattatgaacttatcacagccccatgtttcacttttcagggccaatgtaggaggcagtaaagaaagaaaaataaatgagacatctcttgtcaagttataactggttttatgtataaataatttagaaacacattacctataatacaaaacaattaaaaaatataccactctatttggctgtatttactacttttctgaaactgcttactcggaggttcggttcaccttacctccttatttttactcccttctntttgaccntcngntannatnaaccancaactttggtgaaatcctttctttccttggcttcagtgaaaacatcactttctaaacaatgaatttcgttttctactggacaggggccctttttatagaggcaataaacttgtatgtttaactttgatgattgattattgattcagttggtaatacaaattaaagtttggcttaaaaccagtgaaatatttctgggaagtaattgaatgatgactgtacacacacaaggaagtccggtaccggt

SEQ ID NO: 663365 - DNA, 654 bp, Homo sapiens
gcgggcttaagggagcctggctagtgcctggcagcctggatggtccctgcagctcgtgggcctggccatgcttcgctggtcctgtggcgccagctttggctctttttcctgctgctgctcccgtggcgcgcctgagcccctgctgtgctgcctccatggcctgtgggatgtggaacctgacgatgcctgtggctcgtgcctggtgcctggcctggtgcttccatgctgccttgcagcgacgcagctcagtggctgtgcggtgtgccctctccaagcggtacttggacgctcttcagcttgccagtgtgtggccctgacgactgtgacgatggacgagtgatggcagccactgtgtggcccctgggctggcgccttcctctgtttgggccaagcggtacctggacctcctgaccacgtggtactgcagcttcaaagactgctgccctagaggggattgcagaatctccaacaactttacaggcaaggacttcgttggcacggattccttggttggagaccctgtatcgggccggccttaatgagtaccttgtgctaagagagtgtccattcgccacgttccacttttcctcaccccaatatatgtggaccctgtacacgggcgcagctgatgagccagatccgggagacgcagca

SEQ ID NO: 663366 - DNA, 765 bp, Homo sapiens
  misc_feature (295)..(295): n is a, c, g, or t
tttaaatcggcacgaggaaatgactcagggccactccggccgactggtacaacgagcggatgagctgctcctggatatcccctgaggggaaggtcacgccttgctccttgaagccatctgtattggtgccggcgttcaggatggtggcgtacacccgccgggccagggacttcttggtcagcaggacggccaccacaccctccgagcggcagtacccattccccgctgtgtcgaaggccttgcaggtgccctcggggctgagcatccccagcctcaagaactgcacggaggtgtngggcttcagcaggacgttgatgccccccacgatggcggcagggcactgcccgctgtggatggcctggtaggcgttctgcagggccatcaggctggaggagcaggctgtgtccagtgcgatgctgggccctctgaagtcgaagaagaaggagagccggttggccatcatcgctcgctggcagcccaccatgctgtagcccacgagtgtctcggggtctcggctcagggcctccgaggtctcagagccgctcacgcccacccagacgccagtgtgtgttcctcggagtgaatctgggttgatgcctccgtccacgatggcttcataggtgacttccagcagcagccgcagctgagggtcatcgtgtgttgctgcttggggtgactccgaagaagaggctcaacctaaaggtcctaagttcggaccgcggcagcgctaaaccgctccggaggttctcggcctttcccggttgt

SEQ ID NO: 663367 - DNA, 307 bp, Homo sapiens
gcagaggccgggctgagacgtggccaggggaacacggctggctgtccaggccgtcggggcggcagtagggtccctagcacgtccttgccttcttgggagctccaagcggcgggagaggcaggcgtcagtggctgcgcctccatgcctgcgcgcggggcgggacgctgatggagcgcgccatcagcccggggctgctggtacgggcgctgctgctgctgctgctgctggggctcgcggcaaggacggtggccgcggggcgcgcccgtggcctcccagcgccgacgaaggaggcggcgttcggcctcgg

SEQ ID NO: 663368 - DNA, 298 bp, Homo sapiens
tcccttgtaggaatgacaagatcttggctgtaaagttagccaacatccgagttgtgtctgaggacttgctccaggacgtctccgcctccatcaagagccttcaggagatgccttagcagaaaacttagccatttgggggcagattccaacgcagagcctcggaggttgtggccccaagagggaagtcaggggctgcgctctccaaaaaaagcaaggggtcttgacacgctgtgggcatgcactaatgagaagggagaatgcgtttatctcttaaaggcggagcagcaggaggagtacg

SEQ ID NO: 663369 - DNA, 283 bp, Homo sapiens
ggtcgcgtatcttcaccgatggaaatctcatccttcggctgggggcagtggagtcacctgaggtcgggagttcgagaccagcctgaccaacatggtgaaacgctgtctctacttacaatgtagaattagctgagggtggtggcacttgcccgtaatcccagctacttgggaggctgaggcaggagaatggctggaacccaggagtaggaggttgctgtgagccgagatcgtgcccttgcactccagcctgggcaacaagagtgaaactccatctcaaaaaaaa

SEQ ID NO: 663370 - DNA, 821 bp, Homo sapiens
  misc_feature (280)..(281): n is a, c, g, or t
  misc_feature (293)..(293): n is a, c, g, or t
  misc_feature (296)..(296): n is a, c, g, or t
  misc_feature (299)..(299): n is a, c, g, or t
  misc_feature (303)..(304): n is a, c, g, or t
  misc_feature (313)..(313): n is a, c, g, or t
  misc_feature (322)..(322): n is a, c, g, or t
  misc_feature (336)..(336): n is a, c, g, or t
  misc_feature (345)..(346): n is a, c, g, or t
  misc_feature (352)..(352): n is a, c, g, or t
  misc_feature (397)..(397): n is a, c, g, or t
caaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattannaaaacccattgntgntgngttnntcttgtatnccaataatnaagccactactgtnggcactgtnnggtttnctattttaacactgaaggagtgaaagtatttcctatatttatgantttactactaaaatcttggcaaaaaacaaaaaaaattggctctaccgttgttttgggctgaaacctgcttaacctcaagggtgtttcatacttcccccccgaaaaattcccctgtgaaagttgggacaccaactggtattacccttaggttggcttaaggggattccactattatataaagtcaattaaaaattgacgtagtggtatatattgcaacatggtgtacagaggggaaataagtgaatacgtattaaaggaaccattcctcgtcattccttaacctttaatccccgtatataccatagtctactttgtcaaatttccagacgttcacggcctttggaatccataattcaaaatgtgcaccatgatggttacggggaaaatcgatatctaataacggtttaaataatccccgggaaaa

SEQ ID NO: 663371 - DNA, 604 bp, Homo sapiens
  misc_feature (42)..(42): n is a, c, g, or t
  misc_feature (48)..(48): n is a, c, g, or t
  misc_feature (60)..(60): n is a, c, g, or t
  misc_feature (123)..(123): n is a, c, g, or t
  misc_feature (126)..(126): n is a, c, g, or t
  misc_feature (130)..(133): n is a, c, g, or t
  misc_feature (135)..(135): n is a, c, g, or t
  misc_feature (138)..(138): n is a, c, g, or t
  misc_feature (144)..(144): n is a, c, g, or t
  misc_feature (546)..(546): n is a, c, g, or t
  misc_feature (553)..(553): n is a, c, g, or t
  misc_feature (563)..(563): n is a, c, g, or t
tctagagcccatgtttgatcggtacatgtgttaccgatacgngttacnatacgtgttacngatacgtgttaccgatacgtgttaccgatacgtgttaccgatacgtgttaccgatacgtgttnccnatgnnnnancgnacgtgntaccgatacgtgttaccgatacgtgttaccgatacgtgttaccgatacgtgttaccgatcatggcatacacgtgttaccgatcatggcatacacgtgttaccgatcatggcatacacgtgttaccgatcatggcatacacgtgttaccgatcatggcatacacgtgttaccgatcatggcatacacgtgttaccgatcatggcatacacgtgttaccgatcatggcatacacgtgttaccgatcatgtcatacacgtgataccgagcatggcatacacgtgttaccgatcatggcatacacgtgttaccgatcatgtcatacacgtgttaccgatcatggcatacacgtgttaccgatcatggcatacacgtgttaccgatcatgacatacacgtgttaccnatcatgncatacacgtnttaccgatcatggcatacacgtgttaccgatcatggcatac

SEQ ID NO: 663372 - DNA, 144 bp, Homo sapiens
cagcagcatccccatccaggcgcacagcatgtgggagggcaggggtgggtttggtcttgttccaacactggtccattttcatttttcacgtatgttcagcatcatggaggcagtcagtgtgcattagcaggtggcagtcagcat

SEQ ID NO: 663373 - DNA, 143 bp, Homo sapiens
aacccaatccaattatcccttttattttaaaatgtgcaataaattacttttgactatagtcaccctgttgtgctatcaaatactagatcttatttattctatctaactatatgtttatgctcattaaatatattcttctctca

SEQ ID NO: 663374 - DNA, 560 bp, Homo sapiens
  misc_feature (29)..(30): n is a, c, g, or t
  misc_feature (34)..(35): n is a, c, g, or t
  misc_feature (37)..(37): n is a, c, g, or t
  misc_feature (39)..(39): n is a, c, g, or t
  misc_feature (41)..(41): n is a, c, g, or t
  misc_feature (45)..(45): n is a, c, g, or t
  misc_feature (53)..(55): n is a, c, g, or t
  misc_feature (68)..(68): n is a, c, g, or t
  misc_feature (101)..(101): n is a, c, g, or t
  misc_feature (502)..(502): n is a, c, g, or t
  misc_feature (509)..(509): n is a, c, g, or t
  misc_feature (519)..(519): n is a, c, g, or t
ttcgagctcggtccatgcatgaccggaanncgtnngntntntctnttttatannnaggaaatttgtancactttttttagtattccacatgtaagtgatancatatgatattcgtctttctctggctgacttaatttatgattatctctaggtccatccatgttgctgcacgtgttaccgatcatggcatacacgtgttaccgatcatggcatacacgtgttaccgatcatggcatacacgtgttaccgatcatggcatacacgtgttaccgatcatggcatacacgtgttaccgatcatggcatacacgtgttaccgatcatggcatacacgtgttaccgatcatgtcatacacgtgataccgagcatggcatacacgtgttaccgatcatggcatacacgtgttaccgatcatgtcatacacgtgttaccgatcatggcatacacgtgttaccgatcatggcatacacgtgttaccgatcatgacatacacgtgttaccnatcatgncatacacgtnttaccgatcatggcatacacgtgttaccgatcatggcatac

SEQ ID NO: 663375 - DNA, 444 bp, Homo sapiens
  misc_feature (386)..(386): n is a, c, g, or t
  misc_feature (393)..(393): n is a, c, g, or t
  misc_feature (403)..(403): n is a, c, g, or t
atcaacgcctttatgctcacacgctttctacaactgtgcatacaataaagtgcacgtgttaccgatcatggcatacacgtgttaccgatcatggcatacacgtgttaccgatcatggcatacacgtgttaccgatcatggcatacacgtgttaccgatcatggcatacacgtgttaccgatcatggcatacacgtgttaccgatcatggcatacacgtgttaccgatcatgtcatacacgtgataccgagcatggcatacacgtgttaccgatcatggcatacacgtgttaccgatcatgtcatacacgtgttaccgatcatggcatacacgtgttaccgatcatggcatacacgtgttaccgatcatgacatacacgtgttaccnatcatgncatacacgtnttaccgatcatggcatacacgtgttaccgatcatggcatac

SEQ ID NO: 663376 - DNA, 758 bp, Homo sapiens
  misc_feature (378)..(378): n is a, c, g, or t
tagaacgatcccatctaatagtctcgattatagaacgtgaccttccgtgagacaatgacagataaccctagcctatccggataagatgtaggcctgtctccagggcagggaagctgggagggtcagggcaaagaaaggattagacgcagaggatatatggatagcctccttactaagaatccagaagtttctcattcccgcatgtatggagactgagcttatgaatatgagagcgtcttcgataaaaactgggatgcactcgaggacagaacatagtgactgggatgtatgcaggctagacttatgattctggactgattaggtcgttataatagctgtttgagtggcacaacagttgtacaatgtgaaagttacaanctcgtatgtttatctcatgatgtgccgctggactgaactttgggttcatttaggggtcaaagccagttgttcatgttaaaacttgaattcattctgatgcttggcccccatacccccaaccttgtccagtggagcccaacttgctaaaggtcaatatatcatcctttggcatcccaactaacaataaagagtaggctataagggaagatgtcaatattttgtggtaagaaaagctacagtcattttttctttgcactttggatgctgaaatttttcccatggaacatagccacatctagatagatgtgagcttctctttcttctgttaaaattattcttaatgtctgtaaaaacgattttcttctgtagaatgtgtgact

SEQ ID NO: 663377 - DNA, 175 bp, Homo sapiens
cagaggcctgacttttaagagagcgacttagtcatccccaagaaccgcaggtgcaaaggggagcttaagatgaaacacatgctggcatgacattcctattgccttgataagggacaccacgcagagatgaactgggactaaagcagagagaggagaccgacgagtgtcagacgca

SEQ ID NO: 663378 - DNA, 1634 bp, Homo sapiens
gcggaaacctgtggaccccgcctcgctctgggagtactaggtgccggccctgtccttcccctgacccatgacccacatggctggctccatgccaaaaccatccctgcatcaaccccttactcctgcacaggatgaggctccacgggcgtggatggcaagccaccccttgaactttcaaacatgtgaacaccccagacgaaaacaggttgcacccacaacacgtagatcagaacccataaatggagcatcacccaaacatcatcacacgcatcacgaacacggagattcccataacatcacaccatcaggagatcaagaaaggcatagcgggacatggggaccattggcgacgacggaattatacaaagactgcccaccatgaccccatctctgatacatgacacacaggcaggaccgagaatcatggcaaaccatcgatatatcattccttgaaccatacaagacacgggaatcactggacgaaccgtataatatatacatccttgcgacaaggccgggccttaacagggagacagccgaagagagaggacatgggagaaggcccacatgccgaacagactgccgacccaggtcacaccagcaaaacatacatctcaaggaccccacatcaaccaagacacaaaacagatacgatcacccaagcgacacccgaccaagagcaacgcacaccatgagcgcaaccaaaatagctaacacccaaacgaacacaagccacgcacgagggcgccacccctacacacaccatgaaaaagtgacaacaactggaacaacccccagaacaacacacccaccccaggacatagagcaccacaaggcggcacgcccacaggacccaggagcctggagagaaccaacggcacacagacaacccaccacggaaagccgacgaaccccacccaccggcaaacagccaaacaacacaaggaccaaaacacccagaaccaccccaccccacgacccaacggaaacaacacaacacaagacccaaaacacacgacgcaaaacaaaaacagcaaataaaacacccgacccagacgcgacgacggaacaaagaccaagcacaagaacaaccagacaaaacaaagaacacgcaacacaggccaaacaagaaaacaaaccagcaaagaaactcagaccgaaccaaacgacaacaacgccagacaaacaagaacaaaaagaaccaaacaaacaacaacaacaaccaaacaccatcgagaacagaacgagcaagaagcaagaaccaaaggaacacgaaacagaaaaaaaaacaaacaaagcagcagaacaaaaaccgaaaagacagcagaagaccaaagaaccacgaagaaagacgaaacaacgcaagaacaacaacacgacagacagcctcagcaaaccaacccaacagcggaaagcaagaaaaccgaaaaagacacacaacgacaacgccaacaccacacgagagcagagcacacaaacaaagatacagaaacaaacaaacaaaaaaaaaaaagaagccagaaacaacacacaacaagaccaaaaacaaaaggaacgaacacgccggaacacaaacgagaaatacgacaaaagcaacaaaaaaagacgacagagagaacgaaagctcaccaaag

SEQ ID NO: 663379 - DNA, 797 bp, Homo sapiens
catgcctgtaatcccagcacttgggaggccaaggcaggtggatcacctgaggtcaggagttcaagaccagcctgggcaacatggtgaaaccttgtctactaaaaatacaaaaaagtagccgggtgtgatgacgcacccagctactcgggaggctgaggcaggagaatcacttgaacccaggaggtggaggtcgcaatgagtcaagatcgcaccactgcactccagcctgggtgacagagggagactccatctcaaaaaaaaaaaaaggaaatatggtctatctggtctttaagccatttcataattttaaagatatgatattatcaccaggaaatataaaaccaagcaggcagctaaaaactggcgacgttgggtaacaacctggtattgagtggactagaaactacgcagaagaataattttcttattggaattttagagcaacaaaatttgggacccgggggaaaaccatacctttaacaaaatatggggatcacctggggctttggggggtccacacctgtcatcccagctccttgggggaaaccccttaggggcgtgtggattccaacctggaggctcagggaggttcaaggacccacgctgggcaacttggttggaggaaccctgtcttccacgaagaaaaggaacagaagagaacacacgtggggcgcgcgcccgcgaccagaagaagatttaaacactctgtggggcgcggggcgccaatgtaaacagggcacatgggcccagggaaccggggcgagagcggggggttccccaaaaaagccgggcgcacg

SEQ ID NO: 663380 - DNA, 1023 bp, Homo sapiens
  misc_feature (585)..(585): n is a, c, g, or t
  misc_feature (638)..(638): n is a, c, g, or t
aagcagtggtatcaacgcagagtcgccattacggccggggacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagccctccggcgtgtcaggcatactctgagtacgatcaatttgtcgatgcagcgctatgcgggtcggaatctcactgagccacccatcattgtgaaataattacctcagttgtacaggactnggtgatcaggatccaggcactcacttgtattctactgtcaataaacgtttatnaaacttgatcctgctacgtgaaaacaaaaacatgaactccgattgacgtctctgctgctcgtacgctgagggcatggttcagagctttccatgcttttgacaaggatggagatgggatcatccaggcgcaaccgttctgggagtggatggggggtcacatgtagtgctgaaacaggtgggtcatgcagagccatgaggatcctcagattacagtgagccgcgattccaagcattaccgtcaggaccggggttgccctaggcacccgcctcggggggggcgcgaacaccccacaattgggggggaacaacctgtagagggacacaccgcgaatgggattcattacacgcacagtcgggaggaacagaccgagagtgttggcacaaa

SEQ ID NO: 663381 - DNA, 359 bp, Homo sapiens
cacgagggtgctaccagagacacctgctgtatcttagatgagagagacggtagttattgtgcaactacctgtggcattgcagatatcctgtgtacttatcaaaccaaagtggacaaggatctacaggctttggaagacatattacattaaggtgaaaacacaacattagaagtcaaacaggtgataaaagcaattcaacttacttataatcctgatgaatcatctaaacccaatatgatagacgctgttactttgaagtgcacgtgtgtagaagaaattatgaaatatgaagcattgattttaacacatgactcaagtgttcgatatttgcaggaaatatataattctaatcgccttgt

SEQ ID NO: 663382 - DNA, 632 bp, Homo sapiens
  misc_feature (509)..(509): n is a, c, g, or t
aagcagtggtatcaacgcagagtcgccattacggccggggacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagccctccggcgtgtcaggcatactctgagtagataatttgtcatncagcgcatgcaaatcatattttactttggcccccattattgtgtaataattacctaagttgaactggactaggtgatctgcttccatgaattcacttctatcctagccgtcaatagattttaa

SEQ ID NO: 663383 - DNA, 430 bp, Homo sapiens
catcatggggttctggagtatcggactggtttatgacctggcccgtagtcctcacagcttagacctgtccagtcccaacatggccaactacagctcatgctcgctctgatagcctttgcgaaatactttcccggcattgtgaaccagcccacgtagcctttttggtcagctcagagtgcttctagccatgtaacaatgtctgagcaggatgcccaaggagcctctcaagattccagtagcaaccagcaggacccaggctagcctggggatgcagaagtgccggacgaggatctatgtatttccactccatgaccgaggttgccgatggggatttcattgattgggaggctgaaaccgactccgtggtgattgctgggccccctgaggtgctccgttcacctgagatgcacgttgagaatgtgctggagga

SEQ ID NO: 663384 - DNA, 445 bp, Homo sapiens
accccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccgggggcttctggccacctgggcctgcccgggtaagtcctttcaggtggtggcccatacagagacccagtgtttcccatttagcgtccccctgatgctggccaactggaggactgcagggggctccaggtcactctctccttttatctcccctcagttcctgtggtgtccttcaagtttggttttgggtctgtactcctccacctcctgctattctactgttttgtctccta

SEQ ID NO: 663385 - DNA, 100 bp, Homo sapiens
aaaaagggatattttggttttgttaaaacccctgttgacttttttaccctgaacattttttttaacttgatttaataaaaatgtttattttgaaaaaaaa

SEQ ID NO: 663386 - DNA, 117 bp, Homo sapiens
cagccttcggagcgttctctgtcctacttctgactttacttgtggtgtgaccatgttcattataatctcaagagaaaaaaaaaactgtaaaaaaaagcaaaaaagacaacaaaaaaa

SEQ ID NO: 663387 - DNA, 698 bp, Homo sapiens
caaacaagggtcacctgcaacagcatagagtgtagcatttcgtcagggcatacgtgccgctcatgtagtggcagtctccagaaacggtaacgggggtagtcttcttagcagtacatatacgaaggcagcagcgcacttaccaccccttcacgagaatgctcctgtaacctacaaagtaggccttattcagccatctgcttcttttaccagcctggggaattgatcagaccgtggaaaatgttcctaaaccagttagctgcgttatccgatcaggctctgtaacatctcgcccacagatagcggcttaggagtacccccacgatacgcacagcacaccactgtgccttcgttgagctttcttcctgccataggtagctgggcttgcccaccctagtatgcgttagtagtggtttggcaaggttagaaggccacggcctctctgtcatgctggaaagtgcctactctctggaccactgtagcaaaggccgtggcactagtcatgggtctggaagctccagccatctgcagcaaaggcagcctatcccattgcaaggataggagctgaacgaagtaattcttcagctcttccttttgcataaatgtttagttgaagattataaattggattttctttcacacatactgatcattcttcacagtcttaaataaaacggccctcgatttctctccaatggaaa

SEQ ID NO: 663388 - DNA, 1015 bp, Homo sapiens
  misc_feature (509)..(509): n is a, c, g, or t
  misc_feature (577)..(577): n is a, c, g, or t
  misc_feature (630)..(630): n is a, c, g, or t
aagcagtggtatcaacgcagagtcgccattacggccggggacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagccctccggcgtgtcaggcatactctgagtagataatttgtcatncagcgcatgcaagaatctcactgagccacccatcattgtgaaataattacctcagttgtacaggactnggtgatcaggatccaggcactcacttgtattctactgtcaataaacgtttatnaaacttgatcctgctacgtgaaaacaaaaacatgaactccgattgacgtctctgctgctcgtacgctgagggcatggttcagagctttccatgcttttgacaaggatggagatgggatcatccaggcgcaaccgttctgggagtggatggggggtcacatgtagtgctgaaacaggtgggtcatgcagagccatgaggatcctcagattacagtgagccgcgattccaagcattaccgtcaggaccggggttgccctaggcacccgcctcggggggggcgcgaacaccccacaattgggggggaacaacctgtagagggacacaccgcgaatgggattcattacacgcacagtcgggaggaacagaccgagagtgttggcacaaa

SEQ ID NO: 663389 - DNA, 580 bp, Homo sapiens
  misc_feature (512)..(512): n is a, c, g, or t
aagcagtggtatcaacgcagagtcgccattacggccggggacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagccctccggcgtgtcaggcatactctgagtagatattgtcagcacgcngcaatcagaactcacgagcaccacatggaattactcagtggacagactgggacagatcagcccactgt

SEQ ID NO: 663390 - DNA, 915 bp, Homo sapiens
caatgagaagaagtgatgacagacagaccaagctgtgagatagtagatggcaccctgagtaagctagcaagtaactgagagaactgccagctgatgggaaagctgtagtgcatggcctcagacatcccagtgcctgcatcttgccagtgtgtgatggtgctgtgcttgccaccatgaacatggtgaaatcatgtgatgcatgttgatcttggatgtgaatgctatgtatgatctcttggttggtgcttgacataaaatgttttgccctgtgaaggccacccctgattattccttgtctcactgccatgatccacgtgatgaactaagtttgaaatataaaaaaacataaaatgaacagattgctaatcatcttgtgcatcatgatgcatgttcaatcatgaaacccaaagtgaagtgtggagttcaatgtatatccttgcaatgactgacaatggcctccgtcaaccactcccacattggacacacaacatgatggtttgctcatggtggtgctcctgatgaggaacccttcaggactggaactgagaaagatagatattgaggaagaagtatttgttgatgttagaacctgtcaaaaaacatattgacacatgatatagagcagcatgactatatggtgacgcacaccgttgccaatcatataccacaggggtcgtggcagaacattgtgaacctagaaatggccaatccactgaacatccaaacgcttggaaaagccatctccctgattttgccatttggtgaaatgcaacacatgtctacatcccagcaagggttaggtagtgaatgtgcactacccaagaaggcgtaggattgagatattgtagttggcaccacaattttggcaagtagcgaagcctagaataaaccttggcaaatgcatgcatacatgaa

SEQ ID NO: 663391 - DNA, 248 bp, Homo sapiens
tacctcagcatgaaacaatcaacattagcaaaaagtaataacatgagcagtacggacttaggctaccccctccagtttgctttccgtaactgctaattgtccctactggcaagtcaggaatgattgctgactcacagtatggctgctatgactgtgtataaacttgagggatgggtgcgggaacatagactcactcttccacattcccaagttgggtctagtgtgctgcccagtaacaaaccatggga

SEQ ID NO: 663392 - DNA, 583 bp, Homo sapiens
aactcgctgagaggtcatcaaatgaatacaggataccaggatgaatccagaaatgttgccttatctgcttctgtcaaatattctccaatgttctgaatcttagtcataactgttgcctgatcatgtgcagacattatcaaaagctgctcaaaaagatgctcgacatcatatagtcactaagaaaatccaaatcaaagccacaataaataacacaaccaccaggatggctaccaaaaaaatggaaaataacaagtgtaggccaggaagtggagaaatttgaacatacgtgcactgatggtaggaatgtaaaatggtgcaactgctgtggaaaacagtaaggaagttcttcaaaacgttaaatagaattaactatatgacccgacaattctactcctagatgttatacccaaaaaaatagaaaatggtactcaaacaaataccgtcacagcagtactatttacacatagtcacaaggtggaaataacccaaatttccatcaacagatgactgaataggtaaacaaaatgtgacatgtacatgcactggaatattatacagctataaaacatgaatgaggcactga

SEQ ID NO: 663393 - DNA, 503 bp, Homo sapiens
  misc_feature (371)..(371): n is a, c, g, or t
ggaatcgaggcggaccctgcatctgtgctctctattcccacagcccacctagtctagagaagacacaccagtattactacaactccacagagtatgtgcacagtaattgcggcttaaataaaatgcaaagcctcttcaccaagtgctcctatttccccaaatagaatgtaagcatcttgatggcagagaatacagcttaaatcctcccaggttcccaaccacctttaggaaggaatacagtagaggctgtgtggcaacaataaaaatttgccactcaggccaggcacggtggctcacacctgtaatcccagcaccttgggaggccgagccaggtggatcacctgaggtcaggagttcgagaccagcctggncaacatggcgaaaccccatctctaccaaaaatacaaaaattagccgggcatggtgacgggcgcctataatcccagctacttgggaggctgaggcaggagaactgcttgagcctgggaggcacagattgcagt

SEQ ID NO: 663394 - DNA, 245 bp, Homo sapiens
aaaaacaataccaagaaatatacattcggtagaaactattcttttgtttttgttgcattttgtttgaccttttaaagtagcttcgttctgaagctcagactagatagcctgggctaaccctgaactcccatcgctctctccctacatgcaagtgattttttctacatttatgtttttttctcctttgttttgttttacttattaaccctggtgagtgacaaaagcattctatatgctgtcgacgc

SEQ ID NO: 663395 - DNA, 438 bp, Homo sapiens
ggtgtgcatgtaataacaaaacacaatagatttccattagaaccatcctttaattcaataaattctttggatgaactctgtaaatagactactgacacatagcactcaaaaagtcttatgaaccttaaaacacaaagtattagactgggtagacatatggacaatacagctcatcattttatttttgacatgttggacttcaccatgcaagtaaattaatgcatatatgatatattgttttgttttgagaaagggttttactgtgttacccaggctggaatgcattggcaatgatcttggcttatcagaaatttctgttctcctgggtttaagtgatccttctactttagcctaccaagtttgtgggacttaataagcatacctctttgctcagctaatttttaaactttttttttttaaacattagtgtttcctttt

SEQ ID NO: 663396 - DNA, 291 bp, Homo sapiens
cccttattacgttgaagtacattccttcttttcctaatttgttgagagtttttatcataaaaggttaatgaactctttcaaataatttttctgcatctattgagatgatcataggttttttgccctacattctgttagggtggtgcatcacctttattaatttgcatatgttagctgggcatggtggctcacaccactaatcccagcacttcagaggccgaggcaggcggatcacctgaggtcaggggtttgagaccagccaggccaatgtggagaaaccccgtctctact

SEQ ID NO: 663397 - DNA, 170 bp, Homo sapiens
tctctccacactggtggttttataaaaagaggaagagagaactgagctaacacactcagcctcctcactatgggatgccctgtgctgcctccagactctgtagagagtccccaccagaaatttgtggccttttaggcgggagttaggcgaccaaaccagtgtggagagag

SEQ ID NO: 663398 - DNA, 834 bp, Homo sapiens
  misc_feature (463)..(463): n is a, c, g, or t
ggacgcatgcaggtgagtttgtctatctccgcaggaatgtgacaggtaggtctccagagccttctctctcctgtgcaataatggcaaactctttagaggaggacaataactcattgcagccaggtgtgcgggaatgaagatggcaacagtgtccaaagcaattgaagatcagctgctagtgggtgttagggaacaaggtatggtaagtggcgattgtgctatacacgcatatctgaggaagagtatctggggtgagtgaatttgtggttccttgtggatgtttctggaagataagccttacagacggagaaatgatggatctggcagtgtgggagccttatttgttcaggaccaacctaaaatatgtgggctgataaccggattatcctgtgaccgccaattctcaacgagtagtagttggtaaactagggaggaaggtccgatcgagtcgaaccgaatgggngtaagtagtccgggcgtgcgaaatcttagggtgcaatgaggacacatgtactgaaatcgtcttgtaccacaatgtcgattgatatccgtcaagatcggtacgaattgtacagatccctgtagttagccagtcaattaactatggtggggtttctcccgaaacatccacgcaggaaaccatttccgtgtagcggtgagtggtctagcgcttggtaggagcttaaagtggggaatctagccccaatagcgaccgggggttgcatccgggacaggcttggatgttcactctatgggattctcttgcttagaaatttcgcccaatcctatacatcgggttgacccccaagggtttggtcattaccattgccaaga

SEQ ID NO: 663399 - DNA, 246 bp, Homo sapiens
gaacgggtgctgctggttgcaaagtattctgaatccgtgacggaggccagtgagaaactggagcaggcctgagaagaaggccactgatgctgaggcagatgtggcctccctgaacctgccgcattcagctggttgaggaggagctggacctggtcccagtgagcgcctggctacagccctgcagaagctgtaggaggccgagaaggtggctgatgagagcgagagaggaatgaaggtcatcgaaaa

SEQ ID NO: 663400 - DNA, 128 bp, Homo sapiens
ccatagcaggcacaatggcatgcaatcttctagtggttgagcatagctctgaaatgctcaccagctctgaaatgctggcacgagctgcaacacatgtgctcaaataggatttcaccaaacggaatgtc

SEQ ID NO: 663401 - DNA, 234 bp, Homo sapiens
tcctaaactagggtttttaatgaccccaacaagcaagcatgcagcttcctgcttgaaagggtcttgcctcacccaagttaaagtgcagtggcctttgaagcttactacaccctcaaacttttgggctcaagtgatcctcaccctcccagtggtctttgtagactgcctgatggagtttcatggcccaaaaaaattaaaacagtgtctccaattttaataaatttttccaatcca

SEQ ID NO: 663402 - DNA, 446 bp, Homo sapiens
tataaaaagtcatcagatgatgcagcatactagcgataaaatgtctcatgctagcaaactagagcatttatcaattaagaaaagctttaaaatatatcatgtgtaccatccttagtctgcagactctgaatgtcaccttaaaatgtcagggttaaattacattacggttagtacatgaggcaggcgtgaactttacaacagaaaattgagatagatatacttacatttactttctcttttatggggtaataactgttataatgttaaattcgtatagtatgtcggtgcctcattaagaaactggagatattgatatgatctataagcaaatgtctccaatacgagaaaaagaggactgatttataaatgtggaggactgacacataatgtggaggactgatgggcgcagatctgttcagaactaaaaatggatgtcacaactgata

SEQ ID NO: 663403 - DNA, 162 bp, Homo sapiens
tgtttatcgatgccatgttctcataagtgagcgctaatacataaagatggcatcgataaacaccggtgtttatcgatgccaccaagacacaaagagggcggagagacagacacagaaagagggagacagcggggctggatggacgtgtggcatcgataaaca

SEQ ID NO: 663404 - DNA, 242 bp, Homo sapiens
aattcggcccgggcaatgggtgagccaagcagaagggccaccatgaatctaacacctcgaatgctaacatgaattatcagttagtgtgtgggtgcttgtaaatgagcagagacgggaagctatccaggaagtgtttgaataatcactgggattttgctaaaatcctgttttctactttaatcctttacatgtatagcataaggtggttttaacacgcacagcagtttgtgacttagattctg

SEQ ID NO: 663405 - DNA, 150 bp, Homo sapiens
atctccgcacaggcatcacagtcgcgttatgagtatgttccatcggtgtattagtgtatgtgcaatatccactgcaatcacgctataagactcgagtaaggtgactcaagtggcttcgccgtcagccagcgcagtttacccccagctgtt

SEQ ID NO: 663406 - DNA, 285 bp, Homo sapiens
ccctgcagaggggttagggcaatcagctaagcatggtggctcacgcttgtatcccagcactttgggagcaaggcaagaggattaccttgaggcaggagttaagagagcagccggcaacacagcaagacctgtctctacaaacaaaatttaaaattagcttagtgcactagtaagttgcagtccagctaccctgagaggctgaggcaggaggatcaccttgactccagggagttgggagggtacaggtctaaaacggcttcttgcagggtaccggaggctccaaat

SEQ ID NO: 663407 - DNA, 1749 bp, Homo sapiens
  misc_feature (274)..(274): n is a, c, g, or t
  misc_feature (1138)..(1138): n is a, c, g, or t
gttgactatctcctaacagcgaacaaacgacttgtacaaacacagttggtagtaccacttggccgggtaggtccctacaatgcggaggtcaaaggtggtaatccagcctgggaagcgtaggaggagcgacggaggaagagacgagatggaaccgccgagacagaatggagcgagaaggatggcactacctgtgcatgccgagggcaaagaccatttgcacatcatcgagacacacgaggactgcggaaggctagattgcaagcagttcaccatngccccgaagacgtctgactacgcactgtgctactaggagagtcaagacgtacacatgtgactggcataccaggctatcagaccgcccgatatgaccaccatactggctagagactcaattcaagctagatgctcagtggactagacctgcagggctagtataggcgaaggcgagatgcgccggcgcttgacatagagatagagctattgaagccccctcccagaaacctggatagcgaaattggcgcaactagttggcgaacacaacggcggcgacgaaaccctctattggcaatgtgacaccacacttgcgagtacctttgtgcccctgtaatctagacttctccaggtacctaatagttaagttccaacgtggaaggcccccacacgataccttgcgtccaagtgaaataccaaaaggcctttgggaggccttccctaggtaggttggatcgtgtggcaggatacaccccgttgggagtggacacatagcgaggccccattgttcatgttccccactggggagaaaccttccacccgttgggtcatatggaccaggagttggttctttgggcacgttctaagcatcctaacgttggggccatcccaaactgtgggtaattttggccaccgattaaacctaatattctcctcttacgcctggggattggccactgttgattaggcaacaacgagcccgtaaaacgagtgccgaaacctatgcacagtgaaacacacaaactccgccttgccgtgacgccagaggaattgccatgacagggtgcgttcacacattttgcgccccccgaggataagcgaccctggtaattgtcccggggcagacacctgacaatttcccaaaaangccaggacaaacatacatgactgggtcacatgcagtcaaacgtgcgacaacactgatcccaaagtgtggtatgggatgacccccgttcacccaaagtgtgttttgcccatgaacactgatccaaacagcataacggggacacagagattcagtagggcagataaccatgctagacaatatagtaaattaggtagataaacccacaagcaccaaacataagagaaacattcgcatgcacgcgaaggtcactatgtgcttggcgacgtctattgtacgatatcctagagaaatttggaaatttacatactggaacggcacacctgggacaggcgtgggggattaaaagaaaaacagcgcccgcttaccctatgggcaaagctggacagggacttggccacaaggcagggcgagcccacaccaagacgaacgggctgtgcaccaaagcgacagacccaggggagaaaactcctacgagcactgagaggaaacgagaccacagtgacaacagtgagccgaaaaaaaaacaaaggcagcagcagacagagcatagcaacgacggacagacccacacgacggagtgcaaacagagcaccgaagacacataagcacgt

SEQ ID NO: 663408 - DNA, 696 bp, Homo sapiens
acatgcctatcatatagtagaaccagacccatgagccgtaacaaggggccctcatcagtcctgcctaatgacctccggcctagccatgtgatttcacttccactccataacgctcctcatactaggcctactaaccaacacactaatcatataccaaagaagagggcgatgtaacacgagaaagcacataccaaggcaccataaccactgtccaagaaaggcttcgatacgggataatcctatttattacctcagaagtgcctctcttcgcaggatttttcgtgagccttttacccactccagcctagcccctaccccaccaataggagggcactgggccccaacaggcatcagcccgtttaaatgccctagaagtcccactcgcttaaacacatccgtattactcggcatcaggagtatcaatcacctgaggtcacgcatagtctaatagaaaacaaaccgaagaaccagcataattcacagcactgcttatgtacaagtgtacggggtctctattgtaccctcctacaagcctcagagtacttcgagtctcccttcaccatgttccgacggcatctacggctcaaccatttgtgtagccacaggcttccacggatcttcacgtcatcataggctcagcttcctcactatctgcttcatccggcactaatatttcactctacatccaacatcagt

SEQ ID NO: 663409 - DNA, 176 bp, Homo sapiens
gatagtatgcattagcttgctaaaaggcacctaagcagcagcatcatctctatgccttcagtaaattgtggaacatttctaaaatactccttggaagcagagacagtgtggtcctttgcatatcagtgactgagcaaaattttacggatcaatgtgtatgtgtctctgtgtgtctg

SEQ ID NO: 663410 - DNA, 187 bp, Homo sapiens
aactttttggacccccagttttttgattttttatttggggggggtttgggggcccggcccttttttttcccccttggaggaaataagatgggggggaaaggaaaagggggggaaactttcccctccccccttcccctttaggtttttgaaaaggggcccccgcagaataaatttgcccgttttttta

SEQ ID NO: 663411 - DNA, 251 bp, Homo sapiens
gaaaaccccctggggtttttttttgggggggaaaacattttcccccccccccccccttttcccttttggggggggcccccggggggggtttccccccccccccccccctccccccccctttttttttttggggggggggggggcccccccttttttttttccccttttttcccaagggggggcccccgggggggggggggggggttttttttgggtttttttttttaaggcccggtttttcccccccccca

SEQ ID NO: 663412 - DNA, 359 bp, Homo sapiens
ggctgagcgcagcggtttacttgtgtaatcccagcactttggaaggccggggcggccagatcacctgaagtcaggagttcgaaacaagcctgctcgacgtgttagaaaccccatctccactaaaaaaagaggcaggagaatcgcttgtaccgtatggagaggttgcagtgagtcaagattgctgccattgcactagaccctcggcggtcagagcaaaaattccgtggagcgccttctatgattacagtgctcatgtcgctcccatcgaccgataggatttatgactgcacaagattatgcatccgtacgttcgatcactggtccattacgcccttttgagagctgtataccatggggtg

SEQ ID NO: 663413 - DNA, 581 bp, Homo sapiens
  misc_feature (402)..(402): n is a, c, g, or t
  misc_feature (569)..(569): n is a, c, g, or t
  misc_feature (578)..(578): n is a, c, g, or t
tgtggagacggggttcaagaagatgggttgaatctctgtggctcgttttctctctgtgtcctttggccaccttgtccgggattcagatgcagttatgagatatgggcagagtgggataagtaaagcctcactttctggtcagagaactaaatagggagccccagggaacaggaaagtacgggggacatcacagagagggaggagatggggcaagtgaccccattaagtggcttatgaacggctgggctccccctccaaactgtaactatgtggatctaatcctaaggagcataccaaagactttgagaactgaactaaggaaaagaccacagcctacaaagagatctatctgcctagaaaggaaaagccttggaaactgacattgaaatcaaaaaagacggntgggaactggtggcctgaacccaaccgggtttaaggctggtcaaaacaaggtcaaaattctccataagatccagaatctgggctgggcacggtggcttacgctgtaatcccagcacttggggaggcaaggtaggcagatcacctgaggtcaggagtttgagaccagnctgggcaanata

SEQ ID NO: 663414 - DNA, 423 bp, Homo sapiens
tcaaagaagggagttgtgggggcaggacatgccccacaaggtgaaccagacaaatggctttacacctgtagtgtaaaggggccactatgaatccctatgtatgaaaggagggaggcaggtggcagttcagccacagaagggggcttatggaagacaggaggagctcatttcctcggacacatttgggctggtaagacctggtgttggtgtgtcttaaaaaaagagaagtcagtgctaccatttttggtattttaaagatattaaagaatggattccaacttggaaacaaaaaataaacaaaaacaaaaaagaaaaaaaaacaaagggggggggcggactaataaaaataacacggagaggcaccacagaattaagaagtaccaaaggatgtgatgaaaaaaggggggcacataaagagaggcg

SEQ ID NO: 663415 - DNA, 145 bp, Homo sapiens
cttcatctccgtcccacctcacaatttactgaccacaggaccctctcaagtagcaggactacaggcgtatgctaccacgcccggctaatttttctatttttgtgtggagacaggattgtgcgatgttgcccaacgtgttcttcaa

SEQ ID NO: 663416 - DNA, 486 bp, Homo sapiens
tcagcttcttaaaaaacaataatggtcatctggttgcacagattaatcccagatacttaattaataacgcaaatatctacgatcagcagtgagcttataaatgatcactaggtgtccaccgagaagataatcaaggctatatagaggtgtaaacctgaaaattggtgtccatttaataataggatacaattggcacggaagagttataaaaagataacctacacacatacagttacttggcctcaaacaactgcttagaaatacagtataaacatttacgaaccacgacaaagtgggggtccaaacttcaacaaagatcttctggaaacccagtataaagataacgggctcaagaccatatcccaaagtgaaatcagcaggagattggatggtaagattctaccttttaaaaaaagagcacactgggtaatacatggtttttaaactggagctacagtaatgctacaaatcccttcaccctcccaa

SEQ ID NO: 663417 - DNA, 149 bp, Homo sapiens
  misc_feature (131)..(131): n is a, c, g, or t
caggcggttggggccgccctccgtgtcgtgggcccagttgcaggggcagggtctgtcccgccatccatcccatccccgtccatttcattccatcccaacacggcccatcgttcgcagaggtcactgcagcncagcacattctgtccatc

SEQ ID NO: 663418 - DNA, 223 bp, Homo sapiens
gcttggatatccactgcatcatcgggatgcattttatcatgctgcatggattacactgcaatcaatcacgctgcatggaatccactgcattcagtcgggatgatttgggccatgctccatataatccacagcagtcaatcgggatgcattgggcctcactgcatggactccactgcatacaatcgggatccattgcgccacaatgcatggaatcagaccgctc

SEQ ID NO: 663419 - DNA, 1243 bp, Homo sapiens
ctggatgacagagtgagacttcatctcaaaaaaaaaaaaaaaaccaaaaaaaaacaacccgggtagctttggtcccttccccattgacaaatttatcaaatccagaagcttgagaagtttcgtctctaattaatttttctcctgaacaaaattacccaagtcaaaacaaaatgtatttttagaattcacggcagcatacgacctgaatttggtgagtctcgaggcttaatcttaacatcaccatttccctaaaaatgggttcctattactccttagaaatggctgggtgggcaacttggatggaacacagccaaatggcaccaggggcaggtcactttcccattacactggatcccacatattaaacaaccacaaagagcaaaaaacaaactccctggcagaatagcacaccagatctatgagggttatctcccaaagacctccctttaacctaacttcatctttgcgaaaagccaacatttcccatttgaccactaaacacaacattaaccccagtggcaaaacacgacgcttgaaaaagcccatacaaggtccccgggcccgcggacgcccagggcacacagtgtcgacgcgggcgcggctcccaacgccacgcagacttctcacaacgctccacgcgcacctgcggatcacacgacactgttccaacacacacacaagcaacagggatcagctcacacgtgtgaatccccccagttaaaaaacccaagggaccagcgcggcacacagacgaagaggctacaggaacgctgatccacaaagtgaaccacccaaagaaacgaccacggcgcactacaagctcaaatccccaccaagcgcaaccagggcacatggaaccacagtaacgcaacgacccgccccacccacagaccccgaaccccacgacagaacacaccgcaacaaacacaggccaaaaccgcagggcccgccactgaacaaacacagaagactacacaaccacctattgtacgcagcccaacacatcaaaaaaaacgaaccctatggtacatgaaaaaagggtcacgaacagggttaaagccacacaaaatattcatctccgcgtgagcacggacgatatcacaacattagaacaattccacgacacaccggcgccgacaaacccagtaatcgacagacccgcagtatcagccgagcactaatggtagacatggcgacaggcttattagttcttttttgtttttttattacggacgggcggccg

SEQ ID NO: 663420 - DNA, 154 bp, Homo sapiens
tctagaggatcctctgacttaggacgcgactttggaggcctgacagcagcgtctgatatttgccggcaaacagctggaggatagggcgcactctctcagactacaacatccagaaagagtccaccctgcacctggtgtttgcgcctagcgaggt

SEQ ID NO: 663421 - DNA, 150 bp, Homo sapiens
tgcggctactactattttaaattatattcggagccttctcaaaaaatagctcacattagaaactgtcctttagttccccatctctggcccatggactatagaggggagcaggtccaggacaataagtcctttaattaggaagccagcaag

SEQ ID NO: 663422 - DNA, 383 bp, Homo sapiens
ttgtttctggcgcgtcccacatgaccccgactccgtgtgttacagagtcggccgaataagctcagaagcagtaatgcagatgctgaagaaaagtaggaccggagccatgtacaagtcggacaggggccatgacaagtcggaccgtagccatgagaaactagacaggggccacgacgagtcagaccggggccacgacaagtctgacagggatcgagagcgtggctatgacaaggtagacggagagagagagcgagacagggaacgggatcgggaccgcgggtatgacaaggcagaccgggaagagggcaaagaacggcgccaccatcgccgggaggagctggctccctatcccaagagcaagaaggtaagccgaaaggatgaag

SEQ ID NO: 663423 - DNA, 482 bp, Homo sapiens
aaaaaaccatttctcttcttcctgttattggtagttctgaacgttaaatattttttttccatggggtcacaaggtacctcagtatatgattgcgagtggatttatagcgcacagaaatcaggtattggcagtttttcccttttcatttgtgtgtgaatttttaatataaatgcgtattcgtaaagcattaatgcaagttccaatgtttcagtgaacaagtttcagcggttcaactttataataattataaatgggcctgttgcctttttttgcccaatgccagcatttccctttttttggatcaagtatttttcttattgatggcttttaaatggtgtttgtagcacttttatcattcagtagattccttccatcccctatacttttctaactgagttgtccacatgcaaagaacatgtttttaatgtagtctgtaatatgtactgttcctgtaagtttgctattaaaaaacattaaaaaat

SEQ ID NO: 663424 - DNA, 200 bp, Homo sapiens
aaaaaggcttgttgatgtaatctgtgtgtaggccagcctcctggggcacagtgcgggatggcagagggacaaacgaaagctctccagcatagtccctgttctagaagccagatccatttactccagctcacttcctgactaggtcatttcaggatcatgccaaatatgaacagtctgtccactctctcgttggccttctt

SEQ ID NO: 663425 - DNA, 1521 bp, Homo sapiens
  misc_feature (233)..(233): n is a, c, g, or t
  misc_feature (1121)..(1121): n is a, c, g, or t
ctccctcttcttcgcctgtcgtgaatgaagtcgctgttcgttctccgtgaggaccggtgggtcaagctcccaccacgtattgtttttgggcaccccccccctcccgtctttgctttgagcgtgtggggcccttttttttgtttaaaacgacaagatggtggtgaacgccccccgcgcccctctctgttgtttggggggggggggaagatctgtccaccaagactgtggggggngggcccaccagtcgtttcgtctgttggatcgaaaagggataagagtttttcctctccccagtcgataggtgctgtccatcgtgaaataggagagcccctccttccgtcttgggggctgtcttataaggtaagtctaccaaccaggaggccgttgcctcctccaaaacgaccccgcgaaagtgtggtgtgggcgagcaagaagagtgaataagcgcccttgtgggaagagaaaatggggggccgcagaaccaacctgtggaaggaaaagtctttcgtgtcccagacaaggatccgctgccgacagagtcccccctggcggtgggggggaaatttttcttccgccgcagaatcctgcacttgtagaagtcccccccccaggggataaaaaaggggggggaaaaatttctcctcgttgaatgtggccccacacatgatgtagtaacacagacaacatgggtgtagaacacccctgcttttgggttaaagaacacaactggttgggcctctttttgagcacacatatagggcgctggtaggctcacgcccccccacctctatggtcttctagaggcgcacacgttgagcacacatcgccacatggtgtcgacacatcttttgtggttgtcacaccatgcgtgggttggtgacacacatataggtgtggtaattttttctatgatgcgtaaaatgcgccccacatctgtctatggaaaattttttctcctataaggcgcgagaaatttatcacattgagaatgtctaccactcgaataaaggggggtatagttcctcgagagtggagacaccacggtgttccgcgcacactctctcgtgatcactcggtaatttttgggcgcactctgtctggcccgctatagctatagagangttctctctgtgtggggtctttgtgtgaaacactcgggagaactagactccacgcctttttcttctgcacagtcacacaccgcactagagggcacacaattcacgagtataaccccacctcgagactaatgagagagatctatacttgtaataataagataaatgttcttcgagctcgtaataaccactctttgagccacgtgtgtttacacacacacatgtacactaaagagaatacaccactaaattcacaactagaagatttgaagaattgggcttgtaataagttagtaaccacaccaccacgtatgaaacactttctaactttgaaaggaatttccattattctcttaatgttgtgtaattgattaggtaactaaaaagcgccaattgttggcca

SEQ ID NO: 663426 - DNA, 1216 bp, Homo sapiens
  misc_feature (159)..(159): n is a, c, g, or t
ccggacgccgatgtcgctcgcattaacgtccccagaatggagactggaccagactcattattccccattgtcgtctttggacatcgtagatgcgggctggtccacctactatctggtccctctgatctataagatgacggtgggcatcagcacaagacngtaactcattgcaaaaggaatttagacgcaccgtgaggagccatgtctggacgataggtggaacatgggcctcctatcatgtcatgcctggggtctagcgcaataagactgagaagcctgagacagtgcaagcagtgagtcatcactcaatgtagactagtcttaccttgatggggaacatctggacgatcatggcaagtacctatggtgcacgattcattagagttgcccaccgggaaccaacaggcatgaatctgtatactctaggatgactatgcatgtgtccaggtgccaacatacttacgaatgcatcctgaactggtgatctggtttcccatgacaattgtggtcgcccctcgacctagaggctcgcttcgtggatcgatactcctcgtatgagtacatggcgttaaatcctttcgcaaagagactttgcgggacgcaagagcacccgcaggaacgtcctattggcgccctattactaggggcatttaacaacaacccttgtggggatggactgcacgacagcttaaaccttaacactttggtttcacgcgactggcctataatacgccataacaagtttgccgtaccattccaccaacccattgtgacaaaccccaaaaccgctataagcaagaacagccccggcaaaccgcaaggacctttcctggaaggggcccacaacttgggttccctaggcgagacacgcgatttcaccccccgaacctgctacatcatcttttcacggggaaaacaacatcccgggtgcgacctaaccccacaaccgcccgggacaaccccaaggtacactacgactactcgcgtgccccaaacgaaaaagccacacgcggacaccgggccaacaaccggggcctgcaccgcacacactgtgcgccggagaaagcccccaccaggagccactagaccgatagacccctccggaggcgccccaacagggcgggcacacgcccacacaacggtgccacaccccacgggcacacaagcaccactgcgacacgaacacaggcgcccagaatttggcagaagcacacac

SEQ ID NO: 663427 - DNA, 339 bp, Homo sapiens
gccggaccttcaggctgattgcaggcgaatcacttgagactgggaggtggaggttgtggtgaaccgagattgtgccattgcactccagcttgggcaacaagaccaaaactccatctcaaaaaaaaaaaaaaaaaaaaaaaaaagaaaagaaaaactgggtattttggggcagtgaatgcgtgggaggtggggtggaaaataaagggcttggtggtggaggaagcttggagatgagcttcccttttaataataacaatttaaacaccctatgtggaatgtgtagaattgagttttttcgggccaggtgcaggggctcacgccgtgcaatcaagccgggaa

SEQ ID NO: 663428 - DNA, 319 bp, Homo sapiens
ggtgatatttttacccctaggattcctgcccatttgtctgaaagctttagaatcattcctacacagatgcccaattttcccatcaagttctgttactcccacagccctgttaaaaattctcagcatggtggaacatgatccctgctaagaatacaaaaattggccgggcgtggtggcgcctgtctgtggtctcagctcttggggaggctggggcaggagaatcgcttgaacccgggagtcatgggttccagtgggccacgactgcgccactgcacttcagcccgggcaacagagtaagactctgtcttaaaaaaaaaaa

SEQ ID NO: 663429 - DNA, 651 bp, Homo sapiens
ggggagcagttttcccctggcctcagttcccagctccccccgcccaccctacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccactcctgcggcctgggcacgcttcccctgcgcctcaccaaggggcccaacccccatctcatcctggcacgccctactccactgccctggcagcagcaggtgtggccaatggacgggggtgctggcccccaggattcccccagccaaactgtctttgtcaccacgctgcggctcacatatcatccttccccaccttccctagctccccgtacccaggctccgcaccccgccccctacggctcccgcgaaggcacggcccggtgagtcccctactccctcttcactgtggccacagcccccttgccctccgcctgccctctgcactccacactgccgccgcctcccccctgcccctccctcacggacccacgtgacgccccacagagccctgcggacgcccacctcccgctacgccgccccccgcccccccaccccctacctccc

SEQ ID NO: 663430 - DNA, 534 bp, Homo sapiens
aactttagaatcttttctcctgtgtttcaagtgacttccatcggtgtggtttctccaggggtgatcccagggacaccagcttgagaatcacctggggaaggggtagggtggggggaggagggggcttatcaaatgcagttccttgggaccagcccgtcctttgcttctctcagaacccctgtgagtagatggataatcaacctccttttaccatagatgaaactgaggctcggagaagttaggggacatgcccgagatgatttaattaaataatgacaggcatatcttcaactgctgcagcccctgccctggtcacaggctccctgtggaccccacctgctaaacataaacaaacccatagtgcagcagccacaactcaagctgggaggcctttgtggaggttgatttttatctccccgcagtcaggcacaagtgagagtttcataaatagttctaacaaagctgcctttcacagccagctctttgcactgtaaaaaataataataataaaataaaaacctgatttcagaaaaa

SEQ ID NO: 663431 - DNA, 164 bp, Homo sapiens
agggccaaatatcagagaacacgtatcacgaaaaaaactcgtgcgtcgtcgtagtactaaatctccctacaaatctccttaattataacattcacagccaccagaacctaatcactatttcactatcttcgttcgaagaccacacattatccaccaccgttggc

SEQ ID NO: 663432 - DNA, 117 bp, Homo sapiens
ggatctacattcaggtggctgtcctggacgtgaagtggacgtgagtgctggtacttcgtggtacatgctcgcaataaacctgttggattgagtctggtctgatttaaaacgcgatct

SEQ ID NO: 663433 - DNA, 331 bp, Homo sapiens
tgtacccgcacgctagacacagacctctcagcacacagacacacagacctcagcacctagacctctcagcacccagacctcagcacctagacctctcagcatacagacctctcagaacacagacctcagcacccagaccacagtacccagacctctcagcacacagacttctcagcacccagacctcacacatcacatacacacaaaccttacacacaccacacacacagacctcacacaatacacacacatacagaccacacacacacactgcacacagacctcacacaccacacacacacagacctcacacacacgtgcacctcatcat

SEQ ID NO: 663434 - DNA, 204 bp, Homo sapiens
gtagttgaatccattcactagaagactggtcaattgttctgatacaaaatcctttcttaagtggacattaataaaaccaggaccagcaatttcaactttttcaatacattcattgtatcttgatagaaggattcccctctctctattaaagagatgtccaatgcatcatagattttatttaactcttgctactctggaaaggtg

SEQ ID NO: 663435 - DNA, 137 bp, Homo sapiens
cctcagatgggtcagagtgactttggctgctgctgctgccgcttgccgggagctggaagagggctgcggctgggcctgtgccgactgtcgtcgtggtgctgacctggagcctttggtactgagcgcgtggctcgatg

SEQ ID NO: 663436 - DNA, 115 bp, Homo sapiens
taaagtgccgggagttagtaatgtgagccacgatacccagcccaagctcttgactttcaggcttcctcatcctgttgacttctctgcggcactaatttcacaatggcacgtggat

SEQ ID NO: 663437 - DNA, 380 bp, Homo sapiens
cccacaaatcctctccgcagcccttggtggacacacccagccagcatcaccagcagcagcagcagcagatcaaacggtcagcccgcatgtgtggtgatgtgtgaggcatgtctggcgcactgagtgactgtggtcactgtgatttctgtcgggacatgaagaatgttctggtggtgccccaacaatgatcctgtgcagaagtgccggctgctgccagtgccagctgcgtggcccgggaatcgtacaagtacttcccttcctctgctctcaccagtgactgccctcagagtccctgccaaggcccctgcctggcactgcccacccaacagcagccacatgccatcacatgaatgttagggcgcataccagtgaagatagag

SEQ ID NO: 663438 - DNA, 129 bp, Homo sapiens
gaaaaggcttgatattctgtggaaattaaaatgttattcctgcttcttaattaaaagtggttcaaaatccttcaaataaggttctgaaagctgtccgattgggatggttggaattccaacaaatagtca

SEQ ID NO: 663439 - DNA, 179 bp, Homo sapiens
  misc_feature (127)..(127): n is a, c, g, or t
ccactgccccactttcagagggtagagcaaaagcctcattgtgaaaggcactggacttggaccagggacaccatcaggggccttggtttaactcacgcactaaaattggagacgtggactaactcgnccaacagactcccttctgactctgaccatttttgaaacttgctgagacgaaa

SEQ ID NO: 663440 - DNA, 303 bp, Homo sapiens
atggtatctagaggatccctcatcccagaatacactgtaactaatgagtcatacatattccagagaccaatctgagatagatagcggccatgtgaggtttaccatctcgagtgatacagcaatggcagcagtagcggcagtggcttaggcctgggtgaaggcagtggctactcctacagcagtggtcacagccttggaggtggcttcagttctggcagtggtagagccctgagaagtggtctcagctccactcagggaagcagttccaccatcagatacaccacctcctcctcctccagcagg

SEQ ID NO: 663441 - DNA, 873 bp, Homo sapiens
aacttctcgtaagtacctaatcaaccacaaaacagacgcacccgtgagccttaacaaattgtcccgagccctgttctccggtttacaaacgtggttaaacaaaagtcccctcccccctctaaaacccctgtccagctccctcccctgcaagttccccagtttttcaaccacacggctgcttttccatttaccccccgcttcccaagtacttttccaggtcgcagcaaatctgtttgtcgacgtaccacatcccgctagctcctttttacgcacaaccaacattcgtggtgttatcacacaaaccgagtcacatgtgattggacctcccacagtccacaaatggtcgacaagtttctccccctgactacaactcggggtaccccccatgcatatctccttcggccgctcctcaaccatccgtaggcgtccaaacccaaaattcacaaggggcaccccacacttggacgcagtcgtatgaatcaacttacacccccgtcggttcctttcgacaaatcacatccaatgacacctctgattcccgaggacaaaccccatttgtccatattctggtagaataaacgcccccacttcttcgagccaatcctccgccattcggaatttcacttctggaacatccgcctactataccccgtaatactccctgccgcccctcaatagatgatgcttcccccccgccgtgtaaaaacataaaaaccccccccctttgttgtaaagcggcaaaatcttcccctcacgcgagaccccatcgcctcccgtcctaataaataataatggcacaaacaggtcctccctcatattcttttctacaccgggggggaaacaacccgaccgtttccaaacaccaaaataaca

SEQ ID NO: 663442 - DNA, 992 bp, Homo sapiens
tggccaccaattatttttcttttttgcgaggtgtgaggcaggcaacctgggaaggcagggtagggttgacctcttcttcctcacatggacaccaggccttagttctctcccagataagctaaggtcggacaggggtctgagggcgacttgagtgcagggaggatgcttagggccctgtgggacctcagagagacgctggggtcacaaggtatgagctgaccgcagtgggggtttgggggcgttgaacgtttgatgcaaggtctcaaagggttgacctgcaactcgaaagggaggaggcccacatataacccaggacttgcaggttgttatgcacttaccattgggcctcattacaggctctaacaaacaaatttgcacctcaagacggtagttctccacgatcgattcaacaaagaacacttgggggcgtcaaagcgttacgagacctcaggcgcgtgccaccagagtgagccggcttcaacattcgtagaccgcaagtggtcccaaaccgtccaaaaactcgcaagactcaaacgtgaacgcgtggtcaagccatatacaccccaagaatcaataataacggccccaaagagggtaccaccgtgggatcccactggcggggaccaagacggctcaacaatggcaaacgccaacacactccacggccgaacccgcgcaaaggcacgcaacagcgacacgagcacgcgataacaccagacgtagacgaccggggtttaaacccccgcaacgcccccccctagggcgactagcaacaggattgacaagaacgccacacagggaggtactacacagaatctcacctcagagggccccagaagaaggacgcccacaggactgcgacacatcaacgaaccccatacgaaacaccgtgagcactccaacaaggacaaccgctacaccgagccccgggggccaacccacgaacccagcaaagacgacaacacggcgacccaaaagcatcccacgacatg

SEQ ID NO: 663443 - DNA, 173 bp, Homo sapiens
agagacggaagagaggaaaatgcgagcacatctataataaatgggtgcagggtttcttgagggttaggaaaatctttgacatcatcagtagcgtatcacactgtgaatgtactaatgccactgacctgtttactttaaaatggtattttgtggtggttttggtttttggcagg

SEQ ID NO: 663444 - DNA, 223 bp, Homo sapiens
ttagccgatcgttacaaggtctctacctggtaagcatccaacgttactctctggtgggccaaagcagaagtcaaaaaaatcagacactgaatagtctgatgagatgaagagacacagaaaacccaccagccaaaacacaaccctaacaaagggagaggaatttctcacgtaatgcacagatcactcttgagaacagggatagatacggggtgggaattctgaa

SEQ ID NO: 663445 - DNA, 128 bp, Homo sapiens
ttcggtctaatcatgttggctcactatagccagccacttctaaaatctagaatggtttctgaggcgaaggaatcttgcagtcttctgtcttttaaacaaggttctcgaggcaaatcaggaatcttgag

SEQ ID NO: 663446 - DNA, 381 bp, Homo sapiens
ggcaataaagaaagagacagagtctcactatggcccaggctggtcttgaactcctgggctcaagcgatcctcctgccttggcctctcaaagtgtttggatttacctgcgtgagtcctttgctggccctttaaacaaattgtaacatactattcaagtatctaggttttaacagggtcagctcctttgttttatcttcctcttcagttaaaaccattctccagttgattttgaatgatttaatgaatgtcattttgatcttgatacaaatgcattccaaaactgtaattttgatgagtaaattagaattttaatatgggcttaattgttttttttgccactgttctccagcctgggcagcaatgagacccagtccccctgcc

SEQ ID NO: 663447 - DNA, 1647 bp, Homo sapiens
  misc_feature (1315)..(1315): n is a, c, g, or t
  misc_feature (1617)..(1617): n is a, c, g, or t
tgggggaggttcccttttatgggttctaaacagttggtgggaagggaaaaaatgaggccatctaaaggccggagaggtcgcccagggccccaaacactgtgccacccgtaaagttaggtggtgtggaagctgtggtctccgagggatgtgttgtgcgagcccttaagcacgagggcacggggtgggggcaggagcagcgaggggttccccgagggtgtgtgtgtgagagagggctgtgggtgaggggcaccagaggaatggggacctctccgtggtggctgtgggtgcccccgtgggtggccctattgtgtgtgttgtggagcgcacgctgtgggcgccgaggggctgcgtggctcgcggggcctctcacagttgtcacgcgcgcacagagggtgcctctcgcgtgtgccgcgtgagaacacacacacagagaccagaggtggcggtggggcccccacacgagtggggtgggcgctgtgaaaacgcgcgtggggacgcgtgttgtgtggcacccctttgtgttaaccccccgcgttgttgagacgggggggggtactccccggggggggcgaggggggcgccctcaagatgtgtgggccgtgtgcgccgggtgagcgccgtgtgttcggtgctcccaactgtgttgctccccagaggggttgcatatgttgtggccacccccacagcaggagctgtggtggggcaccaccgcaggggggggaagcacggggaaccagcgcgccgcacccacgaagggggtggcggctcataccagagggcgggggggaagtgtgtaaaaaggacgcggctgttgtagggggaacccaaccttcacatatattaataccgccgggtggggatacaccgagaggagcagaggggggagggggggaacccaccacacccccggagggcgggaggcggaagcatgtggggagggagtgcatggccacccgtagcatcctaattaatgagaaggaaggttgcttgtttgatggccgcctaacggtagaatgaatgtgtgaggtcacattgacggcccgaaatagagaatccacaccaggggggggaggtcattcccagcagggggccccccatttattgctgggtggccggctattattatctactatataccaaaaaccacatcaatactagtggagcaccacaaaaggtagggccgctcactaccgaaaaaacaaactgcaagtgatgccctgcggtggagggtgagggtggtccgctcccaggatggggtttgtatgtgttcccccccaccacacggtgggtggtcttgtgtggtgaccgcgacaanagcagtaacggagcaccacacttctgtgtaggtaggttcattatcaaccagccgaatggagagaaaccaccttcgttccaataacgaacaatccttattaatctaccccaccactattatctgttggatggggagaggcgagccacaactcagtatggtggtgggcgcgggcggacagcccccaatctacaataatcaattctccaccgacaggagggagaaaagattgtgaggcggcgaagcagataggacggagagcgagaagacaattatgttgtgtgaggggcccaccccactaaaanaaaagagttgtgagtctcactctgtgtgac

SEQ ID NO: 663448 - DNA, 81 bp, Homo sapiens
actgtgaggcatcctgtgtgtgtgaagcacccgccgtcagtcaagtatccctggtgcttcctctcagaactcatcaaaaag

SEQ ID NO: 663449 - DNA, 294 bp, Homo sapiens
aggggggggggtttttccccccccccccggggggaaattttttaaaccttttggtcgggttagcccccccccaaagggggccccctgggtttttccctttggggggccccccccccaagggggcatttttaaaaaaaaaaaataccgggggcccgggggggggggggggggggggggaacccaaaggggaaaaaaaaaaaccccggttttttttgggggggtttaaagggttttgaatttggggggggggggggggccccttgggggttttttttaatttttttggccggccca

SEQ ID NO: 663450 - DNA, 583 bp, Homo sapiens
aggatccccgtgggagacggggtccaccatgtgggcaggagggtctcaatatctggatctcgtgattggcccgcccgggactccgaaagtgctgggattacaggcatgagccaccacactcgggctccggtgacctttaagatgaatattttaaagactttttcccacatgtgtacctttccagaaggttcacaccattggtgctttctctagacctgtataaccagaagctctggggaacatgagttcttgagaatatcagcacgggcgtcagaggggatgaaataactttcaaagatcaggataactaccttgccaatgtatagggcttctcatggctgcagtttccagaacaacttttctttgggtccaggacgatcttccccatggctgtggttgggatatggttggttgggccctgccaagtctcatgttaacatttgatacccaacatgtgggtggcagggcctggtggaaggtgtttgggccatggggtgcatccctcatggcttggtgccatgctcaaggtagtaagtgagttctcgctctattagttcctgtgagagctattgttaaaaagaga

SEQ ID NO: 663451 - DNA, 123 bp, Homo sapiens
ccgaaattctgtttctcttgccctccgggtccagaatgccctgcactgcctcctggcctcagagcgctgctgcggtggtgggaaggctgcccagcagtgagggaaggcgacgtgcagcgtgct

SEQ ID NO: 663452 - DNA, 274 bp, Homo sapiens
  misc_feature (169)..(169): n is a, c, g, or t
tgaagcacttgtttctggtgtggacagaagccaagggccttgtgtaacttctgcgagctacagggtctaggttctgttggtggccttaagaggttttggaacagaagagggatcttgctgggtggaggatgatgactggcaagatccctgtgagggatccctcagcatncctggtgaggtggatcctgaggctggcccctgatggacaggaggattgcttgtggccagaagttcaagaccagcctgggcaacatattgagaccctgtctctaca

SEQ ID NO: 663453 - DNA, 139 bp, Homo sapiens
ctcccacagactaggaacaaaaacaacaagaaggacttgaggcactcataaatattaagcaattagctgcagcagctactcccctcccctccagtcgatccagtcaccaaggcaacttgggcagggtgcctgctggttg

SEQ ID NO: 663454 - DNA, 516 bp, Homo sapiens
  misc_feature (331)..(332): n is a, c, g, or t
ggaggaggatgacaaggaggacgatgacgacgacgaagatgatgatgatgaggaggacgaagaggaggaggaggaagaggaggaggatgacgatgatgacacggaggactttgctgaccaagaaaacttgcctgacccccaggacatcagctgccaccaaagcccttccaagacagaccatctcacagagaaggcctattcagacacccccagggacttccctgactccttccaggctggcagtcctggccatctgggggtgatccgggacttctccatcgaatctctgctaagggagaacctgtaccccaaggccaacatccccgacagnngaccctccttgtctccattcgccccggacttctttccacacctctggccaggggacttcggtgcctttgcccagctgcctgagcagcccatggacagtgggccactggatctggtcatcagaatcggaagatcaaggaggaggagaaggagagctgcccccacccccaccacccccagtacacg

SEQ ID NO: 663455 - DNA, 709 bp, Homo sapiens
actttttgaactgtctattatatggtggatgatgatttcatcgtcacgtgcatggacgctgttctgttcagaagtgctctttggactacattaagtcccctgtggagcagcagggctaggagatctctgcagtcccttccccgaccagcctctgccagaaggcaatggatgtgcacgtgtgatgtggccatacattcctgcaatatcattaccctctcctagagtcagtggatgtgtgcttgcccctagccccatggacctcaacatgccctgtacccagaatagtctcaaggttgatgcctactagcagactactagtagtattaaccatatgaagcgtgtgactttgtggcattgtgtgtgtgccccacaccagatgactacacaagatatagcacgatctacctcttgtgcgaagctgtgatagtgtccagctcaagactcgcacatattatcacatagcttgctttaattagtgcaacacaatgtggccagcgtgttgacgccaagttcatatccagcatcaactagacacaaatgcatgttgcgctacaaggcattctatccaagaagacagatgacaacagaggacaacgcctggagacccgccctatgaaacccgacataaggggccagaatgggtggcccttatggacgggttcagcagccccggacctgtggccccaagtgtacgccggaggaggagatg

SEQ ID NO: 663456 - DNA, 896 bp, Homo sapiens
aaagtgccgagattgcagcctctgcctggccaccaccccgtctgggaaggtgagcagtgtctctgcctggccgcccatcgtctgggaagtgaggagcccctctgcctggctgcctagtctggagaagtgaggagtcgtctacagcccgtcgccgcatcgcccatctaggaagatgaggagcgcctcttcctgagcgcatcacatctaggaagtgaggagcgtctctgcccatgccgcccatcgatctgagatgtaggggagcgcctctgccgcgggcaccccatctgggatgtgaggagcagcctctgcccggctgggaccccgtctgggagggtgaggagcgtcgtctgaccggcgtcccgtcgtaagatgtgcggagaccactctgcctggaaaccatacctcgttctgatgaaatgtgaggacgcccactcacgtcgccggacaaggttgcaccgttctgagaagctgagggaagactctcacgacctgtgtgagcaagcctccatcttggtcactgtgcactgacgcgtctactactcgtcacgatgaccctttcctggatatcgcagggagggagaggaattaacatgtagaagcgttgattcatggacttatccgaggcacgtgtcactttagcatgacaaagtactgtagtgagatgagtgggagcgggctgcgaacatagaacctgttcttcttggtggacgaggagcccaacggttattagattcggttagcacgaggtgtgataattatttgtttcaaaagaacgtgggagaccccaagaagatggcggggcgggaaagttatataaaggtttatttgtccatccgcgcgcgcgttttcttcgacaaggtttggcaacaggagagagaagagagtaagagatgcga

SEQ ID NO: 663457 - DNA, 367 bp, Homo sapiens
gcatttttatttcctattaaatctcttggtcttctattatctctatctggtacagcttggtcaccatttttttttattttactcactggaatgtagttccagaaatgaaaacacaaaacctcaaaacggttaactggaccttataatttcctttctctttcttgctttcttgcttttcctttcttgcacacaggtaagacctataacaacaaatggacaattacaaccaagttaaatcgaaccgggaggggaggtagctgaaatcggtctcaaagaataatgtcagcaaatagtatgtaagcatgggccaggaggggaataagaccaagagaaccgtctaggcggggactagaggtgcggaggggta

SEQ ID NO: 663458 - DNA, 492 bp, Homo sapiens
  misc_feature (53)..(53): n is a, c, g, or t
  misc_feature (75)..(75): n is a, c, g, or t
  misc_feature (189)..(189): n is a, c, g, or t
  misc_feature (220)..(220): n is a, c, g, or t
  misc_feature (326)..(326): n is a, c, g, or t
  misc_feature (462)..(463): n is a, c, g, or t
  misc_feature (469)..(469): n is a, c, g, or t
ccctaatcgcgggttgcgatgtatacacccgggattataaaacgccggccaangcgtcagaacgggcgcggcttnttgtgacaggtacgggtgtagcaggtgctactgttgtgttgatgcagtcgtacaaacctgaaaatattttagccactactaccgtcgatggttatgggcgatgggccacgcagnttgataatccgctgccgataagcccaccagnctttaccatgactggatatcagtcgtatttaggggaaaagatccggttggttggccaatagaactatccaggttgtcgatgctcccgatctggcgattatcgaaanccctgcacaaggtgtgaaaacaggacgtcggccagttgtgtcaggtagtggtattgcgggcgcgaccgtcgtgttgctcaaatcgggtgacccgtataacgccttgtggaccaccactgtcgatggctatggacgnntggtcngtgcaggggggaccgagctcgaa

SEQ ID NO: 663459 - DNA, 190 bp, Homo sapiens
ttaaagagtgatttgatgagctgctaatttgagagattttatcaagagcacctgatttgctaggcgcacagcacaagaggtggaaacatacaggagaagcaaggaattacagttagaggtcacaacttgcccgaagccagttctaaatttttatgaagcaatttcctcgcaaatgtcatgagttgttatt

SEQ ID NO: 663460 - DNA, 306 bp, Homo sapiens
agaccagacctagttgcagcattctagctctgccatctctcgaaagaactcagcttggttacttaacctctctcaggcgtggcatctccttatctgtcacactcaggaaactaaacctatcaagatagctgtggattaaagataatttattaccaggtatctggcaaagaaatttgataaaatgttagtgttcttgtcccttctcctcctcacaggtcaattaagaacgaaaactaaacaaaaacgagacataagcatctgggcacagaggcagaaaaactttgtaatctcatagttatacaactg

SEQ ID NO: 663461 - DNA, 469 bp, Homo sapiens
  misc_feature (211)..(211): n is a, c, g, or t
  misc_feature (298)..(298): n is a, c, g, or t
aattcttgaagtcatctgcaccgtctgcctgggaaaagatggtcaacgtgctgaaaggggtgcttatagaatgtgaccctgccatgaagcagttcttgctgtacttggatgaggccaacgccttggggaagaagttcatcattcaggacattgatgacacgcacgtcttcgtcattgcccgagctggtcaacgtcctccaggagcgagtanggggaactgatggaccagaatgccttttctcttacccaagaagtgaagaagcgctggtgttgagcactttgggaatcccagccacangacactttgagagaggccagctcagtgtctcgtggggtttatacttgttatgagcatgtcgtgggaaaggctgcagggtcattcattcagatgaaagcccctaactgatttggttggaccattaaaaaaaaaatatgtgtacagaagaactttagctgcaatttggctttt

SEQ ID NO: 663462 - DNA, 1642 bp, Homo sapiens
  misc_feature (420)..(420): n is a, c, g, or t
  misc_feature (547)..(547): n is a, c, g, or t
  misc_feature (549)..(549): n is a, c, g, or t
  misc_feature (601)..(601): n is a, c, g, or t
ccgtcgcgcctgggtcgcgttgggtcgcatttgggttccggcgggctgcgccggcctgcgcttccggccatgccacctggcggcaccttatcccacacgcgggcggctcatgctcggcctggtgggcgagatcatcacagcgcttcgagccgaaggagttcccgcctcgtggccctggaggtcctccggcgcttctggagacccctggagcagcactaccttgacctggatagaccgggcccttgttgcctgggctggtggagtacatgaactcagggcccgttgtggccactggtctgggaggggctggacgtggtgaagagcacggccgagtgatgcttggggagacccatcccgcagagttcgcaagcccggcacccattcgtggggacttctgcattcaggttggcaaggacactnacttcatggcagtgattcagtaaaaagtgctgaaaaagaaatcagcctatggtttaagcctgaagaactggttgactacaagtcttgtgctcatgactgggtctatgaataagaggtggacacaacngncagtctccttcagcacggcgtggtgtgtccctggacacagctcttcattccnttgacttagaggcaacaggattgatcattcttttatagagcatatttgccaataaagcttttggaagccggaaaaaaaaaaagaaaaaaaaaaaaaaaaaaaaaaaaaaaaaggggggggggggaaaagagatattctcccggggggggccccaagtagcggcggaacaccggggtttatgtggggacaagaggggggccaccaataaaggagggcccgattatataaacgccgaagaggcgcggggcgcggcggaataaacaaagggggggcgacggggggaaacagggggagaacgtggggagacactgtggggagaagaggacacctctataatcttctgcgggaggcgggaggaacacaatatagtgggcaacaaattttcccctacaaagaggatttttaagagacccctcacaggaggacaataattttcaaccatttctataaagggggtataaaaccgggctataacaccacaaacacgcggacaaaataagccatcggcgccacaggcaccaaacactagcgcaaccacgcacggacaaagcgcaattcggggcacccaattttaacacccgggcgcaacagatacaccaccaacaaggacgcaagacagacacacgcaacacaacacaccagaagaagcgccggagggagagagagagcagagaaaaaaaaagaacggaaggacacagcgacaagaaaagagagaacacacaaaaggaacgcagcaaacaacaaagaaaaaaaagaaaacacacaaaaaaaaaggagagaagacaggaaagaatccagaaagaaaaaacaggaaaaagaggaaaggacagaggaagaaagaaaaagaaaaaaagaagaaaaaaaaaaacaaaaaaaagaaagcagagaagagagaggacaaaaggaaaagaaaacaacgaaaagaagaaaagaaagcgaaaggagaaagagaaaaggaacaagaacacgcagagcaaaacagcgaagcacgaacacaccaaccgcaagcgacaacaacagaggaggaccaaaccaacggac

SEQ ID NO: 663463 - DNA, 1688 bp, Homo sapiens
  misc_feature (420)..(420): n is a, c, g, or t
  misc_feature (547)..(547): n is a, c, g, or t
  misc_feature (549)..(549): n is a, c, g, or t
  misc_feature (647)..(647): n is a, c, g, or t
ccgtcgcgcctgggtcgcgttgggtcgcatttgggttccggcgggctgcgccggcctgcgcttccggccatgccacctggcggcaccttatcccacacgcgggcggctcatgctcggcctggtgggcgagatcatcacagcgcttcgagccgaaggagttcccgcctcgtggccctggaggtcctccggcgcttctggagacccctggagcagcactaccttgacctggatagaccgggcccttgttgcctgggctggtggagtacatgaactcagggcccgttgtggccactggtctgggaggggctggacgtggtgaagagcacggccgagtgatgcttggggagacccatcccgcagagttcgcaagcccggcacccattcgtggggacttctgcattcaggttggcaaggacactnacttcatggcagtgattcagtaaaaagtgctgaaaaagaaatcagcctatggtttaagcctgaagaactggttgactacaagtcttgtgctcatgactgggtctatgaataagaggtggacacaacngncagcagtctccttcagcacggcgtggtgtgtccctggacacagcagcagtctccttcagcacggcgtggtgtgtccctggacacagctcttcattccnttgacttagaggcaacaggattgatcattcttttatagagcatatttgccaataaagcttttggaagccggaaaaaaaaaaagaaaaaaaaaaaaaaaaaaaaaaaaaaaaaggggggggggggaaaagagatattctcccggggggggccccaagtagcggcggaacaccggggtttatgtggggacaagaggggggccaccaataaaggagggcccgattatataaacgccgaagaggcgcggggcgcggcggaataaacaaagggggggcgacggggggaaacagggggagaacgtggggagacactgtggggagaagaggacacctctataatcttctgcgggaggcgggaggaacacaatatagtgggcaacaaattttcccctacaaagaggatttttaagagacccctcacaggaggacaataattttcaaccatttctataaagggggtataaaaccgggctataacaccacaaacacgcggacaaaataagccatcggcgccacaggcaccaaacactagcgcaaccacgcacggacaaagcgcaattcggggcacccaattttaacacccgggcgcaacagatacaccaccaacaaggacgcaagacagacacacgcaacacaacacaccagaagaagcgccggagggagagagagagcagagaaaaaaaaagaacggaaggacacagcgacaagaaaagagagaacacacaaaaggaacgcagcaaacaacaaagaaaaaaaagaaaacacacaaaaaaaaaggagagaagacaggaaagaatccagaaagaaaaaacaggaaaaagaggaaaggacagaggaagaaagaaaaagaaaaaaagaagaaaaaaaaaaacaaaaaaaagaaagcagagaagagagaggacaaaaggaaaagaaaacaacgaaaagaagaaaagaaagcgaaaggagaaagagaaaaggaacaagaacacgcagagcaaaacagcgaagcacgaacacaccaaccgcaagcgacaacaacagaggaggaccaaaccaacggac

SEQ ID NO: 663464 - DNA, 291 bp, Homo sapiens
tctagaggatccggccgagtgcatggtgggcgcgggggctcatgctgtaatcccagcactttgggaggcgaggcgggtggatcactgaggtcaggagttcgaaaccagctgggcaacatggtgaaaccctgtctctactaaaattacaaaaattagccgggcatggtggcaggtgcctgtaatcccagctacttgggaggctgaggcaggagaatcgcttgagcccggaaggcaaatggtacactgatctgagatcgagccattgcactccggccagccattgcactccgg

SEQ ID NO: 663465 - DNA, 903 bp, Homo sapiens
gactgtgggtcttaacggtgtcccgaagcgcgttttggaccccacatctccgaactctgcgggcactgtgcgcctgtgccgccttcccgtggggaggcccagtgactgcgttattacttgcacaagggttatgtgtagaacgcaaggaccataggcgtggattaagagaatgtagtcgaacgtctgttctgaaattcgggctcagacccgtttaaacacggtaagtgcttagcaccaagacctgtagttggaacactctgggggcgggcaactaagttggccggacataatgtggccttctagagcctatttctagatccatgttctcaacggaaccacctcgtgctttgtagccttaccttgaatcctggcctacttaattaagttggggccaccaccacacgtgaaggcttgctgaacccgcgtccctgaaagatttcactgtgtggaatgatccgtctgtaggtgaagctggaattgtcgttgtaaggctacccccagaatcactgatgttctccacatgaggttaagccgcggtaaactgcccgcgcaaatgaaaatggttctaatgtgaacttgaaccccaacacggggattcgtattatgcttacaagtggcccgacatgagctcatcgtggatcatgcaaatgagtcccttcaatcccccggaattgaggttttatagtcatggtcacctcttacttatgtttatatcactgtaagcgtaacctttggtcggaaagttaaacattcatagagaaactgagtctacggtgtaattccgagtctaataaaaggagtaaatcttaatccaatcgccgggagttgccttttggaacttaataattaatttttcttccgaagagattccttgttaaacaaaccaaaaaaacaaatttgtaa

SEQ ID NO: 663466 - DNA, 135 bp, Homo sapiens
agccaggaaaggctcccctgctggccctctggagtccaggagcccttaggaaggcgtgaaagccagtccctgaccagcaggcgttagttgtccctgagaagagcgcagtgaggcgcacctggtccagttcaccct

SEQ ID NO: 663467 - DNA, 344 bp, Homo sapiens
  misc_feature (52)..(52): n is a, c, g, or t
  misc_feature (59)..(59): n is a, c, g, or t
  misc_feature (91)..(91): n is a, c, g, or t
  misc_feature (333)..(333): n is a, c, g, or t
  misc_feature (339)..(339): n is a, c, g, or t
  misc_feature (343)..(343): n is a, c, g, or t
gtcaaaatactttttaagtcctgagtgccttacaggtagttgttaaaaaaantttaagncccaggcatggtggctcgctcacacctataancctaggatcttgggaggtcgaggcaagctgatcgcttgagcccaggagtttaaggccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagnccctancaant

SEQ ID NO: 663468 - DNA, 520 bp, Homo sapiens
  misc_feature (321)..(321): n is a, c, g, or t
  misc_feature (353)..(353): n is a, c, g, or t
  misc_feature (358)..(358): n is a, c, g, or t
cggcaacttcggctcagcgagcgcgggcggacagacagggccagggggcgagtggcgtcaatgtccgaccagttgccagctggtaccagtcctcgcctcggtcccgtcgctgtggccgccctgggcaagaagcacatgacgcacaaggccgcgtggcgctcggcctacgaggtatatgaccacacgcccttgcagaagcctctaaagctagtgctgaaggtcgtaggaagtgaagtgacttaactcataagattcggacaagactccaggtactatgatgacagatcagaccatgagcgagagaggcacgacgtacttcgncggatgaagaagcgctaccccacgacgttcgntatgngggccttgggggttttttttttttttatgttcatgacaggaggttattaagggtctttagagagcaatatctatactcttgatgtacattgcaaggagaccctgtttgatttgggacctgatgaccatgtgggaggtttttgttccaaccctttggttgggg

SEQ ID NO: 663469 - DNA, 254 bp, Homo sapiens
  misc_feature (15)..(15): n is a, c, g, or t
cttgtctccaccggnacacagggagggctggttggacttcccctcagaatagggcatgcgctgttgtgggaagtcagggaccccaaacggagggaccagctgaagccatggcagaagaacgtggattgtgaagatttcatggacatttattagttccccaaattaatacatttataatttcttatgcctgtctttactgcagtctctaaatataaattgtaaagattaaatggacacttatcacttccccagtc

SEQ ID NO: 663470 - DNA, 214 bp, Homo sapiens
tgaatgcaaggctcctgactggaacggactcctaagctgaactcacattaagttagcatgagctaaggcgagaagtggggacacagagtacgcgtgttccgtgacccagcaagcacggtattgctgctggacatgaaatacaacgtggagattaggtccagtttaaactggtttaagtagcaccagtgctgaccaggagaacatttataccggg

SEQ ID NO: 663471 - DNA, 706 bp, Homo sapiens
gcccaggactttccccagggattccgagtctggggattgcaccccgcccccagtaccccgtggtccaccccccggactgaaggagatacgtactctctcgccgtcggcccgttatgcccagaatcatatggtggaacccccgtacccctcccccacgttaatgctcgagagggattttcccccaggccgggccctgcacgcaacctgcagcaccgccccttggagggccccggtgtctctccccccgcccccctgccgctagggactgggagatattgtccactctgctggttgtgttatcacctccccccccctatcccccgcccgtcttccggatttttccactaaatttcacttattgggcacggaaggaggtcactgggttcactttcaacattttgttttttgtgtttttaaattaaaagaaaggtgtacccccgtgtttcacctcccctagaccactggatgtagctacccttttttgtatgtctttttttttttaagctactcgtgttgaattaggagtatacttggtgtggaaagagtatgaatttgcccagtgatttgccaatggggggaagctactgtgagcgtgtgtttttttaatttaccctatagagtgatttttttttccccccacgtccagtttttaccttgcaagtactggagtatttatttcatctattaaatgttatgtttctccaga

SEQ ID NO: 663472 - DNA, 194 bp, Homo sapiens
aaagcgaagaaggaagctcctgcccctcctaaagcttgaggccaaagcgaaggcttttaaaggaccaagaaggcagtgttgaaggtgtccacagccacacaagaagaagcatccgacgtcgaccaccttccgcgccgagacatcgactccgcgacagcccaatatctcggaggcgtccagagaacagctgacca

SEQ ID NO: 663473 - DNA, 999 bp, Homo sapiens
ggcctcctcccacaaagactgatggctccgtgactctggacaatggcatcatccgagtgaagctggacccaactggtcgcctgacgtccttggtcctggatggcctctggcagggaggccattgctgagggcgccgtggggaaccagtttgtgctatttgatgatgtccccttgtactgggatgcatgggacgtcatggactaccacctggagacacggaagcctgtgctgggccaggcagggacccctggcagtggggcaccgagggcgggccttgccgtgggcagggcatgggtcctggctacagatcagcccacaacagatcggctatagcacaagagaggattgtgcgtgagacgtagggtgaccccatatgtcccgattccacaaccgaggtacactggcatgaggaccacaagttcctgaaggtggagttccctgcatcgcgtgcggagttcccagggccacctatgagatccagtttgggcacctgcagcgacctacccactacaatacctcttgggaactgggctcgatttgaggtgtgggaccatcgctggatggatctgtcagaacacggctttgggctggcacctgctcaacgactgccaagtatggagcgtcagtgcgaggacagatcctcagaactctcgactcttgccgggcagcctaaaagccccggacgctactgctgacacggggcgccacgagtacacctatgcactgatgccgaacaagggctcttgacaggatgctggcgttatccaagctgctacagcataaattcccctgttggatctgacaggcccagacccagaggccagcaaactcatggagggcaataaaccgagggactacaaccagaggacgaaatggagaccggcaagaaaggcgggagcagaccccaggacaggacgaggaccggagctgatgagagccccggagacagtgaacagggtgacatgagggcggtacagagcaactgggaccagggaaaaa

SEQ ID NO: 663474 - DNA, 347 bp, Homo sapiens
cccccccccccccccccaggggggtttttttggggttttgggggggggggaaaaaaaaaaattcccccccccttggggccccaaaattttttaccccaaattgggggtttttttttttcccccccccccttttttgtttttggggtttccccctttttgtttggggggggggaaaatttggccccctggggggggccccgttttttttaaattttgggccccgttttttgggaatttaaaaaaattttttttttttttttttgggggggggggggtttttccccctggggggttttgggggaccaaaaaaaaattttttggggaaaaaaccccccctgtgggtttta

SEQ ID NO: 663475 - DNA, 391 bp, Homo sapiens
gataaggtagcgaggctggtcgccgctgctgctaggagtctcagcagatcctccagacagccagaagcccctgtctaaccgccgagagcctgctcagcctcgaacagagcctgcaggctcccctcagtgcttagccccaccccatggttcgtccgaccccccagtcctgagctgctcactgggagggggtcagggaaacggggcggaggggaggagggggagttaggggcattaatggtgatgcagtgcagccgggtgcgaaagcctggcagctggcgggagcctggcgactggccctcaatatgggggacagtggtggcttaatggacgaaatggaaagtgtccaagagaaccgacattggagatactggggagctggctgaagggggtg

SEQ ID NO: 663476 - DNA, 144 bp, Homo sapiens
gcagagatgagcgtatagtatatagagaggagagagagagaactatagagagagggcaaactatgtatatagaataagagtgtggtatagtaggtgtaagatacatatatagtagtatgtcgtttgtggtggagcgtgggcaag

SEQ ID NO: 663477 - DNA, 151 bp, Homo sapiens
gccggctgacggattggctcactcccaagcgtggacttagataaccttggaaggacgccagcactgtggtggcagctgaggaaaggacgatctgctttatttctgtgatctaccatctactagtctcctgatcctgtcaaaagaaaggaaa

SEQ ID NO: 663478 - DNA, 1722 bp, Homo sapiens
  misc_feature (1261)..(1261): n is a, c, g, or t
  misc_feature (1383)..(1383): n is a, c, g, or t
tgcaagagttctacgtcctaggcgctgataagtgagattcaacagtacaagatgtgctgaattcgtcctagtactcctctaagcacctgccctagcttgtccatgtgggagtccgtggtcaatattttggacgttactttcactcacgtaatgaagttaactatgattatcagctgcttcaggtcacagaggctttgttcaggattagactcagtgagaagaactagaagttgagagcttccatataagtagaaaacatagtatgtaccccatcgtaatgagtttagccagatattgagacactgtggtagttgatcccaaggactctaatcacggaaggacaaagatacgggtgccgttcatgcttatgctacacctcgttacagtacacacgtaagggggagatacgtggaaaacttttgtccttggtagtggtgactttctaatgcgctaagaaggacatgtgcatacttgacacatttcttcagatacgactcttggcatactgttcatgtaaggaaaaaccttatagtacctttctttgaaccttaggggaatagaacgcatttgacctttgccgagggggtgtggcacaccccaaaggtatcagatcaagaaagggactaccactatattaatgtagaatttttcaagggaccactttcctatttaacctcggcgtaaattccgtcttccattgtgtaaccttttttagttggagcgagctcaccacaaggacattttggcaaagtggtgttttgacaatccgcttggctaaaagaaacacacaataatataggcgcgcaatataacacgcgtctagacaagtggaacagcgccccccataccagttccaccaggcggtggataggaacacacgactttcgtttaggtctcgatgaagcagtgttccacaactggcgacttcttaaggaacgggcccactttgttgtagaggaggaactgtttcccaacgagacgccttggtaaaccgcatgcgacagtcgacgaacttcctttcgcgcaattgcggcaaagttggacacaagtttttgagaccttcatatcacagacggcagggggcacatagagctgtcggcacacaggatatggcggcaccacagttctatttgcgctcaaaagcggttgggccaaagcttacgaacccatcgggaacgacactttcacaaacggaacaggagccccatacggcgattggcacaggtgggcaacggcacaccccaaattttcgacgagcagngttttacgggacgaagtcaaacaattaatcagcatgcgcaccagatctctctagtggttgaggcaccattacagattgcggatgaggaggcgacggagctcgtagtatcacccacatctatntgagcccgacacaatgtgtacacatgcggcacagggaagatttaaacaagcccaccacagaggggagagggtacccgaaacacgtgcctaccagcgacgatgtaggccaacatggcggcccgatagaggactggcgacacacccacgacgagacgagacctcatgtgcgacaacattgcgcgaggcaaacaccgcccacaagacagcaacaagtgggcaggccagttgcggcactggggagaacaagaggaagcacagcaacaaaaacacagggcgaacacaacagagtattattagcgcacaaactgagcgagccccacaggggggagactaagccgg

SEQ ID NO: 663479 - DNA, 510 bp, Homo sapiens
tggtcaggcactgaagctgagggtcgcgcggcgcggtgtccctggaagaggcctactgcgcctcgccgagttcctctccgtccagctgggggcggaaaaaaactggggggggccggcggactgggccagtctggcgaagtccccttcacggttgacagttgacagtcagctcttgggcctttctggcatggcttcgaaagccccaggggggaggcaggcccttgctccagggggactcagccagccccctcggggtccgggcccccctctccagatggattcacattccaagaagaaaggccttcccacttcaccgcagtcccaggcgagccactgggggatgagacccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaa

SEQ ID NO: 663480 - DNA, 720 bp, Homo sapiens
  misc_feature (277)..(277): n is a, c, g, or t
  misc_feature (536)..(536): n is a, c, g, or t
agcggcttgcattagccggcgccgtacggatacgcacgctagtctgactttgtcttctccgacaacttggatcgtgttagcacgcaaggtctccagagccttctctctcctgtgcgccattggccactctttaaggggactaactcacttgtcagcctaagcttgtcgaaagaaaggaaggcacactaggttactcaagatcacatacaggaatcacctgatacgatgtgcgatgatctgggagcgaagctctcgcgttagttgagtgctgcttgcntattccagactgtgtccttggggacatatgatcgtcctggcgttgagtagaaacctttgcctccctattgtgggaatagttggtatagggtagatgcaatgagacggcgtgtaacatagcggaagcagatattcgtaatggagtagttcctgtcgattccactgggggatgacttaaatctatacttttcttagaacaaccgttgaacaaatatcgctgcgacaagcactacaaacgtactatgaatgtcctcgttcgnacctcggtcgccatagtgtgcgtaccttactgtggtgatgctcgagctgacagcctcgccaaggggtaggttgcgccgctaccacggacgacaagcacagggtgtgacgtaggtcttgtgccgtctatattcgcttggtggcgatgaagagagatggatcttagttcgatcattcgcaagatgt

SEQ ID NO: 663481 - DNA, 610 bp, Homo sapiens
  misc_feature (9)..(9): n is a, c, g, or t
  misc_feature (90)..(92): n is a, c, g, or t
  misc_feature (101)..(101): n is a, c, g, or t
  misc_feature (109)..(109): n is a, c, g, or t
  misc_feature (115)..(115): n is a, c, g, or t
  misc_feature (205)..(205): n is a, c, g, or t
  misc_feature (235)..(235): n is a, c, g, or t
  misc_feature (316)..(316): n is a, c, g, or t
  misc_feature (337)..(337): n is a, c, g, or t
  misc_feature (340)..(340): n is a, c, g, or t
  misc_feature (369)..(369): n is a, c, g, or t
  misc_feature (423)..(423): n is a, c, g, or t
  misc_feature (435)..(435): n is a, c, g, or t
  misc_feature (480)..(480): n is a, c, g, or t
  misc_feature (594)..(594): n is a, c, g, or t
gggtttgtnttttggtttctgaagtcctaaccctcaccaggcccaactgccacctacgccagccgcatggcccctacactgtgtctttgnnngaggcaggncagcaggnaggaanaaaagtgggggtgatgagaggttgttctgttcagccctccccactacccacaggcctgggcacgtgaaggaggtcagagttgggtgagcnggaaggcagggggggttccggacaggacanaccccagcttctctctgattactcgtgcatgggaagcagcgtcccagggaccccacgtgttctggcccagcccaagcttgntttggcggccgggtggctgcnatngcgtagttgctgttttggtttggccattncacatcttgttagagttgggcccacgatctgagggtttgtcttgagcctgagcnatatggcctgtnggtacaggcttcctcactgtacatccagctcagctgaatgtgtantagggtgtggtggtcttgttatagtccaacatgatgtcgaggacagtccagggggccccgcccacagacagggcagtgcgggaagccacacggtactccacagtgttcaggccnccctccctgtccacct

SEQ ID NO: 663482 - DNA, 546 bp, Homo sapiens
tgccctcgaactctcgcttgtcgggaaactgatctccactccttcggttgaggacaagtctgaagagccaccaggcacagagctccagaggaacacaagaggcatcccaccttgctctcaatcacaccaccttccctaagatccacagactgcgattcaggtataactgcagccagatgcttagtaaagaagtggatgcttgtgtcaccgacatttctcttctaagagaagtagtacaaccagctgcagtgtaatcaaacggttgcaaatagtggtgcaaattaacccaaatgaatctgtaactgctacatgccgctaccacttctccttcatgtacaagagagttatcttggacaccaaatgggttaatgttgttcagacagacatttatctacagaaactgtcagccgcccctaaaaaatgttccttctataataaacttaaagaccattgcttcatcagcagatcctaaaaatgttagtataccatcttctgaagctttatcttcggatccttcctacaacaaagaacaacacattattcatc

SEQ ID NO: 663483 - DNA, 796 bp, Homo sapiens
  misc_feature (340)..(340): n is a, c, g, or t
  misc_feature (361)..(361): n is a, c, g, or t
  misc_feature (371)..(371): n is a, c, g, or t
  misc_feature (406)..(406): n is a, c, g, or t
  misc_feature (411)..(412): n is a, c, g, or t
  misc_feature (444)..(444): n is a, c, g, or t
  misc_feature (454)..(454): n is a, c, g, or t
  misc_feature (474)..(474): n is a, c, g, or t
  misc_feature (478)..(478): n is a, c, g, or t
  misc_feature (497)..(497): n is a, c, g, or t
  misc_feature (514)..(514): n is a, c, g, or t
  misc_feature (528)..(528): n is a, c, g, or t
  misc_feature (534)..(534): n is a, c, g, or t
  misc_feature (541)..(541): n is a, c, g, or t
  misc_feature (561)..(561): n is a, c, g, or t
  misc_feature (567)..(567): n is a, c, g, or t
taattttatgcgtcaggagtgtttggattccaaatttctattcaggggaggggggctgtgtctcttcttgtatctctaattggaagcagtatcctttttatgttagcatttatggatatgaaatttgaagggttttgatacttgtgttaattattatgaatataataataatatgacataggatatgggccctcacattttgggggggtgtccatctgctaactattttgactgcaaagccatgtccattggagcccgttcccaatcagctcgtacttacttggagagacatatgtctgaatttatggagtgtaattaaaatgaactagttaaacatggnctgcgtgccttaagagagacncttactgcanaacaggacctgactacaaagaatgtttccattggnattgnnggtaaagacttagagtttacaatctatgatgntgatgatgtntctccattcctggaaggtcntganaaagacacagagaaaggcncagcctgctcaacctgntgatgaacctgcanaaaggntgatgancagtggacattaagtgatangccagnctatatatgtattatcaaatatgttagaatacatgggccacatactgatgacaataatctatactttgaaccaaaaggggcagagtgggggaatgctatgttttaagagtgcggccaaatgggaggtttttccaagacacctctctggaacctatataatggatacctttttgtttgagaggggtgtgtttaatattttctaaaggttatgggtgtctatactatggcg

SEQ ID NO: 663484 - DNA, 282 bp, Homo sapiens
tattgatcacttagcacagaaagctacgactaatatcactggggtttggctgcagttttatcatcctggccaacgaatatatgtccgagttgcttcccgagttttcatggttctcgagaaacttggtgacaatcagatgtcactgataatagtttggatatgtggagttcgggttgtatgctggcaagatatgatctttcggaaggagccattttaccatggacatgacaattatgatcagttggtgaggatagccaaggttctggggacagaacatttata

SEQ ID NO: 663485 - DNA, 431 bp, Homo sapiens
atctcgaggatctcgtattctaacattataagttatatgcagtgtcagcattttttttcacagcactagagaccctgtcaataggggatatgagtcagaatggcttattcacagatggggtccagattcagtggttggaacacagacaccacagtgagctcctttgcaaagtggcaaacataattttgcttactgccttcaaaaacatatatccatcgcgtttaggcttcatgatactgctcctgcaaaaatgcaagtcgaaagggactgcagggactctcgctgggggccctgtgagcatcgagcagggctctaacccatggcggtgaccatgctggaggggtgctgtggtccaaaggacaggctgaatggcgagtgcatcggcgtgagcgtggacagcatgtggctaccgttagagataccgggtaccg

SEQ ID NO: 663486 - DNA, 131 bp, Homo sapiens
attacttctaccttaggtttaggagtaatatacccggaaatctaagctcatggaaacatgtcttccatttttgcttggagccccttcttctagttgtacacacttcttcatccatatatgtgcgcatctcc

SEQ ID NO: 663487 - DNA, 672 bp, Homo sapiens
  misc_feature (116)..(116): n is a, c, g, or t
ctccctccctgttctttgcctctctatagagggacggacattggtatcttatttatctaccatctaaccattcctcacccctaagtgacctcgaaacaccacggaaatgaaaagtngttctcccaaataaatggaagcctcaagggttcaaatagttaaagctttttcctttgatactgaaaatctcagctagctctgttagattcttaagcagataacaaggaaaatttattttctaaaattaatcttctagcttccaaaggaaaattgcctattaaatggatggctccagagtcaatcaattttcgacgttttacctcagctagtgacgtatggatgtttggtgagtactcttaaaagttttgtattctttaaaaattatatttcatatgttatacaaaacaccattatctctttttggaatatgtaggttgatttgccttccctaacctgatcatctcctcatcagacttcttttgattcatttgacagtaaatagcctgacatctactgtgcatcagcttctgggcacagcttctgtaagggtccacagttctaattgcccagctccttccatcactcttcctttttgttcccctttgctgtctcttctttcctcacagggggatattttgcttattttttaaaaattgactacatccttttcttgaa

SEQ ID NO: 663488 - DNA, 606 bp, Homo sapiens
gatttctttacggaatactggtttgcagttttgatgtctggactatatcagcagatggtagacagtgcttatgttgatgtgttgttgctatcatcattgactgcataacttgacccgagagctgtaactatatcatggtcattctcactcttgcacatgacgggtaccgcttgacagttgcctacatcccattaccacaagcgattctggccttctatggcttccaacactgcgctactactagcacccactgttcgggctccgacaccattcctgctacatatacctgaaacgtctataccgatgggcagcctttgatactgttatagacttatctgttattacaagtactctaagcgtgaacgtttcaaatgatatctattaagaggtatacgaagagatgacttactcagacgcatctgctcctaatggctatgaaactgcaattatttgttccacttgtcatacctaccctccttcgtgaatcccccccatatcatcatcccattataacggttccattttttacaatgacgtcttctctatctgttagtggacaattacgcctgctcccgccccaccgcctttccctgtgtcctttgtgcg

SEQ ID NO: 663489 - DNA, 220 bp, Homo sapiens
  misc_feature (42)..(42): n is a, c, g, or t
tcgaaagcagaaactaaagtcttccaattctgtttaatccangtttttattagaatttgatcagaactgagtaatagctgactagtactgtggtaactgtctgaattaataaaagacggtaactgaggttctggaagaataagactgaacacataatattcagtttttacatatcatttaattacgaaattccaatttcaatgctgacttttcgtcgacg

SEQ ID NO: 663490 - DNA, 1357 bp, Homo sapiens
gttaaagatctagtgtaattaaggtggaaaacatatatgctaagacaaaagaaacatgattttacttccttaaacttgaagcaccaaaaaaacacacacacacatcacacgtgggtgatagctggggacatgtcgcagcatgtccaagtcaacacaggagcaatttcatagagcatcagtcaatcgaaatacatgcatcatccttctttcataaacattccaagcagttgcaaggtttgttttccacgatacgagatcatattagtcctcatttttcaaaacacaacaataagaaaaataggaaccaacccagaacacaacaaaaacaaagacaacaagaaactgcgcggcgaggcgctgccgcaatcaacaagcaccgccaccgcacctgggggaagctggccccgccaacggtacagctccgcgcgcgtactcggcacaactggaaacagccaagtcgaaacacaccagtgtgcgactccacaaacagatagacaaacaggcacgtcgaccgctgaataacaaagggccacaccaaagagagacagcccagagaagcactaagaacagctacaccaagcgagacacgccacaccacacaaggtggcacatacacacacaaaccaccagaaacgtggagacgatagacaccaccctccggagtttgcgaaagatccagaaaacccaaacaccaacaattagacaacggtatcacaccctagtaccaccaaaactgggcacgacagaaccccaagagcgcacatcacacactaaaacaaacaacacaaaagacaagagaaatgcaaaacaagcaagaacacaaaccaaaagcacgaaagaagacaaagacaaagacatacaaataccagggagcaccaacaccgccagccgaggcgagacacgaaccgaggagacaagagaacagacaagaataaaaaatattgagacaacacgaaaaacaacccaaaacacagagcaaccaccccggccaccacgactcaacacacccgtccgccgcagcctatagacaacggacgagagacaatcgccacaggaacagcgcagacacccacacaaaccgagagcaaaacagcaggcggcgaccaacaacaaaagagggggaacgaaaaacaaagcgagcgactaccaacacacacgcaaccctacgcccacgcgtaacaggcagagagcacacacgacaacacaagcacgaaaagcagccagccccctacccacgcgcacccccacacagagcaaaaacacaagaccgagaacgccaggctaagcgcaacccaggacagccacgggaacaaacacggagagacacgaacaacgaagcaccaccagaccgcacaac

SEQ ID NO: 663491 - DNA, 1130 bp, Homo sapiens
agcggagtgggcgtgagcgccggtgccgctggagcggtggacagctgcacaggagcaggtgcctggggcccggggatctggcccatggatactttggttagtgaccacatcgcagcgatgtagagtcaagtataccgctggtgggttccaggcccttacaagcaacaatctatctgccctgggtcaagtgtacagacgtaatatcagatacgtcattgtataccagccttacagatcgatacgagacatgtacgtaactatggagcaacatacccgtttatcactgtacccctcagtacgatacagcatggacaagtccttacgacccagccgagagtgagcgtgaagcatgcgcacagagaagtcgatggttgaaagctacgggcagatgccgagtggctgagccgcgaggtggatgacacttgtgtgccttgggcccctggaggaccgcacatgggcaagtcatacttagggtaggaagacacggtagtcaagagtggctagcaagaaaaatcagggggccaagcagaagaatggagagcctaggggtagaaccgagagtggaggacggggaccacaaaagggacgaaagaagaccgacattggcggccagtgcagaactacccattacagaccgtacaggagccggtggcgttggaaagagacaccgagcgacaaccgagggggccaagaaaagccaagagtggaaaagcgagaacggcgaaccaacagcccacgaggcaagaaagaggagacaacgggaaggcacatgggcagtgacatcgaccgcgacaggcgcaggagggggcaaggaaagggacaatggaaaagtgaaagggacgagatggtagagaggcgccagaggagaaagaaaaaatgaggagagcgggccgcaagcagaagacagggcgaggcaagcgcacagaaatggggagagaggcacgggagaggaaagacgaggaacagagcgaaggggagacgagcaacaagaggggaacacacgtgaagaggcggagcagacgcgcgtgtagaacagggggagacaagtagggggccgcggcaagaggaaggagcaaaacaacaagagaaggggtggggagaggcgcgccagggacggaagacgcaacaga

SEQ ID NO: 663492 - DNA, 423 bp, Homo sapiens
  misc_feature (423)..(423): n is a, c, g, or t
gtacaacgaagcttagaggatcctgcatgagactgctatcatggcagacaagcccaaactccactactgcaatgcacggtgcagaatggagtacacccgatggatcctggctgcacctgcagtcgagtttgaagagagatcaatgacatcttgccaagacttggacaggtctcagaacggatgcatatttgacgttccagcatgtgtcaagagctgagattgaaggcatgaatctggtgcaagccagagccactctgaactacagtgccagcaaatacagcctctatgggaaagacataacggagagagccatgatcgatatgtatatagaaggtctagcaaacttgggggaaatgatcctacttgtgcccgtatgtacacctgaggacaaagatgccgctcgccttgatcagagagctcctn

SEQ ID NO: 663493 - DNA, 516 bp, Homo sapiens
gtaaaggtccaagattctaaactgccgccatataaggatctcggtaaaaatctcccattccctacatattttcctgatggagatgacggggaactgccagaagatttgtatgatgaaaacgtgtgtcagcccggtgcgccttctaatacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaattatcattcatacccccattaaattttgttagaaaaattaccacattaaatatatgagttaagtagattggattagctgaaaatggtgatgagcatattagcaaaatattcttaaataatggactcgattcttataaaaatacatatttcacaagtaatataaaaatgtctgaaaattataaatataattaaagtattgtcaatatataagaaaaaaaaaa

SEQ ID NO: 663494 - DNA, 1378 bp, Homo sapiens
  misc_feature (291)..(291): n is a, c, g, or t
  misc_feature (302)..(302): n is a, c, g, or t
  misc_feature (304)..(304): n is a, c, g, or t
  misc_feature (332)..(332): n is a, c, g, or t
  misc_feature (378)..(378): n is a, c, g, or t
  misc_feature (380)..(380): n is a, c, g, or t
  misc_feature (414)..(414): n is a, c, g, or t
  misc_feature (510)..(510): n is a, c, g, or t
  misc_feature (587)..(587): n is a, c, g, or t
  misc_feature (665)..(665): n is a, c, g, or t
  misc_feature (1226)..(1226): n is a, c, g, or t
tcagttcaaactcatttcccttttattaaagtccaagttcaccattacatgggctgggtacctcaataaagggaaaacttgttcaaataagggtaatatgttactcatcagtattctccagggtaactggttcacactcaatgtagcaatgtcaataaactccttggggaaagcccactccagtggcggtttatacactttgtgtctcaaggcccagttctccctcgcggaagtgtggaaatttcccagttctcatttataaagttgtggctcataagttctccgtggaantgacattaagngnggtataagatttctccttatatgtgaanggtctccgtgcttgtgtgtctccttataaacaaccctctctatagngnatatatcagaaacgcgtggtatcttagcaccaanaatctcactttataaccgcgtgtctgtgtctatgtgtccccgaccaaaagccagcacatctcacatgtgcatctctgtgtgcgcgcctctctgtgngaaacccaatatatctcatatagcggttaacacacaggtgtggtgtcttataatctcccccttttatagcgcacaanatttctccccaagggcgcatctctatatatatctcgtggcccttgtgtgttagacacgtttattgtgttttaaccccnaaagccagagagctatttctaaaactctctctctcatatctgtgtctctccctgtgtgtgaacccccatgtgggggaaatatacgccagcgagaaactgtgagctgtgggaattatgcccaacggcgcggggggcgcccgggggggtctacccgggggcgggacagtgtgccacagggagaggccctcgagagcgggtctccggccccggtgtgtgggttttcgccggccccaagaggggccagtgcgtggcggaaaaaagacggggcgccccaagcaattgcaccgggacaaaatgaggcggagacagcacgaggggccttagtaggagcaccacgaagaaagaaaagcaccggggtttgtaaaaagcctccgccggggggttttagactcccccggggaagaccggtgcgtcggggtgggggggcccccgctgaagggggccactaaattggcgacagtttttaatgtagcgaaaggggtctcctttttagaaagaaacgcgcggcggggtctcttggacgagaatgaatacctacaccgcccggcggcacacacaagnggggggggggcccttcaccccagaaggaggcgtcatctactacccaaacggagggtggatatttattcacagcggcacacaacttttggtctgtgcgccgaacctcggttggtgtgcaccccataacacgggggggggagcagcacaaactg

SEQ ID NO: 663495 - DNA, 941 bp, Homo sapiens
  misc_feature (209)..(209): n is a, c, g, or t
catactcttcttctggagcgcagttacgaaacaataaacgccaccaagggctcaaccaaggtgcaactattagaaaaagtttctagcgcttctcacgtgctactagcgagagtaccagtgagaaaccagcactccctgtggtcgctattcgtacgtatccgctcattgtgatcccacggggcaccatcagattccagccaaagcatagnaatgacgtctggggtgttattcgatgcgaagcggtggttcaacgagatgcgtgatgtggggcttgagtccctaccttgcatctctgatggagtgcgtcacctcgttctcagcaccagcgtcgatgccctgttgttctagccgtagcccccaggatttctcgcagattcctcatgccgatttcccgtgtcctagatgtgcttgtgtgatgacttctggacctctcttgtcctgtggctctgcgttgctctcctcctctctctgctagagattttctccaagggtgcgccttgtgggcaagtcccttaccagctcctgcttgatagcttggtaggcgccttactttgtccacaatcgcaactggtggctctcccgctgaatggggcctcagcaggtgcccaagctgctacaaccttggccactctgtttgctccaccccagcactgggcatggtaattagcctttccccatgttaatttattcagttttttcaagggtcaactgaattccccacttcctgggtaagaagcatgatctccttttaatttcacgtctaagatcctggcagcttccccctagctggttcctctgttagtcctgctggtgactgtcagctcattttcaatgtgggtctgcagaagggctttaggtcttccccaacccccttacctttcacaggagggaacctttcatcagggatcactgattattgctggcctgtgggtctgcctcag

SEQ ID NO: 663496 - DNA, 544 bp, Homo sapiens
  misc_feature (370)..(370): n is a, c, g, or t
ggtgtttggggcccttgggtcaagtgggcctcttgctccaagccctgcggggtgggggtgcagcgcaggagccgaacatgtcagctccttacagtggagctccaccggagtttgcccctccctcccgggcccccaagacatccagaagccttcctcccccggggccagggtcccagaccccagatttctccagaaaccctccctttgtacaggacccagtttcggggaaggggtggcccctttcggggtcccgtttcccccttagggagagaggagccccaggagtttcgagcggccagggggtcccggtttcgagcccccatcaagccaggaatgttgggttatgggagagtgccctttgcattgccantgcacgggaaccgcgggccccctgggggcccccccagttttgagctgtccctgtttttttttaggggggaaggggtttttcggtcccctactccaagagcagagcctttttccgcaaagggcggcccccaaattgggctccctcccccagaactgtttttccccccccttccta

SEQ ID NO: 663497 - DNA, 890 bp, Homo sapiens
  misc_feature (890)..(890): n is a, c, g, or t
attctagaggccgaggcgggtggatcaactgtggtcaggagtttgagatcagccaggcaacctggtgaaaccccgtctctactaaaaatacaaaaattagctgggcgtgatggtgggcgcctgtaatcccagctacttgggaggctgaggcaggagaatcacttgaacccgggaggcggaggtgcagtgagccgagatcgcaccattgcactccagtctggcaacagagtgagattccgtctcaaaaaaaaaaggaaagggaaaaaaaaatagcattatacctcttcctggtctcaaaccgccatgaaaattctgaacactccaaattcagtggaataatccaaaaccaaaatttataatgtataaaatatttatcttcttataggtaataggtatactttaaaaaggcctcgacggtatattatcttctaaacaggttacaattcatgtgagggtacattaaccaattatggttctctagttgagaacaattaaggcctatttcatggtgtgtaggcctcagtgcttaacagtgtgtgcaaataaatatcggagaattaccctggattggtaaaaaccatgcgtctgtgttaacaatgcaaaattcaaagggcctgtatctatgtaattcttggacatcattatttaatggatctcaagtattggatggtggggggactagtacataagtctcattttaaaactcattatgattgtttaaccaaatcttcctttaaagtactttacaatctggttttccaaagttatttggctcgaaacgttaatttggttcgaatggtatttccaatttttaagattgcggttgcgggagaatggtaatggggggagtggctcgcaaatggtaccttgtgtttctgcaacatatttcn

SEQ ID NO: 663498 - DNA, 144 bp, Homo sapiens
gagacagagtcacagagcacatgctaggaaggactagtgaattgcatgtctagtgaaaagccatcttcaacagtctgaggggctgctatatcacatagaaatgcaggtagggggctgggtgcagtggctcatgcctgtaatccc

SEQ ID NO: 663499 - DNA, 119 bp, Homo sapiens
gctctgtgtgtatctagaggatcccagcgctgcgcagtagtataaaagttggggataattattttttaacccctccccccaatacacacacaaaggccttccccatcccaacgggaagc

SEQ ID NO: 663500 - DNA, 540 bp, Homo sapiens
  misc_feature (5)..(5): n is a, c, g, or t
  misc_feature (206)..(206): n is a, c, g, or t
  misc_feature (222)..(222): n is a, c, g, or t
  misc_feature (244)..(244): n is a, c, g, or t
  misc_feature (246)..(246): n is a, c, g, or t
  misc_feature (267)..(267): n is a, c, g, or t
  misc_feature (301)..(301): n is a, c, g, or t
  misc_feature (305)..(305): n is a, c, g, or t
  misc_feature (308)..(308): n is a, c, g, or t
  misc_feature (317)..(317): n is a, c, g, or t
  misc_feature (325)..(325): n is a, c, g, or t
  misc_feature (349)..(349): n is a, c, g, or t
  misc_feature (352)..(352): n is a, c, g, or t
  misc_feature (363)..(363): n is a, c, g, or t
  misc_feature (383)..(383): n is a, c, g, or t
  misc_feature (405)..(405): n is a, c, g, or t
  misc_feature (429)..(429): n is a, c, g, or t
  misc_feature (433)..(433): n is a, c, g, or t
  misc_feature (451)..(451): n is a, c, g, or t
  misc_feature (500)..(500): n is a, c, g, or t
  misc_feature (506)..(506): n is a, c, g, or t
  misc_feature (530)..(530): n is a, c, g, or t
  misc_feature (534)..(534): n is a, c, g, or t
gaatnaattgattacgtgaacaggtaccgtgtacaatccccaagctacggcaaaacatcaggagaacgcaccgatcttacattgtacacagcgcagaacaggatcaccccgaatgtcaacagaagaccaaaaatcactttacaaaaaaaaataaaaataacacccatttttatatttaaaaaagtgccagcccttgagctgcaganattagaaaagcccaangacgtgccgccactggaacgangncgccagcaacgtgtggccgtnctggcctttaaagctgaactgaagcgctccaganactnatntctggagtncctctgtnttaggattttccctctctactgtngtnatgtgtgagcntgtcagcctcaccacgagtnaccttcatgcgtcctacgtgtnacggccagaggctttccctttgtnaggnttaaatctgagtacagtnaagaatgaagaaaccaaacaccagaaccctaaactcaaatgatatggancgaatntagagcggcagcgccacccctcanaganagcggc

SEQ ID NO: 663501 - DNA, 370 bp, Homo sapiens
aggaggacaacacattcacttttatttcagtcaagtcacaacacttgtctggctgctgccaagtgcccacagcttcccatttacagacacactttacagggtttcctgtgacagtacagcaagcctctttgttcaaacaggaccagtccaaattttccctcaaaaaaacaaaacaaaaaaaaaaaaaaaaccaaactccattccagtaaggggtaaatacatgaaattacagcaaacagacacttaaaaggacagccaagaaatcttccaacagtttattagaaagaatgtagacatttaaaaaaatccccactgtcatgaacataaattgaggttttccagccagggcataagctgaaatcaaaacaga

SEQ ID NO: 663502 - DNA, 357 bp, Homo sapiens
tccttctgcacgcgaagaagcagtggtaccctcaccccattggcgtgagtgctgtagttgtgaccaaagcagcctgtgcctggggccaagtgttattgggtgttttacatcagatatctcatgcaatctaatctactgtcatctctacactgatgatggccactgtgtgactgccacaacgcattaacctggtatttcccagtgtcaaagggccaggaaaagtgacaagtctggtttatgcttcctcatcctttatctgtccagacaacctcaacagagtaggttttcctgggtaagcagatactgcgggctggcagcccctcaatactaagattcttttcagtgagatctctcctt

SEQ ID NO: 663503 - DNA, 600 bp, Homo sapiens
  misc_feature (173)..(173): n is a, c, g, or t
  misc_feature (266)..(266): n is a, c, g, or t
  misc_feature (423)..(423): n is a, c, g, or t
  misc_feature (505)..(505): n is a, c, g, or t
actgattctgaccctcaccagtgaagagggtgtcagcatcacgcatacgctggacgggcagttcgacgaagccaataacgccgaaaaagcaatgaacaatctgaaggatggtctggcaaaactggggcaaaccctctattacgcccgcgatgtgcaaattaatttgccggggngctgtttgtaccaaacagtctgttaaaccagttccgccgtgaagctgctgacatgctggatgctgcgcgtcttgccagttaccagcgcggcancgtaaaccggttgctgatcctgcgccggtttatccgcaaacgcatctgagtttcctcgcgaacgtatacaaccagaaagcgcgtgaattttatcatcgctatggtgtgcagctgattgacgcggcgtatgaagcacatgaagagaagggcgaatccngctgatgatcaccaagcattgtctgcgctttgctttaatctgtgcccgaaacaggcgaaaaggcaatatcaaaagctggaangcgacgcaatgcaactggttaacggcgatgaagtttaacgctaaagttgattagctttttacgccacttacaaaatgtttgcaggaaaaccgcaa

SEQ ID NO: 663504 - DNA, 273 bp, Homo sapiens
actcagctcccaaagtgctgagattacaggtcgtgagccatcgcgcccagccgagtacttcaggtgtcttagaattttccagagtgtaccctttctgagaaaaacagagacttaaagctaggataactggtatactatttattttttttttacctccagccggggtgacagagcaagactctctctaaaaaaaaaatatttcccttgtaaatagtcccggcgacacgttttacacgcgttgccaggattgcaacgttaggtcaacatatacca

SEQ ID NO: 663505 - DNA, 157 bp, Homo sapiens
ggtccgtcacacactcgttgatgtcttcacaggacacgccatccgccatgatgcatagcgggataacaggagcatatggctgagccccaacagtgctgcacacctgcttgcggttcccattgtctttgcaggtattgggctgcggcagtggcagccg

SEQ ID NO: 663506 - DNA, 1593 bp, Homo sapiens
taccggatctttgctccatggttgctttcttcgtcgctggtagtgatggtgccttgttcgtatgtttgctgcgctcggttatcgtcactcgttcgtgtcggtctttccctactcagagttgggtgtcgattcgtctccgcgtcggtggtgtacacgtgtgtagcgtgcgtcctctcgtctcacccccgtttgtgtggcgcgcgggtgggggtgcccccccttttgtgccgcgccgctcttttgctgtgtgttgtgtcttccccccaggtgggtgttactgttctttgtctgcaagaccgcggggtcggggggtagagtcgctcgccccgcccttgtgtggtgagctcgtcctttgctcctcccggaattaatactaggccccccgcggttgtgaaaatacacatgtggcatgttcgttggcgtcgcgccctggatgttgtttgtcacaacgtgtggcgtgttctctcgggggggttttcttcttccgtgtgggggccacacccaccgagagttggtgttccgcctacgtgtgttattaggcgggttgtgcatacacgtcggggcacattttttggtcaccgctctgcgtgtccacctgtgaggtcgttcgcggttttcccccagccggggggttcgaaaggtatttgttgatgcggtaccttcgggccaacactcttccccccgagggtacccatcttttgtcgaaagtgagtgtcctgcctgtccacgcggcggctccttgtaggccccccttatgggagttcgaaacgcgtgttccgctttgtcaccccgcttatggtgtgggccccctgagtcctcgggcactgttggtgatagttatgccccagacgctgcgagatgcgcctttgggccatttccgtgttctagtgctcccgagtccacccgcttgtttaatcccggttggtatggcccccacccgttccccgcctatgtgctgcctctttcccactaatggggcggccgttatttttggcccactctcacttaatgggggggcctgttcacttttccccctggagtgttccccccccaaatttctccacggctaatcacccctattgagcccataacgctatcgccccccaaattccacatgtttcacactagtccaataattctacatcgcgcgctaaaaatttttaaacctttttttctccacacaaacacacttttctcgggccctaattccgcgaaatgcccccgacacgcttatactcggagactatacccccgaatgcacatatcaccccaccactgtgaaacacttcctcatacactcctttaaggctcacattcacttttcttctaagccacccacgtaaatacttaaataaattttccatgagtttgagagagccttcgcttccgaagcgagaaatgttcctatatagtagagagagaccctccactaaaccctcggaggtgagctaataatggagtgccccccacccctatccaccaccacttcgagagaaacccgtataacactccaaatttagaccaaaaaggaagggatcgtaacccccccaagctggtttcaaacccaccccctggcctccatgactttttcca

SEQ ID NO: 663507 - DNA, 340 bp, Homo sapiens
cgatcgttctgtctgctctggcggacgagaagtaacaagagttcactgttgacatccgcgcagcagaataccacacatgccattcggcaagggggcggaaaattcgcaaggtgcgcgacagcactggagcacgtgtcatcttccctgcggctgaggacaagtaccaggacctgatcaccatcattggaaaggaggacgccgtccgagaggcacagaaggagctggaggccttgagccaaaacctggataatgtggtggaagactccatgctggtggaccccaagcaccaccgccacttcgtcatccgcagaggccaggtcttgcgggagattgctgaaga

SEQ ID NO: 663508 - DNA, 312 bp, Homo sapiens
agagagagagagagagagatactgtgagagagagacagaatggtggcacacagacaggcatgtgtacgcgcacacacacaaacacacacagagacgcacccccccaacacacacacacacccaagacgaacacacactgtacaggagggaacacctctcccgcaggcagccctctgaagctggcgggtttgtgcgtctccgacgagtgagagccacgcggtgagagacgccgcccactgggcacagcaggggggatcgtgtgctctgttatcacaaggggctccaattttgtggggagactcaccgcgcaca

SEQ ID NO: 663509 - DNA, 182 bp, Homo sapiens
gccctccttaggccctccagtaccaaaaagggcaaaaggcccccccagtcccctcccatcccagacctttttggcagcctaaaaagggtaacccaactttgccctatgaaactgcttccctgagcatcattttcaaaggagcaacccctctgtgtggctataaaaagcctacgtgattgtga

SEQ ID NO: 663510 - DNA, 526 bp, Homo sapiens
ctcccctagggggcacgcgagtctaggtggaagaggcacatctatatgtgggtagtggagacggctacaatgaacaaagaaatctgtaatggtttcttccaacaattcgagaaaagacaagaaaaacacgcttagctgagactgtgccataatctgtttatgtgggatacgtgggtggtgggagctgctcgagaatgcacgcagtagcactaaactatggaggctctacagccacaatataccactcccctactgtccccaccaaagtccccttccaggatctagtactgagatccctctccaggaagcacgggaccacggacacggccatgtatgtgtaactaacaaagtccagtaggaacaccagtatgggtgagtccaatgatgattctggagtgtagacaccagaggtaggttgtggcacaccaaccagaggcctaccgtacacacccaaacatgtcctttaccggacatatggtctagaagatcacacaaagactgcctagaagggtctctggagccactg

SEQ ID NO: 663511 - DNA, 130 bp, Homo sapiens
  misc_feature (64)..(64): n is a, c, g, or t
tgctttcgcctccgcctgtggatgctgcgcctctccgaacgcaacatgagttgctctgccgccncttattcggggggtgccggctctttcctgctgtggccgggacctctgcggccgtggagaaggagga

SEQ ID NO: 663512 - DNA, 459 bp, Homo sapiens
tatgaagataagtttcctttcatccattaatttcatcttcagtggtctagtttgtaaaacaaacggaacaaaaacaaaggcagaagagcaactagttcttgaaataatgagttggttccctagcaatataatcaattaattttcatcctaggtttcattatgacttcacgggtctaaattgaaaaccaatcaactatcttccttttctcttacgatttaaaagttgctcatggaaatttgagaaatacagaaaaagtatataggagcttggcaacatagcaataccctatctctacaaaaaaaaatttaattaactgggcatggtggtgtgtgcctgtagtttcagctactcaggaggctgaggtgaaaggactgcttgagctcaagaggtggaggttgcagtgagccgagattgtgccactgcactccagcctggcgacaaagcaagactccatctca

SEQ ID NO: 663513 - DNA, 331 bp, Homo sapiens
tactgactatcctagaaatcgctggcgccttaatccaagcctacgtttccacaaaaagaataaaatacctaggaatacaggtaaccaggggggggaaagaactctacaagggaaattacaaaacattggtcaaagagatcagaattaacacaaatcaatggaggaagcattccgcgctcatggataggaagaatctatatcattaaaatgcccatactggttaaaggaatttacagattcaaggggtttcctatcaaactactagtgacattttttacagaattagaaaaaaattaaaaattgatgggggaactaaaacgaaacttggtag

SEQ ID NO: 663514 - DNA, 119 bp, Homo sapiens
catcatcatgatggattggctggtgcaatacaactaggcttaatagggacatgtcagattcacacaacaagttagtaaatataacacaagagaagatactacttacaatggcaaaaaaa

SEQ ID NO: 663515 - DNA, 339 bp, Homo sapiens
aaggaggactgtgctgaggtatattatcgcaggcttctccaagggagcactctcctatgtatatccctcttaagcctgcgtgaggatggcacattaaccctgtggcccctgcaggcaggagggtgtagggtgcccatacctaccttgccctttttcttgaaccgtagactgtgccggtttatgagtcagtgatgtgtgtctgagtgtgtgtctagaagtgctgaactccaccttgtgttattgggaaggttgttgtaacccccttagctttagagcctggcttccaagatgttccttttccgttctctgtcctgccttggttcccatggataccggagg

SEQ ID NO: 663516 - DNA, 448 bp, Homo sapiens
cggggataatcatggcgcccgtcggaacaacatgtgattgactgatcggagacgcctattcgacggtaggtgcgatccagcacggctgagaactgggtactgtttcgcgagcatcgaatccagccctggcacggttggactgctacaaccgctaccttgctctgtcgagatggagctgccacgccggcggttcagcgtgccgatggccgcatgaatgctggtagctcgcatagaccaacgaaatctacattcatggacgagcgaagttcaaagcatactcacgaaaatgacaaccttgaacttgcagaaaactatgaagccagctatacatgaactgcagccaccaacctataagctcatgactcaggcacagctggaagaggctacaagacaggcagttgaggcagatgtacgattaagccaccagttctggaagagcgagtaccat

SEQ ID NO: 663517 - DNA, 291 bp, Homo sapiens
caaagagctgcagaggcgttcgctctcgtcccggcaaagacgcccgaatgcgggcagctccgaaaactcctggaggagagcagacgacagagagcccgccgcgcgctacacacacgatcacgcacccacacggcgagtcaaaatgagacgccactgaactcaggctgggtgaactcgaggacacagacactcgctgctttacttatctattcagacatatcaaaaatgaaacttcgagacccactttattttgttctgtgttcaaaggaaataaaaggacatcgaaactga

SEQ ID NO: 663518 - DNA, 616 bp, Homo sapiens
  misc_feature (295)..(295): n is a, c, g, or t
  misc_feature (526)..(526): n is a, c, g, or t
taaaaaaaaaaaaaaaaaaaaaaaaaaaaaaaaaaaaaaaaggggggggcggctttaaaattatctcccgggggggggccaaattttacgggtgttacccaagttttttttgttaaaagagggggcccctatatatagggggagggtggtattatatataagcatagaggacaggggggcgggggttttaaaaacgttgggaggcgtggggagaaaacctgtggcgaagcgcttgggaagattctttgggtgagaagagagcccttatatctctctggggggggggagacattanttggggacaaaactcttaccccatacacgaggagaattgtaaagagaggcgtctcataggggaggtagatatttatatacacacatttatttaaagaggtgtgtgtatataggggtgggtgggtaacataccacatagggcgcgtgcacatatagagtgctgcgtgagcagcggtgactgtgatgaaagacacgtttttggtgggcgcatgatacgcgggaaggatatatntagatgtgttgtatgtagagaaacattattatctatattacacacagcgagggaagctcagttgatagtataaaaaaataagatagacgg

SEQ ID NO: 663519 - DNA, 268 bp, Homo sapiens
tctgtttaacattacagcgtcaatctgaattactgaagttctttaatttagcaatcttaggcaacctaaataggagcgaagatggccaatagggattctgcatagatcctgttctgctctgaaagcgagagggaagtttgtacgagaggccagctagaggtcgtcagggaaagctagctgcagtatactgtctttctgaaacagacagtcactcagaactgggagctaaaagccccaattcattcgttaacctcgtgaagtaggaggt

SEQ ID NO: 663520 - DNA, 552 bp, Homo sapiens
  misc_feature (239)..(240): n is a, c, g, or t
  misc_feature (258)..(258): n is a, c, g, or t
  misc_feature (289)..(289): n is a, c, g, or t
  misc_feature (300)..(300): n is a, c, g, or t
  misc_feature (368)..(368): n is a, c, g, or t
  misc_feature (422)..(423): n is a, c, g, or t
ccctgtatgcgtgtacaacatgtcccgtggttcagcgccggttttgaccgccacattaccattttttcacccgaggtcggctctaccaagtagaatatgcttttaaggctattaaccacggtggccttacatcagtagctgtcagaagggaaagaattggtgcaggtaattgtttcacacagaagaaagtacctgacacaatatattggattccagcacagtgactcactatattcaanngataactgaaaacattgngttgtgtgatgaccggaatgacagctgacangcagatcccanggtacagagggcacgctattagaggcagctaacgtggaaatacacagtataggctatgcagattcctngtggaccatgctgtgtaaaacgaattgccgatatttctcaggtctacacacagnnaatgctgaaaatgcaggccctcttggtttgtggtatggattttaatatgggtataagatgaacgagcaaggccctacaggtatataagatgtgatcctgcaggttactactgtgggtttaaagccactg

SEQ ID NO: 663521 - DNA, 102 bp, Homo sapiens
cacgatctttgcccaggcaggcaccaccctaagtgtgctccatgcttcctaagccgccagcccaggtccacctatgccagcctgggaggaggggagtgtggc

SEQ ID NO: 663522 - DNA, 379 bp, Homo sapiens
  misc_feature (223)..(223): n is a, c, g, or t
  misc_feature (246)..(246): n is a, c, g, or t
ctgtgtacatctccgccttactccgccttactctccgccttaccacccaagtagctgggattacaggtgtacgctgccacacccagctaattttttatatttttagtagagatgaggtttcaccatagttggccagagatggtctcagatctcctgcacctcgatgatccagcccacctcggcactcccaaaagatactggagattacaagtagtgagccacncatgcccgagcacgtaatttcanagtttttacagcctacaattttatccaatctgtaaaactggggatcgtaactaagatccacccacatggcgattgtcagagggactcgtagttcaacccaggtgatctcatagtcacagagctcaagcccgat

SEQ ID NO: 663523 - DNA, 148 bp, Homo sapiens
tggagaagacattaagggacatatatgcagttgctacgcaaggggcccgactagctctagtgtgccatggaagaggcaggatgagcagctcagccttcaggtgaagacactttatcgtggattccccagactgtcatccatcttgcta

SEQ ID NO: 663524 - DNA, 120 bp, Homo sapiens
cagcagttaactgcacctggagaacggcgtgcttgtgtgattaggagtcggcccggttcataatagtttcattgattggagtgcaacatgcgaagggcagttttccatacgctatctctt

SEQ ID NO: 663525 - DNA, 123 bp, Homo sapiens
agagctgcaggcccagtttagcagccccatgcagctgcccttgtccagcgaaggccctcgaaggttggtgctgctgtgttgctgcaattgccactgctgacaccagagctcaggccccaggtg

SEQ ID NO: 663526 - DNA, 890 bp, Homo sapiens
tcggtgcaggtgatcacctgaggcgggagttgagaccagcctggccaatatggtgaaacctagtttctatttaaaatacgaaaaattagccaggcgtgtggctgtaatcccagctacttgggagactaaggtgggagaatcacctgaaaccgggagggcggccaggttgcagtgagccaagatagcgccatgcaactccagcctgagtacaacccgagactgtacttaaaagaggtatcattccgaaaaccaccaagctcacctagaaaaggtgcacctaagatgctttactgataattacaatatgtggactttcagcctaaagacagttttacttggggagtcactggtactcagaacaccgatgctattttgggacctaatatggtggtcctggtcattgtcacgcagaacaatttattacccataccataacacatctagcgaggttggcgtttagcagttcagacctgtgtcgcattcacttatccaggtccatccatctactcagccattgagacatttggcctagaattcaaaactaagaaacttagaataatgaacacctatttctaaaactttttagaatggagtactcccacgaaaagtagattcctgtatcagctacatctattgtgactcagggtcatcccaagtcatgcactaaccgtgggccttcagagacaattcggactacttgaaaggctggggagtcacggaggtgtagtcctctcagagttatgaacattggtcggtaatgccaccttaagagaatttcggtccgaaggtacaaattggcagtgcatttagaaccggcagctgctagaccttctggaaactccaggaggacacccacgtggtaaaaacggcctgctcttggaacataacgg

SEQ ID NO: 663527 - DNA, 824 bp, Homo sapiens
accggtgttttctgcttgtcgggtttttttgtcatcttccgccccattttttcctgggtattccccctttttgggtggttcctcccccctgtctctctctttctggatacacttttttctctggtttatgacggtaaaatgttttttgccctcttttgtggttaaaatcgtggagtagtgtcccccattttttgttactgtcgtggtgctggtccccttctgaatcagtggtctttcctgacaaacaacacttgtgtggagagagtttttcacgacagaaccccctcgtgggctccttgtccgtcgtttgtaagaagatgagaccacacccgtcgtcgcggggggggtcacacaacaccaccggaggaccaacaagagttttcctcggggtctctcactactgctcccacacttttgtgccccgccagagtctctatccacaggcgtacaaatatgtgatatttttgcctctataatatcttcgcccctcccctctctctatatactcagcggggggaaaaacgcgtgttcatcagaacatcctttggtttttaaccatggcgtcctcctctacgtcattgagtgatatgaagaaagatgcggttgtagagtgaaaccgaactgcttcgtccattaatcctaccacgcgcagagaaaagaagaaattctttgtgggaccaccctgtcggtttttttttctgtgtggggggcccttttttgtttttttattttttaaaacaccgcatttttttttggggaccaccttggcccccaaattgtttcccagaattgggggccccccttataaaaattataaggagaga

SEQ ID NO: 663528 - DNA, 686 bp, Homo sapiens
aattattatactaccatgtagcatctcacttctaggactaactaatctatcgctcacacctcatatcctccctactatgcctacaaggaatatactatcgactgtccattatagctactctcataaccctcaagtccactccctcttagccaaatattgtgcctattgccatactagtctttgccgctgcgaagcagttgtgggtcaaccctactagtctcaatctccaagcacatatggctaaatacgtacataagctaaactactccaatgctaacataatcgtcccagcaattatattactaccagtgacatgactttccaaaaaacacataattaagaatcaacacaaccacccacagttcataattattagcatcatccccctacgtatattattaaccaaatcaacaacaacctatttagctgttccctcaatccttatcacatccgatcccctaataacccaccatcctaatacatatgctacctgactcctaccgcctcataatacatggcgaagccattcgccacttctctcagtgacctactatcacggagcaaaatactaatagctctctatactaatctcccctaaaaatctccttaattatagactcttcacgagcacaagaactaatcatatttatatcttacttcgaaaccaacttatcccacttggttat

SEQ ID NO: 663529 - DNA, 116 bp, Homo sapiens
ccgtcctttctttcgccaggctgggcacatagggagatctcatctctacaaaaataaaaattagcaggcagaggggcacacacctgtagtctcagctactcggaaggccaaggagg

SEQ ID NO: 663530 - DNA, 863 bp, Homo sapiens
gctgagctcgcgggtgcgcacgggtacgcagcatccgtggcttctgcctccaccccgtaactgcacgcctgcggggagctgccgagccatcgagaacgctcgccggtggaagccctgtccatgcctggacggctgacctggtggtgccgatactacgctgctcaagagcatgacgtgagtgctggagcagcgagcagctcatcgacgaccacttcctcttcgcacaagcccgtgtcgccccatgctgctggcctcgtggcaatgggccgactgagtggccctgacgcccgcggtatctggcacaatgacaataagaccttcctggtgtgggtcaactgcggaggaccacctgcgggtcatctccatgcagacggggggccacatgacatggcacggtgttcacccgattctgacaacccggccatcacccagattgaaaactctcttcaaacgtctaacggcactactgaagctacactgctcggacacgcgcttcacccatggatacatacaatcactcgacctgccgcataccacaccttggggccaaccctgggcgcctgcgagacgcagggtgtgcacatacatcacaggcctgaacccagaccgtggggccacagccatgcacgcacacgtcctccggcgccgggctggcactatcacggcccgtgtcactggcgcgatcatatccagcaacagcccgacaggggccaagcacgaagtcagggactgttgtgaccacgagtacatgccgcgtgacgacggttggacccatctcggaccgctctctcccaacggcgccatgacaccggccaagttggggcattcccatcaagaaccgatggcacgccttcggcctgccc

SEQ ID NO: 663531 - DNA, 325 bp, Homo sapiens
  misc_feature (13)..(13): n is a, c, g, or t
  misc_feature (18)..(18): n is a, c, g, or t
  misc_feature (65)..(66): n is a, c, g, or t
  misc_feature (100)..(100): n is a, c, g, or t
  misc_feature (126)..(126): n is a, c, g, or t
  misc_feature (155)..(156): n is a, c, g, or t
  misc_feature (230)..(231): n is a, c, g, or t
  misc_feature (259)..(261): n is a, c, g, or t
  misc_feature (278)..(278): n is a, c, g, or t
  misc_feature (292)..(292): n is a, c, g, or t
ctcgtgcgttgcnattcncaatgccagaagacagtggaacaatatctagagtgttaagggaaaannattttcagccaagaattatatactctgccaagtnatcatttctttacaaaggaaactggnagacattcttagatatacaggggttaggnnagtatatcaaccaagaactttccctgacaattttgctgaaggatttactgcagctaacagagaacctgaattannataagaatagggaggcaattgtatgccnnnactgatggtatgcattnccactagttaaggngcattaagtttaaattgttatgtatagggcatt

SEQ ID NO: 663532 - DNA, 248 bp, Homo sapiens
ggcgattgttttttcctcaagggcacttccttgagggctgaataccaatcagcctgcgatacaaaggaggggccccctgtcatccttgggactgtgcagtggctctgtggggacaatcccacgtgctgtcctccctacgacctcactcccctgggcttttgtgcaggagtcaatattgattactgttatttctttcttttttctctttttttttttgagacagagtttcactctgtcaccaaccggtg

SEQ ID NO: 663533 - DNA, 353 bp, Homo sapiens
cgtgcctgcaggtcttgcaggccgcttggacagtatggagcgtgaagctcgcgaggctgaggccggctgagcagtcgcgcctcccaggtgcgcaccatggaccgttcggagcgcatccgcacctataactggccggagaaccgcatcacggatcaccgcattggttacaaggctaataacctggactctgtttggaacggcgatatgcatgacctttttaaggccctgcaggaccaggagcgtgccgatgcgcctcgaggctgagggctaaacgggcgtggcatacacgtatggacaggcgctgcgccgtggggtgcagcgccttcgtgctgccggggtaccaagccccgagt

SEQ ID NO: 663534 - DNA, 888 bp, Homo sapiens
  misc_feature (73)..(73): n is a, c, g, or t
ccgccaacgaagagaagcaaacgtacacgccgatgcttaaggaaggcctccaattttaagaagatgatcccangctaccgacagcccatcatcatttccatgtgctccagctctctcagcagctctctgggatcaatgctgtgttctattactcaacaggaatcttcaaggatgcaggtgttcaagagcccatctatgccaccatcggcgcgggtgtggttaatactatcttcactgtagttctctattctggtggaaagggcaggaagaaggactctgcattatgataggcctgggaggattgcgtttttggtcccacgtctactagtagaacggtctcttgggtatataacgcgagataactatagtggtatgagctgttgtgtgtagtggggctatcttggtcttagtagccttctttgaaattggaccaggcccattccctggtttattgtggccgaactcttcagccagggcccccgccagctgcgatggcagtggcggactgctccaactggaacctcacaaacttcctagtcggattgtcttcccctccgtgctcactatttaggagccatacgtattgattatcttcactggcttcctcattaacttctaggcttcataccttcttcaaagtccctgagaacccgtggcaggactttgaggatatcaacacggggactttgacgggcaggcaccacggtgcaagatagacactggacaggacggaggttcactggagatgcaccaagcatcgagccctgctcaagagaaccaaccaaccaagggactaacatcgggacctacttccacacaaccctcacggacaggggaaagccacactctcacactcacaaaaaggagaagaacccaacagggaagaaa

SEQ ID NO: 663535 - DNA, 2346 bp, Homo sapiens
  misc_feature (1892)..(1892): n is a, c, g, or t
  misc_feature (2221)..(2221): n is a, c, g, or t
ggacctaggtagtataggctaggaataaggcatagaagtaggccagcgtaggacgcggagacccagtcatacatagaagagcgacggctataccccacataaccacctaggccctagcgtaggtaggacgaccaccacatagggcatacagccacgtagctagcgcaggggcatcatgacgatggacgacatcgcccataagaaacccatgatgacgcatatacgacaaccacgcataatccgaacgaccacgacaccggaccggcccatggcggccccgataacggcgaaaacgtaatagccttagcaacggtacacctacaacgacgtagggcaacacccaaatactactagcaccttagccaccacccaacgtagccaatactcggtagaataccaacctacaacgtgccccaccggctaactgatataggctacacagtattggagcctcagcgccgtgacaagctcccccaaatacccccaatacctaacaacaccctaccacttagagcgaacctacctaggagccaaacacgaggccgacctatcacctaaccaccggcgcagcacacctaacgggcttcaacaacctaacacaacccaaaccaactaaaccactcacctcaggatgccacgcgaacgtggctaccactgggggcaggctcataaaccgcgtataacccatccaatggcacccaaaacaccgttttttactatctaattttcccttccgatgtaaatactttagcactttgttcccactgctactacgcttcgctccctttcttggctgctaccattatatttctacccttgcctatacctatactggacctatttaaacgtcaggatgccttacccactacctccctaaccttctaactacccatacctatactctatccaactgttcctctcatctctacctccaccattcccctctccacctccacttccatattgcatcccatctcctcttaacctccctccacctccactcatttactctacccctttctcaatctctcctctatctccatcccatccccttcttacctatcaatccaccacttcctcccactatacctcaacactcatccctctttcctatcatatctcacatactcttcacctcactcgcggcaactgccactccaaccgccccacccgcatgactcactccaccttcgctatccactacccccttcaccccccacattaccacccacacacctcgtcccacctccaccacgctcctcacgcccgccgccactactctcctccgccgcccctcactcacactagatctaccaccctgcacaccctcacccctaccaccccacttgccccacccccactctcacccccatccacaaactcacaccctcggcactatctccctatcccctaccacactcactctctcctctgcttccccttctccatcctcccacgcacatctcaccccccacccctacttactcactactcctctactctcctcctcacctccctcactcactaccctaccactaacatctccacacactccacatcactcacgactatctccctcactccccacctaccactcttccacccacactctgcacacctctctcacaccttccactcacaacaccactctcctctatctcatcctcactttaacttctacactctctctaccccatctatcactcactgacctcacacaaccactcccatactcactcaccactacactcactactcacgccctctgcactacaacaccacctactatcggcctcaacactcctctcatctacctccactgcactacctctacacctcactctgtactctactacatcaccacgactacacctccactgcactacctacancaccgacatctaccatcactacacctacgctagccctctatcacataccatcaccacagcccacacctacacacacaacaccactactacatactacacctcaccctacacatccactcatacactcctacccactctcactcctctcactcgacgcacactcctctactcacccactactcacactctacgcccacacacaaccactcatcactctactcacacacactcacactacacttatctcacacacgactacatctctcactcactacttactacacctacgctctctctctctcacatctcactctctcactccgacacancactcacactccctctaccacaatcacactctcactcctactacacactcaccaacactcactactaactcacactccctcacgactcctccacactccctcaccactcaactcactatctctcc

SEQ ID NO: 663536 - DNA, 485 bp, Homo sapiens
gtggcacgctcaggcaagcacagagagtgactcccgtggggccatctactccatcccgatcatggaggacggaggaggtggcatctccacatctcagaagacccagcacgaggcccctcaggacgctccataaaatttgaaacacagtccatggtaccgcgcacggggttctcagaagaggcaacgtcggcattgccggcagaagagcaatctcaacattaatcaacagaaatccaggcagtatgcactcaagcggcggcggtgtgcggatgcggctctgtggtcatggcccagtgagctcatcagctccggtcccgtatcgccattctccccacggagccagcagcccaggagaagtcactcgtcccaggcgctagcaagggcagtcttgcagccgggttgcagtcaccacttcactgatggcgagtcataagcttccaggccgccacgggtccatggaccacctagtgagactctgcccactc

SEQ ID NO: 663537 - DNA, 426 bp, Homo sapiens
ctgcacgagagctcttttatatcacactcgagtccacagccacatattcagaacacactggcaaaactctgggggaaaaagcgcaaggttccctacaagaaggaaagaaagcgcacggcacatatctccaaacacaattgaggtcatttcagggtcattcccaagaatcccccaaggggcgattccaaatccctgaggagagacaagtgcgaacctgtgcaggtctcaatgagagacaactcacttatatgctttgcgtggtataacaccgtggtgggtggatttcctgtgggccacagacaaccgtgtgaccagaatatatgcgtggcgctgaccctctgggcggaacctgggctcttggcttccttcttgggcacccaccacatcttgcacagaccctctgtgtttacacccataacagtttgg

SEQ ID NO: 663538 - DNA, 863 bp, Homo sapiens
  misc_feature (269)..(270): n is a, c, g, or t
ctgcggagtgggtcatgggctgctgagggctgccccaaggtgctaccgggtttgcacgggcgcgcccggctccgtccgcgagtgcgccttcctgacttactgctgggtgcgcggggctgggggtgcgagtaccacccctgaagtctcttcctgggcgacctccggggcctcacttctaggtcctccttagaagagagaggatctagaacttaggacaaaggaagtgcccgttatccgacgagcaagctattccacgctgcgtgagctcnngcttagtctgctagcctcagacgcgtgcgtgcacagtgacgtggccctgtgtactgcagcgaaaaacttgcgggctcagtaaatgcataccactgagagtagttgtgagaacaggaacaaacatcttctgaagagctcggagcagaagcctttttggtcaaccatggaggaggatgaagacggcgagcccgagttcacggagcctgggctgcccctgttaaaagccaggccattgctcagctcagcgtaccacgtgctaagagccatctccatcagaagcctggccagacctggaagaaccaaagagcatcatctctctgacagagagttggtgttcaaatgaacctcagacaggtagtacgtagagctcctgaggccacgagtgattgaccagagagggtgtgtatgaaatcagcctggtgagccacaggtgtatctagggtctgaggtatccgtggcattgttgacgtgaacagaagctggacgtggatattggaacagctgttgtcaagatgttccctggaaacagaggaccggcatcagagagggtggcaccctgtgctgggcaagtaaagaaacgcattgaagagaac

SEQ ID NO: 663539 - DNA, 311 bp, Homo sapiens
  misc_feature (308)..(308): n is a, c, g, or t
  misc_feature (311)..(311): n is a, c, g, or t
cttatagagatgggtgtgcatgttgccaggctgatctcgaactcatgaactcaatgatctgcccactgagctccctcagtgttgggatacaggtgtgagccactgctcctggcctggctagcactttttttttttttttcctagcacttcttaatgacggtttccattgtatctggaacttcattgaaggttttttggaaaaataatataggatatgttgcaggtctattcacggctcccttgttggtaatgaaaatacttgatgtgaatggtgacaaattgggtccagttggagctgcctacgtgtngcn

SEQ ID NO: 663540 - DNA, 301 bp, Homo sapiens
  misc_feature (253)..(253): n is a, c, g, or t
ggtttttctgtgggggccccccccccgggggttggtggccgagagtaaatttttttcccccccgggtgtgggtgggggggtttgtggggcctctccctttttgggggtttttttcccccccccctttgggggggggggtttttgtgtctccccgggaaaattttgttttggggggagtttttttttaaaaaaggggggatttttttttcccccaaccaaggggggggggtaggggggggttttcccttttttncgccccccccttaaccccggggttttaaaggggggttttcccttttta

SEQ ID NO: 663541 - DNA, 261 bp, Homo sapiens
taggaggtgcggtggtagcttttctgtgcctcagtgctcattcacatgaagccacacttcatttgatagtgccaatgtcagctaattgtttgtatgtaagtagcaatggggtacgccgtttggctcaggcaatcatcccaccgtggccttccaaagtgctaggattacaggtgtgagccaccacgcccggccttttggtttttttttttttttgaattggaaaggttacctaccggggtgggccgggtggacctcaacgcc

SEQ ID NO: 663542 - DNA, 315 bp, Homo sapiens
tgcagtggcgctatctcggctcactgaagctctgcctcccgggttcacgccattctcctgcctcagcctcctgagtagctgggattacgggcgcccgccaccgcgcccggctaatttttttgtatttttagtagagacggggtttcacctgtgttggccaggatggtctcgatctcctgaccttgtgatccgcccgcctcggcctcccaaagtgctgggattacaggtgtgagccaccgtgcccggccttcattctttttcttaattttccttcagtatataaaaatatctagcccccgttgttagagagatatt

SEQ ID NO: 663543 - DNA, 266 bp, Homo sapiens
agcggagcggccgccgcctcctcccttccccgcctccgccggacgcatggcctcctccctccggcccaagcacgaactccccctcttcgaaaaatacgccgtcacataaacatggacataagagaagagagagaaacagaagagacggaagagaggagaaggaaggaagagagagaagagagaaagaagggagagaaaagaagatgacagcaccgaaaagaagaaagatagcggaagaaacgagaggaaagaagagaaaaaaaaca

SEQ ID NO: 663544 - DNA, 345 bp, Homo sapiens
gatgtccagctcaaccggccaacaagaggaatgccatgaacaaggtcttctggagagagatggtagagtgcttcaaaaagatttcgagagagctgatgtcgggcggggtgatctctgggtgcaggaaaaatgttcactgcaggtattgacctgatggacatggcttcagacattctgcagccaaaggagatgatgtggccggatcagctggtaactccgctgaacatcatcactcgataccaggagaacttcaacgtcatcgagaggtgccccaagcccgtgattggctgcgtccatgggggctgcaattggcggaggtgtggaccttggttacccgcttgtgac

SEQ ID NO: 663545 - DNA, 372 bp, Homo sapiens
cgatcgaactcgataaaaatgtcatgggtgaggccacgttgagtgcccttgacggtaaagaaaaaggttttgctgtaggtggtcaacacccggatcacccgccgatcgagcatgccaggcaaatctcctttccagggctgcatgatgtcgtccattttgacttccagtgcctctcgctcctcctgtgccggcggcttttccttcaccggagcagcatgaaccgaactgacgaacagcagggccgtgatacacgccaggcaggcgattagcaatcgttgagaagagaaggcattcatggaagacactccgaatggtgcgtcttttcattgtagtcaaactaaaaaagccgtcgacgcggccgcgaatttagta

SEQ ID NO: 663546 - DNA, 271 bp, Homo sapiens
ggcgaaaccgcttgggctattacagtatagaattgtcttctctctgtcaaggtggacaaacatgtcgcctatatttcagcacctgtaacccagagatcacaggtcttccctgagaaacttggtttctttctataaatgtgtgtggttttcagcgctcaactcctgtcttcaaatggtagtaagttctacttctacttctgtcattcagaacattttatgtcaaatgatgtaatgcagaaattcttgtgctattgaaacttctaaaactagg

SEQ ID NO: 663547 - DNA, 295 bp, Homo sapiens
  misc_feature (76)..(76): n is a, c, g, or t
ggatgtagtgaggacaaacctgatggatgtttatttgtgtatgcggggacatttatgttctattgtgcgcaggggngaaacggtatgtttctggtaacattgcgatttggaatgtaagtaatacttaatggtaatttttgttttctctttcacatatggagaatgttgccttataagtatttgagtattagaaattgatcaaatcactaagttagtttaataaattaaaaaatttatgcttcattattatagctatttcctaatagtctctgcatatgtcctcactacatgccat

SEQ ID NO: 663548 - DNA, 780 bp, Homo sapiens
gtcaattccctgccatttgcctctcctgtctcccatcccctgccccagaccaggagccccctgaggctttgccttgcatgctatgtgttcgctcttactcacttggtaattcaaattgtcctgcgaggttcattccccatgaccctttccgccacattggtaagagtagctgcgtgtgctaaaccactctctggaatctctttgtgttagcggtctcgatttgaggacattcatttcttcagcagcccattagacaactgagagcccagggagtgtcctacaggatagtttcatagtgacaggtggcacttggctaatagaatatggctgatattgtcattaactcatttaagtacctttgacatgggtatgtctaataaaactcggacccttcttgtgaaatcaagttaaataacgaccttgtctcggtcacctgtgccccttgtccatgactcgaggcacgtggtaaacaacttgccacagtgctaatgtggcttctctttgagggactattcgagggttagttggtaaaccgttacaaaatttccttttgccttgcccctttcaataccttctgtctcactgtacttcagagaatcatattgcgcaattgccccgtttgtaaaacaccatttgggagaaattcgcgttcccaagaaaagggacatggtccccccagtgattattcttacacaccagcctagcttaccaggggaaagcgccatattcgcccaaggccctacccaattggccaagacaacccacagtgaattgcgcatg

SEQ ID NO: 663549 - DNA, 152 bp, Homo sapiens
atagtcgtgtgtccagctctagtcagagaccgacagctgggagatcaagtcatggtttctgagctgcggaacaagtagtctgagaagctgctcagacactgcgagaggaacagctgccacacagcgtggaagcgggcgcaggcttgtcctca

SEQ ID NO: 663550 - DNA, 379 bp, Homo sapiens
ttatgtagaatctggagatggacttttggggcgctgaggcctatggtggaaatagaaatatcttcacataagaactagacagaagcattccgagatgtttctttgtgaagtgtgaattcatctcacagagttgaattttactttcaattgagcagttttgaaacactctttttgcagaatctgcaagtggacatctggagtgctttgaggtctatggtggataacgaaatatcttcacataataactagacagaagcattctcagaaacttctttgtgatgtgtgcattcaactcacagagttgaacctttctgttgttggagtagctttgaaacactcctttcataaaatctgcaagtggacattgggagcgctttga

SEQ ID NO: 663551 - DNA, 1009 bp, Homo sapiens
cagcttacctaagaacagctaaaagagcacacccgtctatgtagccaaaatagtgggaagattgaataggtagaggcgacgaacctaccgagcctggtgatagctggttgtccaagatagaatcttagttcatctcttaaaatttgcccacagcaatcctctactaatccccttgtaaatttacatctgttagtcctaaaggaggaacagctctttggacactaggaaaaaaccttgtagagagcagtaaaacatttaacacccatagtaggcctataagcagccaccaattaagaaagcgttcaagctcaagacccactacctaaaaaatcccaaagatagtaacgtgaactcctcacacccaattggaccaatctatcagccctatagaagaactaatgttcagtataagtaacatgaagaacattctcctccggcataagcctgcggtcagattaagacactgaatctgacaatataacaggcccaatatctacaatacaaggcaagcaagtcattattaccctcactgtcaaacccaacacaggtcatgctccataacggacataggttagtcacacaagtactaaggaggggacggtcgaacactaaaccacgcgctgtaggagcaaaaaaacattatcactataaaccatcatcgatgtagtacacagcaccctctgcacacgatgtaacgttacgtcggataacttagtaactacgagccctgactgcagtctgtttgggaacaggcccccgttccaggcgtgtcagagactcccgggagcatcggcttaccccatgggaagggacctgttataaccggttcctggactgatacccagggctatcacaactaacgtgaacggaatcaatcaaagaacaataaatgaggaacacaataggaaagtaaacacacattaagctgcgtacgacgtaaacagcattcacttccttgtggacacaaaatggggtacgcggatgtacgtatacgaataatactcggcaa

SEQ ID NO: 663552 - DNA, 156 bp, Homo sapiens
ggacccccggaaatgtgttacaggaccttcctggacgcccgtgggcttctggacgactaaacggaacggactggacttacccgggacaacaacggccttcccggatctaagggaatcaccctgccctgtattattcctgggacttgggctatcaca

SEQ ID NO: 663553 - DNA, 2452 bp, Homo sapiens
  misc_feature (1071)..(1072): n is a, c, g, or t
  misc_feature (1883)..(1883): n is a, c, g, or t
  misc_feature (2046)..(2046): n is a, c, g, or t
  misc_feature (2146)..(2146): n is a, c, g, or t
  misc_feature (2321)..(2321): n is a, c, g, or t
  misc_feature (2328)..(2328): n is a, c, g, or t
  misc_feature (2355)..(2355): n is a, c, g, or t
gtcaccaccccatcgtttgcactgcacgcacgtttcattctccgtacctacgcgcccttttcctacactttcctcttctccccgaccggaggagccgctcttatccgagcggtgcatttctggggcccgaggtcgagcccgaccgcttgacagcgatcgcctgagggaaagcgagaagaggccgcgaccgggacgagcacacacaagcggagtcgccaccgggagagaagtcgactccctagcagcagccgccgccagaagaggccctgacacacacagatacgcccggtacccccaggccccggttcaccaatggcgagcctggatacttgcaaaggtgggctcacggcaacagggagggggcactaatgttcttaccatgggacatacgcgctggtagcacagacacagcagcaggcattggttcacttggtcacaccatcgtcgggcacaacacttcccaacaatttatacacatttcacaggttctgctcctcgcgcacgcgaacgtcgctcaacttgtccaaacggcatttttcagagtggcaaatttggactcttaattacacactggtcatagggatccccacaaatggcattcccacagcaatcaacaagcaacggacaccaggatgaccactatctcagtggagggtgaacacggcacacacggacagaactcgctagccccaggcaccatggacccacgggataccaccacacacggaaccgtgcccaacggcttaacttgggactaacgggtcagaacttcccaaatacattgggcaacgcacctgggccagcaggcatccagacttgacagaccatggttcacatcacggcacgcgacacaccgacgacacatcacacaaccatgggttgggctgaacgatggaaataacggacgcaatgggctgagtgtacacagacatgggaggtcgaaatagccactacggcacgaaggcaactcggttggcgaaacaatccgtcgataccagaccacgggcgagacatgatgggttgcatccttgtttcttctgcctgtgttatcctgttttcgctatacatcanngagcagcctaaataccaagacacgctacacgtagcagagcagaagacagcagagcacacacagtatcagcagaccaatacgcacacagacagaaacgactaaatgaacaagcaggagcgagacacaagcgcgccacaacgctaacagaaaagcagccgaaagaaagagagctaaccgagatgaatacggagaccgagaagtaggagcagctcatgagacgaagaacagacaagcaaacgaagaagcaaaggggaacagcgcaaacgcatgacgagcggcaaagaaagacaagcaagcgagacacgacgactcgcgtgaatcagacgaagacagaataagtcgtacgaaagaaggacaaaggagaaacgatacagacgacacaagccaccagcagaaaagagagcataagcgagcgaggaacacgaaaggcagaaacacgacgaacagcagatagagcaaagcgaagacagaccagcagatgagagcaacacaggacacacaagcgcatgaaggtagcaaccgaacagccaagagagtacacgatgagtcgcgaacgacaggcacacacacacgcacagaagccggaagacgcagcgcaaggacacggatgacagaggagacactacgactcgagcgaagcgcgcagagagcgagagtcgccagcaagacgcgacagcgagagacaagaacgcgacacgacgactgagcgtagagagacagacagagagcagacagcagggacaaggagcgcgacagcgagctaaacagcagcagaacacgagacacggcagcgcaaagataagcagcagancatgacacagcagagcgttaacaggcagcacgactaggtcacgaagcaggagagatacgcgaggaagagagcagagggacagtcggagagtacggagcaatagacagcgcacggagcgacgcgacgagaagcgagcaccagaggagacgcgagagggctgacncgagagatgaagtacatgacgagtaccaagctcagagcaaagcacgtacggaccgatgagacagacgcactagagacagcgagaggatgacgacgcagcngcgaacgacgacgccgtgcacagcgagactgagcgccgtgaaggcgagctacgccatgcgcgcagagaggacgacgatagagacagagacgaggagaagtgaaacgcacgagaggagcgatgaaggcgagagaacagaagtcagcgacgacgagcaggaggggagagcacatgangagatgntcgagcagagacgcgagcgagtcacancgagcactagcgacgagtgtagcagcaacggagaggcgtgagtacgtacgaccaggagtagagcgatacacggaacgaagcaagcacgcagagagct

SEQ ID NO: 663554 - DNA, 154 bp, Homo sapiens
actcatctgccctcgcctaaggaaattacgcttatcctgtcacgaacacatttagcacacatgaaccaccataggccctgttgacatgtttctttgttttggacgatctcataagaactttaggtcttacagcacgaacccctcaaagtctgcc

SEQ ID NO: 663555 - DNA, 543 bp, Homo sapiens
actcatagttgttctagagtatccctgttctcctgctattactgcccaggttggagtagtggctcgacctctgctcattgcaacctccaccttccaggtcaagcgatctcatgcctcagcctcccaagtagcggggattatagacttgcaccaccacactgggctaattttggtattttaagtagagatggggttccgccatgttagccagaggggtctcaaactccgggtctcatgtgatctgcccacctgggcctcccaaagtgcggggataacaggcgtcagccacggcgccgggcctagagatacctttaaggggggttctaaagcctcagaaattatatatcctgaagagaaagataacagtgtaatccatggcataatgagggaaagttaaggcagagtatcttagggttgggttttccattaaaagatcagggtccttacagatttaaagtccatttaaaattttggcatagtaatatatgtacttggttgaaaaaagtctattagcccagaaggcttataatagggatcaagaat

SEQ ID NO: 663556 - DNA, 348 bp, Homo sapiens
tcggtaccggctcctgtggaattgtcatctttaaaagtggctaattttgcaggcacggtggctcagtgctgtatttgcagttctctgggaggtcaaagagggaggatctcttgaggacaggagtttaagaccagcctgagcaacgtagggaggccccatctctaatttttaaaaagtagctgaggctgggtgaggtggctcacacctgtaatcctagcactttgggaggccgaggcgggcagatcactgaggtcaggagtttgagaccagcctgaccaatatgatgaaactccgtctctactaagaatacaaaaattagccaggcatggcggtgggcgcctgtaatcc

SEQ ID NO: 663557 - DNA, 713 bp, Homo sapiens
  misc_feature (233)..(233): n is a, c, g, or t
acccgagggatattttctccgggttccattatcatcgctatccccacggggttcaagtattttagttgctcgcccccctcccgggaagcaatatgaaatgtttggtgccaggctctgtagccctaagattcttcctccttttccccgaggtgggcctgactggcattgtattagcaaactctccactagacatcggactacccacacggtattacgttgtagcccacttcacntatgtcctatcaataggagctggatttgccatcataggagggttcattcactgatttcccctattttcagggtacaccctaggccaaacctacgccaaaatccatttccctatcatattcatcggggtaaatctaactttcttcccccaacactttctcggcctatccggaatgccccggcgttactcgggctaccccgatgcataccccccatgaaacatcctatcatctgtagggtccttcctttctctaacagccggaaaattaataattttcctggttttagaagcccttcgcttcgaagcgaaaagtcctaatagtagaagaaccccccataaacctggagtggctatatggatgccccccccccttccccccctttgaagaacccgtattcataaaatttagaccaaaaaggaaggaatcgaacccccccaagctggtttcaagcccaccccctggcccccatggctttttcca

SEQ ID NO: 663558 - DNA, 345 bp, Homo sapiens
attggtgaatatcaggctctatcatcgtatttgcaggctccggcatggagggatgtactttaaagtcgccttcacctttttgttgtagaagagtatccatcgagattttgttaatccggccttcgtgcgtgggcgggagattctggatttttattccttcgagccgtgagttgcgggagaagggcgactctgtcgggaaaagttttactttcaggtaaggcgaatatcggaggtgggtgccgaggacaaatcgccattaaaataatgacgcaaacaatgtttaatgtcaatagtcaacgttaaacaatcaaatacggttaaattccgtgatggcgggcgggttag

SEQ ID NO: 663559 - DNA, 1649 bp, Homo sapiens
  misc_feature (616)..(616): n is a, c, g, or t
  misc_feature (1315)..(1315): n is a, c, g, or t
tggcacttccgggttaaaaaagccactatcctcagttgagcccgggggtgaaatggtgaaatcctgatctctctggtggcagtaatatatattaagtggggtggggccaggggctggtggaataaactatctattcctccagtaacagtctggcaatctccgagggccccttctaaccacaaagtatgggcttaaagcaagaggcagccagtatggaatgttatggtatatatccaaacaaggaaaggcatagtaagcgaagggtgtcaactaaaatgtggcgctgggtgggcccaagcagtatgggacacacagaatgttatgggcccccgaggcgcacagagagcgcagtgtccgagggctaacgagtggtccttccagtgtaacgtgggggtgtccctatatacaggggcgctatttgcgcgcacccaaatattcttgtggagaaactcccctctgggcctatatgtggtgggactatggcgcaagggctgagcctggggttcctttggaaggtgtaaagagagataatatgcgctaatgtggggggagaggagaagtctggagccgctctgtgtgggacctgtgggctatttgtgggtgacccaggggtgcnccatgtatgggggggaaatatgtgtttagaagtgtctggaaagggggctaatgcgtatgggggggggcccacttggtggggcatctaaaatattgcgctttggggtaacaaccctattcctctataatgagaagggggggcgaccaacagggggtgcggctgagaacccacaaattatttgtcccccttataaagggggccatctgtacaaacgccactgtgggcgggagataaagggaaaggtgtaacccccccaaagggggtgttacacaaaggttgggcccctacacaagggggtaacccaaaggattaataaacccccccaaaaagaaaaatggggatcctgtggcacaacagggacaaatttattggagctttaggagaacgcaggttgggggcccaaccacttagcaacacaaatttctccccttatgttggagcagtggggatcacaacggggcggaaaacaacatcttcgtgtggatgtcggtggccccacaggagtctatatttgtgggaggcgtctatatcgggggggggcccacccacatcgcttgggggacattgggggccaacgccagggagtataacaacccaaaccccgtggggcatgttaaacaacaccaggagaatgtggtgcaccgggtataaatttaacccactatgagaggagctagaaggggctgtgggcgacgacanagcacacagggaatagccacgggggtggccgcgtgtgccacacaaaagggaagcacaccaggagggatgattcgagaaacacacgaggcggcgctgcaggaaaaaacagcaccccgcgggggggtattgtaacacccggcgagcaccagagtgctttacaaaaagaagatgaggggataagagaccgtgcgaccaaaacaaaaaagtcgttgcccccgcgggcgtagtgaagaagacgaagcaatagtgatcaccacgagcaaggtagacaaacgcgccagtgtcgataggagcaacaactgagtcgctaggacgacacatacagccaactggt

SEQ ID NO: 663560 - DNA, 290 bp, Homo sapiens
  misc_feature (17)..(17): n is a, c, g, or t
  misc_feature (24)..(24): n is a, c, g, or t
  misc_feature (41)..(41): n is a, c, g, or t
  misc_feature (182)..(182): n is a, c, g, or t
  misc_feature (245)..(245): n is a, c, g, or t
  misc_feature (270)..(270): n is a, c, g, or t
  misc_feature (272)..(272): n is a, c, g, or t
gggctgcatggaagttnggcacgngacgcaggagcacccangcatgggctgacactggcttcctccacaccctgtgctttgtgtattatttgcctctctatatccactgaggacagatctcctggagagacagtgttgttactcacctgtgaatcttaaaaccttttgagacctggacgaanggaaaagtcatactctaactgtcaaatgctttattgcttacaagcattgtttaggactagaangatagtaccatgcaaacatagtttnanctctatccttgagaaaaa

SEQ ID NO: 663561 - DNA, 993 bp, Homo sapiens
  misc_feature (485)..(485): n is a, c, g, or t
  misc_feature (680)..(680): n is a, c, g, or t
agcgggtgtctcttgttcttgcctggtgtcggtggtatagtaatcagcgacttgtgtagggacagctgacaagtgaagatagacaacaggaaatagcgaaaaatatagagcaccctacccccaacagacagaagccacgatcgagaaatatccagaaagaacgaaaataagaaagagacaaccgagacgagacgtactaatgggaaaataatagttgagtgttaacatactaatttaccctacattggaacgatactaccgttatagtagtggccccagcgggattgaacagatgactaaacgagaatagagaggaacataatgaaaggaaataaacaactgagacaagccaatagaaataagaagaagcaacatatataagaacgatcacaacataacaaagctaaacagaataaacaaaaagcacctaaaggaaatcaaaataaagacaaaagacctcaaataagcgaaatccataaaagagnatcaaaggccataagactcacgcaatacactagaagaaataaagaatagcaaagagatatctaaagaaaaaacatacacagatcaaaagagccaagaaacacagaaatataaaaagatgaatatcaacagacaagaactcatgataggaacctaccgcgaaaaatacctgcacaataaaatagaaactatagagnactaattagcagtatgcaacctagatacacaaacaaacagaagataataaaaacccatgtaacataaaaccgagatcaaatagaccgaagatgtctaatagacctatgaaacgaagaaaaaggcaccaaacaaagataagcacaagtcatattaagaaccatgacaactgatgaccagcgaagaaaaacagaaacgtgaacaataaaaatggagaccgaaaaggaagtcacgataagacatgaaacagcaaataaaaaacgaacaaatagaccaaaccacggattaaataaagaggcatcaactgaggtacag

SEQ ID NO: 663562 - DNA, 250 bp, Homo sapiens
agggtcagacagaatttcattcttctttggatccagggggtgtggtaacttctcaaaaaattcctttaatttaatctgaatcttagtcagtaactggtagggatttcctctatactagtttccaatggtatccaagacgagaaaagagcatctccccgaaggccaggatctcaagagctcgtggaagaagggactcaaagggcatcccgtttccggagaacagcagtatcaggggtaccggagcttcgaa

SEQ ID NO: 663563 - DNA, 569 bp, Homo sapiens
cagaccgattcgaactgtgggtacccagtacatggtccacggtagaggtgccctaatcagtcaagagagtttgagagacgtgagcttatcaccgctgcactatgagcgtaaaaattgccagctcgtagatcaaggaattgcatgccctactggataaggtggctcctgtaaatatgagcagggggaacttcatggggacaacatggtggcaaacctaacatatgttcgtcaatagttcggttggcaataattcaacgtccgccaggcgagaacatattcaggcaccgtcagtcaaacatttctacagagtcacacctgatcccatatatagtagctaagaagtttacgtgcaacatgtgaaccatggggggagcatggacagtgctccaggcacggatagaagacagcacaacctgcaccagtgcatggcgagactaccaagccttttttcgccaccatgactggccagtctgatagccaacgaactaacttatattttgaccacagtaaggaatggatgtgagaatagatcatagagactgtaacggagacgactataggccttggag

SEQ ID NO: 663564 - DNA, 359 bp, Homo sapiens
agaaacctctcttccataaaacaacaagaacacgggcaaaaaatgtcaagactgggccgggcatagaggctcacacctgtaatcccagcacttggaaggccaaggcgggcagatcacaaggtcaggagttcaagaccagcctgggcaacatggcgagactccacctctacaaaaaataaaaaattaactgggcatggtggtgctcacctatagacccagccactccggaggctgagtggggaggatggcttgagcccaggaggtcgaggctgtagtgagctgtgctcacgccactgcactgcagcctgggtggcaaaacaagaccctatctcaaaaacaaacacaacctctcttcactt

SEQ ID NO: 663565 - DNA, 477 bp, Homo sapiens
cggcacgagggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtgggttgacagggattcaaggaacaaacactgtgatgtactattggtggaagaatgaactggagcagcctttctggagagtgatttgccaatatgccttatcattttgcatgatctttgtcctagtaactctatttctatggatttactctaagtttgtaaacatggatgtgtgcaaagattttagctctaagaatgtttgtcagtgttctaataatagcaaaaaataaaaaacaaatgattgaaaaatagaaaaaa

SEQ ID NO: 663566 - DNA, 300 bp, Homo sapiens
tgcctacccttgttttggggatcttttgcggtacctcttgtgcggccagtttcggcgcagcctctagagggggtccccggacctgggctttctttgagggatgctctgggattcctgtcgttgccagagggtgcttgagagtcgtgttgtggtgtccacttgtggccatcagggcgctgtacggtgcttggtgtcccgccacctggagccttttgatggtggtggctccagcctcctaccagctagctgtgtagcaatccacctgcaccccggactcaaagctggctgctgcggctggag

SEQ ID NO: 663567 - DNA, 486 bp, Homo sapiens
  misc_feature (139)..(139): n is a, c, g, or t
ttttgctgcgacatcggggcgatcaggagagtggatacatgtctcgaggatgcaagtgacgatgttcagatacgttggaccagagagaggcactgaggaaagtaaaggcttcttcagaacctggtgttgcttggcaggnaggatgctggagcggagaagatcttccggagtaatggggttcagctcttgcaacgtttactggacatgggagagactgacctcatgctggcggctctgcgtacgctggttggcatttgctctgagcatcagtcacggacagtggcaaccctgagcatactgggaactcggcgagtagtctccatcctgggcgtggaaagccaggctgtgtccctggctgcctgccacctgctgcaggttatgtttgatgccctcaaggaaggttgtcaaaaagggtttccgaggcaaagaagggtgcatcatttgtggatccttgcccgggagcttgagggtcctcatcaagaaact

SEQ ID NO: 663568 - DNA, 1116 bp, Homo sapiens
  misc_feature (21)..(21): n is a, c, g, or t
  misc_feature (50)..(50): n is a, c, g, or t
  misc_feature (62)..(62): n is a, c, g, or t
  misc_feature (74)..(74): n is a, c, g, or t
  misc_feature (83)..(83): n is a, c, g, or t
  misc_feature (753)..(753): n is a, c, g, or t
tccaggggaaaataacttttntggaaaccccaccaatggcaaaatcggtnccgggcattaangctccttcttcnttggcaatncgggtctttcttcagtgggtcccatgaatggctttcttctcctccagggtctgggaagcgggccagggccaaactgggagggggtggtcaatggaacttaagggtgcaatcttctccaagagcccggccggtttcggtctggcaccagcaagggactggcgggaggggtggaggcacccggtttctgggttcccaccaaaaaggcctttcagcttggacaaagtcatgggtcccacttcacctataggggcacaagagccacccgagagagggttggaggccctggtcgagatgaggtcatagtcgagggggaggctatggtcctgggatcagttggccgtcctggataaggtagcccgggccaatctttataaattcttctgggggatcccacaggggcggggatggtcagccttttctggcccagggccgggcccacagagaaggctaacacgagcaggatgccatgccccaataacagggcaccttgggcaggcctcggggggtctgggggggcagttcctgggggtgccaacgatgggtgacccctttggtagccttggcccttggtcaccccgattgacgtccgaacaatctcatccgtggcgcaaacactggtgttcaccaggtacctggcgtgcacgagactctcgggggcccaagccaagcntcctcgggcaaagtggccccgttacacctgggatctacaacaaggggggccgtctccggggccaggaaacagggcgcatcggggtgtgggcatgcaccggataatggggagacacccaaggcgggaaagccttcacaaggggtctgggcaccccaacccagcaatctggcgacaccgacaaaggccgccctgaaaaatggccaccactataaaacccgcgggtcctcacggctcgtcaacacaagatcacgcgcggcgcacaggtgctccgccccggcccaccgggggtctagggagcccccacgtgctagcccgacacaatgactctcgcggggtcgcacaccacgcacggtcgacagcaac

SEQ ID NO: 663569 - DNA, 602 bp, Homo sapiens
atatgcagttatttgcatttataatattttgtgaaagttctgtattttcttgttttttttgagacggagtctctgtcacccaggctggagtgcagtggtgcaatctcggctcactgcacactctgcctcctgggttcacaccattctgctgcttcagcctcccgagtggctcggactgcaggcgcctgccaccatgcccggctaatttttgtattttagtagagatggggtttcaccgtgttagccaggatggtctcgaatctcctgaaccttgtgactctgaaccgacataggaaataaaaaagatagaagagaatagcaaggaagaagaaacaaaagaaagaaaaagggaaaaaagaaagaagagaaaaaagaaaaaacggaacggacagcagaaagacaactacaaaggagaataagcaaaacaaagaaaaacatatgaaaaaaaacaaaaagagaaaaaaacaagagaacacggacaaaacagaagaggagaagagaagaggagagaagataaagaacaagaggacaagagtaggagagggacacagaggacaaccacaggagaagaaagcgagtgggaaaaaacgacaagacaagac

SEQ ID NO: 663570 - DNA, 930 bp, Homo sapiens
  misc_feature (35)..(35): n is a, c, g, or t
  misc_feature (131)..(131): n is a, c, g, or t
  misc_feature (134)..(134): n is a, c, g, or t
  misc_feature (138)..(138): n is a, c, g, or t
  misc_feature (149)..(149): n is a, c, g, or t
  misc_feature (158)..(158): n is a, c, g, or t
  misc_feature (196)..(196): n is a, c, g, or t
  misc_feature (304)..(304): n is a, c, g, or t
  misc_feature (317)..(317): n is a, c, g, or t
  misc_feature (459)..(459): n is a, c, g, or t
  misc_feature (480)..(480): n is a, c, g, or t
  misc_feature (494)..(494): n is a, c, g, or t
  misc_feature (511)..(511): n is a, c, g, or t
  misc_feature (520)..(520): n is a, c, g, or t
  misc_feature (527)..(528): n is a, c, g, or t
  misc_feature (532)..(532): n is a, c, g, or t
  misc_feature (546)..(546): n is a, c, g, or t
  misc_feature (552)..(552): n is a, c, g, or t
  misc_feature (568)..(568): n is a, c, g, or t
  misc_feature (582)..(582): n is a, c, g, or t
  misc_feature (593)..(593): n is a, c, g, or t
  misc_feature (611)..(611): n is a, c, g, or t
  misc_feature (639)..(639): n is a, c, g, or t
  misc_feature (677)..(678): n is a, c, g, or t
  misc_feature (761)..(761): n is a, c, g, or t
  misc_feature (826)..(827): n is a, c, g, or t
  misc_feature (835)..(835): n is a, c, g, or t
  misc_feature (842)..(843): n is a, c, g, or t
cccccatggccatgggcacccgcccccactccccnattcgcgcctcttccatctgccggaaaacacctggcgtctaccctgtggagggttcgaaatccaaatcagggctcccaagtgatggaccctccaanaancagncctacagaacnagaatctcnaaaaaatgaccgtgaggggcctcagtgagaccagattntgtcatttggctccaccttcatcttgcagagccagctgttctcagattgccaagaaactagaagcaacttgcacggtgtggccagagcctcagctggatgagaggctnagatgggtggccngcttgtataccagtccctgaactgagctgtttacaggactggggaggctccacccagaaagctatcatttgtactctgctgggagtaactgggaaaaactccttccccgctgctaagtggaaagaggcctcatccggctttnacccaccatccgttgcagaancctccaggagcagnaatcctaagagtgggangcagccaanacccccnnccancaaaacctcccggnagtggnttcaggccctctagtngccatgaccaattngtgtgtgtgtntaatttttgcttcaagtnatgtagcaggacctgccccacgcacacncctacccctctttgaggagctgtgggaagtgtgggttnntctccagaacagaagagaatgatggatattctggctctggggccctctccaccaccactcacagtagccttgctgaagccatnacagatgggagaaggccatgccagccacgtccgccgaggggcgccagcctgaagctgccaggacnngaggttcngacctgnnccccatagctggaggcctgtgtgccagaagcccggattagggttggtgtccatccctggatagctatttgcacgaatcatggacata

SEQ ID NO: 663571 - DNA, 793 bp, Homo sapiens
gacactcgtgtgttgttttgcttcgtgccatcctcatgctgcgccttgtggtgggtgccgtggcccgttccgttggtggccgcgttcctgccatgtgccccttcttgttgtgggacccccccccctttgtgagatcaccgactctcccgtctagtgttgcttcacctgcgcggcggccacgacttcgttcggatcgaaggtgctccgctccgcggtctggtcatagtcccgctaccgctagtggccatcatagttggggcgtcctcgtcccgcgacgttcctcgttgtttcctggctcggtccgctttgacctcctggccgctactaatagattctctccttcttaaaaacgagcgtccctaacaatgatgttcctcacccataagatcggttctgtttgtaagcttttttgcgacccaccctgtagtatattcggcctcgctgtcccctccccgttgtgctccacacatactgggtggataatctctccttcgtggtgagaacaccacgcttcttccttgtgccgaaacactccttctttcctactttcctagacgccctctaactactactcattttttcctctcctagttcccgctctacatgtgtgccaccgcacacccagatgatgtctatctccatcccctcccccttttaccatattaaacccgctcttggacacacacaggacaccactctctcctttttatactaccttatccccctcttgcctccttttcgcttcctacccacgaacatactctacaccggtgtttcctctacaaaacaaaac

SEQ ID NO: 663572 - DNA, 839 bp, Homo sapiens
  misc_feature (397)..(397): n is a, c, g, or t
aggaacaagctccaaggtggtgggtttcaaaacaagaaggcgacggtttcttcggattggaaaaacccggcgtctggagggggcttgaagaatcactggggattgtgggacaaggactgaacaaggtgggggccttttgacgggccttcttgggtttccaggcaaagggcgtgcgcctaacaggcccttggtgtgttgccgtggggccaagcaggggaatcccggctttccccttggcacgggtttattctccttggtggtctgggtttcttgttccccgggggcattggggttcaagggaaatctcaattctggaaaagggcccttggtcaattggccttcggctccactggtttttggtggaacactgagcaaaagtctaattcccgtcatcaanggagaagtgtggcacgtgggcacggcaaatttccccggaagcaatcaaccgtctaaccaaatctgggtgggcaccttcattcccagacagctgtgaaccccaacggttagggcctaactctaagttcttgggaacaatttgcgagagtggaaagatcccagaaatggtctctgtgtcctacatacagcttctctaaggggaggctccggcaatcatggccttccaagaaactttcaatcattggtgtgaagtgggctcaacaaaaacagttaaagaaaacttataattttttgaaccccaaattaagggccgggcctggtatgaaaaaagggggccaaggctaagggattgatgttaaaagcacttatatgtgggagctgatagagggaatggaagaagtggctggtggaaacaaagtgttgggtaggcgggggggggagct

SEQ ID NO: 663573 - DNA, 986 bp, Homo sapiens
  misc_feature (985)..(985): n is a, c, g, or t
gaactcctgagcccacagaatctggcgctgggcgttccgctctccgcgcctgaccgcacctcagaactccggtaggacggggtgggtggcccccggactcaagctctgttccctggggaagagacctggatggtgcgaaccgcgcgtcgtgacccaagcgtcgggccccagcggacatccggagcccgaagcggttccccaggaaggcggcgctcgtagcgcctaactcctccctcccaggcgaatactggagaccgaggacccagggcgtctcacgccattttctccgctggggacccggctgagctcgccaatccacgcctactcgggccccaacccagcagatcacgtccttgagtcagaaactcagggtttaacatttaaggatcgtgggctgtgcgtctaggggagagaggtggtcctcagacgtgctggaacgactgcatgctgatccaattatcccgtgtggaggcttctggtccgaggctccgaacgcgggttccctgtaactcccagaactattcaatgaatgatccaggtcacaggatgataagggggaagatgggaagaaacagacgggagagccgcccagaaagactgcgggacgaaagaaatcgagaggaactgcacggcagtgagcgcctccaaaaagcctggatgaatgaattaaaactatataggccggactgggtggcatcacgccctgtaatcccagcaccttggggaggcaaggcgggtggactacctgaggtcaaggagttcgacccagctggtaacatggtgaacccggtctactacaaatacaaaatagcgggtaggaacagcctgaaaccacctggaagcaggggggacacaggcggagtcgcgcacacggcacaggaaccgcccaaacacaatcccgtgggcaccacgacgagggaacaagcgaggaaaccagcaggaggacaaaaaaaacgggcacgccaatgacgagtaaatacgtcang

SEQ ID NO: 663574 - DNA, 271 bp, Homo sapiens
gagcccttgctctgattgcccagagctagaggagcagtgggcgatgatcctagctcaacgtgcaaccctccaccctcctaaggttcagagcaatttcttctgccctcagccctccgggagtaagtctgggatctacaggtagcagccacagctacggctaaattatgttgtatttgttagtagacaatgggatatgagacggagagagccccgcggtcgcctgtcgctgtgcaggcacacaatagcaggcgccaggccgattctggaagtg

SEQ ID NO: 663575 - DNA, 362 bp, Homo sapiens
  misc_feature (294)..(295): n is a, c, g, or t
gatcgaccctgaatatccttcagtagcggctggatctcctgcgtcaccgatacgccctgctcgccatccttcacatcggcgcgcacggtgatcgccatatcgcgattacggcgccacagcaccggctcctcaagttcgtagcgcacctgtgcacttccgacaacggcaccacggtcgcttgcgggtgtagaggttgatgtccttcaacgtgtcgaggctcaggcgttctccaggcacggcgcgggcgacgatgtcgatcaggtcctcgtgctcgcgcaactgcgacagggtcgnnccattcatcacggtctgggtggccagcgatacgtcagccggcgtgagtcccagcgcgcgggccttgt

SEQ ID NO: 663576 - DNA, 144 bp, Homo sapiens
ctccagtgaggagacaggccatgtctttcaagatgcatgcagctcactgacttgtcatcctcaaagtatccgctacagtgcccacctagaagtttgtccgacgaagccttggcagaaaggcagactatcaattactcatgtact

SEQ ID NO: 663577 - DNA, 658 bp, Homo sapiens
ccgcgagaacaagcaggctggcagaactccatccgccacaatctgtccctcaacaagctgctctcgggaaggtgccgcgccacatactgactgaccctgggcaatggtgcaacatactgtgatgctggaccctgtctgatgctgacagatgtgttcatctggcgtgcaacacgtggcaagcatgctgtgctgccagctccaccacctcgcgggccaatgctggccattcaagcgctggtgctgcgcctcaacctccaccggcctcaccttcatggaccgcgcacggctccactctactaggcccatgtcgcccttcctgtccctgcatacaccccactgcgcaaagaagcacatttgaagttacaacggacaccacgtctggcctaacacaagacaccaccaatgccctaaagactccgtgttgactcagaactcgcgtgtggcaaaaaacaactcccattctccaaccgacaacggcacttgagccggtggacacggctgttcaaacggggagaaaccgatatgacacgaaaccagctcaacggacgacggcgctaagaccgacatcggatgccactgacggacaggaacggtgccctgagacagggacctaaaaccctaaaccacggctccgcaacactgaacagcgggacaacaa

SEQ ID NO: 663578 - DNA, 175 bp, Homo sapiens
tttcgtatgcgtttctgctttgggaccttttcattttgttgttgctaaaagtcacttcttttcatcattgcttcatacgacatgtagttaggacagggaataatcattcaacactccttatgcattacatgatgcaataaaccagtgtaggatatttagactatcaattgttggt

SEQ ID NO: 663579 - DNA, 1529 bp, Homo sapiens
gggtccagcgtaccagccgcggccgcgctcctccgccccgctcctcctcctacctactacctacctcctacctacctctctaggacaccccacgtacccctacactatccagctggcttgcagccaccacagaccccaagctactaccgccgctatactacctgtggacgcgcgtacctacgcaaccaatacctatatgcattacctatacctatacctataccttgctgaccgtatccaacaccacaggacgtccacgcaaccaacacacatcaatcacgagtgaatcgaccaacacacgagagcccacagaagaagaacgacagagaagaccacacgcacacaacagagacaccagaagacaacaaagacacaccaggaacgacaaacacacatagaacaacaaatcaccattgacaagtacccgcgcactgacacgtgacacctgaccagcccggaccaaacacataccgcccgcgacgcgtgcaagacaccccaaagcaccccaccgcccaaagaaagccccctcgcacccaacgcaccacacataggcaccaccacagggccctccccaacgacccatccacaccgcacacccccaaccaacgccaacccccacaagagcacgaaacccaaaacaacggacggcaagacaaaccccacccgacgacacaccacacgcaccgacacaacagacctacccgacaagggacggacctccaaccagtcggcgcgccaccacgcgcacaccgatccaaccccagcccacccacccaaagagaccacaacccccaccgcgcaccaccgcagccagaccgcacagccagcccccgcccgcccgcccactcaccacaacaccacaaacgacggcgcgacccgacgaccaccccacacccccacagcgccccgaaccaaacccacccacaaacaacccaccgcccacagacccacgatccaccggacccgccgcgacgcgagcaaacgcggccaacaccccgcgcccagccccccacgagcgcacccacaccaccgcgccagagccccccgccgcccgcgcccccccaccgcaccaccgccccagccgcacgagcgccacaccacccccacaccccacgcgcccaagcagccgcactacggcccgccaccaccccacgcacccccaggcccacccgcccgcgccccccacaggccccacgcccacccacccgcaccacccccccccgcccccggcagcgccccccgacaccccacccgacgcgcaccccgaccaaccccacgcacgcgggcagccgcgagatcaccccaccccgacccccgccggaagcacccacccccaccgcgcccacgcacccaccacaccggcccgcccccacccccaccacgcgccacgcaccagcaccgcaccgccaccgacacgccgcaccgccacagcggcgcaccagcagcccccccgcacgcgacgctacaaccgcagctggcacagagcagagcgcacccaacccaccagcgagccggacagtaccacgccc

SEQ ID NO: 663580 - DNA, 121 bp, Homo sapiens
cagcacgcccgaggaagcaaacagaaccacaggcagcgaaaggggacgaaacgaggacagcaacgcacgccacacacaagaaaagccgaacaggagacccaggcaacacacatcgggcacc

SEQ ID NO: 663581 - DNA, 193 bp, Homo sapiens
agcgcccgccctttttttggaataaaatttggaaaatggcaatgaaaaatataaaaaaaaaaaaaaaaaaaaaaaaaaaaaaaagggaaatttttaaaaaaaaataattctccccccccccttaaaatttttctcctctcccttccgttgtttttaaattaatttccctcccttttttataaaaaattccccc

SEQ ID NO: 663582 - DNA, 444 bp, Homo sapiens
ttagctacctctacgatgctgtagaaggaaatatcaaagagggacgaacaatcaacctgtccaatgcattaattgtcataatacacttgtatgacctcccattttgactccaggaaaagtgtaatgttggtacgggctcgagaaggaatctgcattctggtaactttgaccagaccttgggaatcctccccctcaatacatttaattaatgaagtgttacagcaaattctaaaaagatctaagagatttgttttcactttaagcgctgtgatcataggcctaattatagtcactgcactggccaccactgctggaatggcgttacatcaatctattcgaacggctcatttagttaacgattggcaagccaattccacccaaatgtggaatactcaacaaggcattgatcaaaaataggctaatcacattactgatttaagacag

SEQ ID NO: 663583 - DNA, 684 bp, Homo sapiens
cgtcgatgtgaatgattggcttgtcaagactgactcctgtaccaactgtacagggaaaccagcccaaaggtgtggagattgaaaacctgggcaagtctgaagtgcctgaatgaccacttggaggccaagaaaccattgtcgcacccccagtcatgtgttacagtagagattgtgcttgtccagaaccatcaggacccatgtaacggtagaggaggtgtgcagagcctaatgagcccgtgcacgaagctttgctaagagctgtgtgtgtgatgagaattgtgagaaggcaggctctgtataagtggcttctgaagaaagaaggaagggataaaaatgggatgcctgtggaacctcataagctgagcctgatgaagcatgacagattcccgtgaatatgtggctctggtccgtagaagatagaagtaatagagacaatagtagaagcaccaaaggcagtgactccttctagaattgctgattccttccaagtcataaaggaagcagtcgccgttgtcaggagtggctatatcaggctcccacatactaaatgacacggaagtgcccgaaaggaacgtgcctggtactgaagtactagagctggcaaagagaagtttacagagccccatgtaatacttcctggtgttcctttaaacacagtgactgggtcctgtcaggatcagaaga

SEQ ID NO: 663584 - DNA, 183 bp, Homo sapiens
tgcactgttgtcataccccccatccacccattccccagtcccaggcaagaatatggatgaatctcaaaaacattatactgaacaaaagatgctggactcaagagtacatactgtatgattccatttatatgaaactccaaagacaactctaatctatatagtgacaaaaggcactcatcagtg

SEQ ID NO: 663585 - DNA, 755 bp, Homo sapiens
  misc_feature (159)..(159): n is a, c, g, or t
  misc_feature (162)..(162): n is a, c, g, or t
  misc_feature (194)..(194): n is a, c, g, or t
  misc_feature (197)..(197): n is a, c, g, or t
  misc_feature (221)..(221): n is a, c, g, or t
  misc_feature (225)..(225): n is a, c, g, or t
  misc_feature (235)..(236): n is a, c, g, or t
  misc_feature (278)..(278): n is a, c, g, or t
  misc_feature (313)..(313): n is a, c, g, or t
gacgaatgcagacatgtggtacccacgtttgtgtgggaggactcatcataagtaacaaccaattctcagtaatttagtacaattcacccactgcattttcaggctaatcagtcaccctgcatataaacacctgtcaagctaaaaaaaaaaaaaaaaggntcngggacactcagacgccctggcaggtgagctgnggngagtacacggaactcagcagcaancccnccagggcacnngctgaacaccctccactgccacacgtcattctgggtcatatnacaagctgctcctagccgtgcattaaaataaaaangatgtgtagtgcacactcatagactccctggaacgacactttcaccagttcccatgagtaacaccatacactgccaccctttgagcatgggaatctgtctagtgcctcagagccagacatgtcaagatcaaacttcagacctaaacacccagacagaccctagggctcactagttttttctgttagcacccttcaaataactacaaccttgcccgatgcacaaggatatcactcagaagcttgactgttgcaagtaaactactaagtagaaaaacactcgaaactctacactcactactccttgactagaaggagaattaaacagtaattcccaagttaaatccgacaacactaccacagatcttttgccacttgagtgggactttaacttctatacccgtacatgtcctcccacacaacgtgggtaccacagttctgaact

SEQ ID NO: 663586 - DNA, 263 bp, Homo sapiens
aaatggaaaaagaactaagttttgatgtcctttttttggaggccctagatccaactgtgcctaaagcctgccctacctccgggctttaaagttttgtgagcccataaagtcccctttttgtttaagataattgaaatgaggttctgttttgattaatatagggtatttgtatttttttattgatttgtaaaaaacctttgtaatttttaattttagactttatgccctatataagtttattaaattagcatggccttccctga

SEQ ID NO: 663587 - DNA, 299 bp, Homo sapiens
  misc_feature (122)..(122): n is a, c, g, or t
agatttggagcggatcttggcgcggatcttggcgcggatcttcgccgcggatcttcgcgcggattcttcggcgcggattctcggcggcgcgacggtctgggcagtgcagtgggagttgctgngcgtcactgtcaacgtacgagtgtctaggcggctcggagacagacctccgtgagcgatggcaagctcgtgatctgatttagtacactacgacggaagcgggctcagatcttctgaccttgggtttagcaggggtgtcagaaaagtacccaggactccggcggcgagggtacgagctc

SEQ ID NO: 663588 - DNA, 416 bp, Homo sapiens
taccaccaattctaaatgccctggaagtgcaatgcatgggagaccacgactggtttttggagtgtgtgcccagcatttgggtgatgagcacagtaaggactattgctatggatggtacagaatggcttgtgtatagagtgccagaaatgtaactggattctggtagcaccaatacaaaattcctgttggtcctgagacttatgggcagaatcatgaatgtcatatggagaacctattgactgaaagaggtcccatcaaaaccaaacaatttgctcccattcatgctgaggctccagagttcatggccactgagtgttgagcaggcacaattctggtgactggtatcacggttgtcgctctgctagctccctatgccctggtggctcttgggcttttggggtgcgcgttgcagatgg

SEQ ID NO: 663589 - DNA, 1927 bp, Homo sapiens
gtacacggagactttctgaacgtgtgatgggattcccgctgaaccacttctgcaagactgactggtgaagctctactacccgacacccgatccggaggacctgcggacggagtgtcaagcactgacccctatcccggacacgcgatgacaccattcgaacgaccatcagatgactgatgtgagtgaggaggcgagatcgttgagcccgaactcagaggtgacgcaggtgtttcgccacgcagacatgatgaatggccgacggcgtcggagaagagcgatgtgaacatggcaccaacggcgaagagagactgacagtagttcaacatgtgacctacagaagagagaaccccaagacccatccagattacaccgaacacctgaccataccttgcgaagactcgaagatgactgggagcactattaaacaggaatattaccaaaagtgagacccatggactttcaaccacagaatatgcacaaacaaaacttgcaaaagggagttggtaccctgacactatattggtctcaccacagacgcaactggcacaagacacaacaccaccactaagaaacaagtagccatagcccgtggaaccttaactacgagcacacaagtgcagaaaaaagctggcgacacagcacacttcagttgcctagtattcggatgcacctcacacttggcgcagcacagcgaggacactaaacgacaggcgcaacacaacacacacagcaatagaacatgcgccacccaaaggcagacaagaccaatcccccacgtgaagagacagcgtaacaacagcatacacaacagacacacaacctagacagagcgagatcacaacacaagcgaaaacacagcccaaaccaacgaaaacgcaacccacaggcacggaacaaacgagagcaaccaccaaaacgcacgaataaaggaacaaccagtacaacgcagaacctggaacaaagaaaaaacataacacaacaatacaatggcgcaaacagcggcgaccaatacacacgagatccacaattccgcacgcacacgaaatataacaatgggcaaccaccacccacacacaagtagaagcacaaacgcaacatccacataacacacaacattaacacccattgccgacaagacatcttcacggaccacatcatcacacaggacataacggcaacacaaacatacaagaaccacccagaccaaaccaacaagcacgggtgacagcagatatacgaacagacgacaagcaaaacaacggccagtaacccacgaacagacacagacaaaccccacaaggacccaacatgacaacaacaaagaacaaaaaagctccagcagcacaaaacccaggaaaacagaaaaaaaaaacaaaagaaagacgaccaacaagaacaacaacaccatgcaacacgtacacaaaccaaaccaaggagaaaaaccaacaggagaaaccacacaaaacaaaccacaaaccaagacacaccgaacacccacacaacagacaaccaagacaaaaacaaaaaaaaaagacacaggacgatacaaacagccaaacgaacgagaacagagacgagaaacgcgaataggagacgggctgacagctacactagagcaacagcaaaaagataaaaagacatgagcgacgacagaaaccacgaacagagaacggatccaagaagcagagaacatacaacatcacagagtgcaacccaagagacaccaccaccaacacagagacacgacaagagcaagccgaaccaacacagacgagaaaacagaccacgcacgaccacaaggaggaggacacacaacagaagacaatacggcacatacacttaacagacgcgcagcagcctatagcacgagacataatcagacacagacagacgaacacagcacacaagcaactggcaagagaaaaac

SEQ ID NO: 663590 - DNA, 393 bp, Homo sapiens
acgcgagaatggccattgagtcgaacttcaggatgatccagtattttaataaagcttatgttgatgattaaagtctgccttgaagtggctggtctcgtcaaggagactaaagtacattcatttctctttctttaaaataaatccaattacagatacttggaacacccagtcctgatttgctcttttattatagtcttctatgtggacactttttagcatagccctgcttttattttatccctgcaggaaagactaggagagggaggacacctgttctttggagcaggtaatagaaagtatcatggatccacatcaagtaaagagaatataggttagaaaaaaaaaaagtcgcccaggtaaatggcttggcaaatgtgtggggaaaatggattt

SEQ ID NO: 663591 - DNA, 623 bp, Homo sapiens
  misc_feature (90)..(90): n is a, c, g, or t
  misc_feature (92)..(92): n is a, c, g, or t
  misc_feature (101)..(101): n is a, c, g, or t
  misc_feature (103)..(103): n is a, c, g, or t
  misc_feature (108)..(108): n is a, c, g, or t
  misc_feature (113)..(113): n is a, c, g, or t
  misc_feature (118)..(118): n is a, c, g, or t
  misc_feature (153)..(153): n is a, c, g, or t
  misc_feature (164)..(164): n is a, c, g, or t
  misc_feature (226)..(226): n is a, c, g, or t
  misc_feature (466)..(466): n is a, c, g, or t
  misc_feature (551)..(551): n is a, c, g, or t
  misc_feature (574)..(574): n is a, c, g, or t
tagattcatactcagagtttgaattctaaatctccatcgagcatcctgactttccaaaagccagccataaatcatatttctcttggaacnangcaggccananatgtncttancagcnacatctcttcccttcagtaatcaaggaaagagaanaattagtttanatgtagaacagaatttcaattaataaaatgtcatcggccaggcgcaatggctcatgtctgtnatcccagcactatgggaggccaagacgggtggattgcctgaggtcaggagttcgagaacagcctggccaacatggtgaaaccctgtctctactaaaaatacaaaaaaaattagttggatgtggtgcatgcctgtaatcccagctactcgggaggctgaggtcagaagatcacctgagcctgggaggtcgaggctgcaatgagccatgattgaaccactgcactctgtctgggtacccagngtgagaccctgtctccaaacaacgattttagagaagatacatgttttatataatcaaatacaacttttcctaataaccacatganaatttcagattttccccattcangtgtagtctgaaaatagcctttttttttcttgactggaaaagccatcga

SEQ ID NO: 663592 - DNA, 180 bp, Homo sapiens
tgctgggattacaggcgtaagccaccaagcccggacatctgaggtcttatttacaactgcaaaatgttaaataagaattctgattcccatccaatatgacattcatttaaattgaactttaataataaatgatgtgcacatatttcgaacacgatagaaaatgaaatctcgccagagttc

SEQ ID NO: 663593 - DNA, 163 bp, Homo sapiens
  misc_feature (137)..(137): n is a, c, g, or t
tgcgaagttaggagcggcttgtttggctccctttcgtgttttccgcggaaatatgtttctgcacatactgcacacaggtgtcctccaggaattcccgcatgttcatacgctgatgtgcggttgtagtgcatatgatngctgctcgcagggtgaagtgtgacca

SEQ ID NO: 663594 - DNA, 183 bp, Homo sapiens
ataaggaaaggttaaaaaaagtaaaaggaactcggcaaattttaccccgcctgtttaccaaaaacatcccctttagcatccccagtattaaaggccccccctgcccagtgacacatgtttaacggccccggtaccctaaccgtgcaaaggtagcataatcccttgttccttaagtaggggcca

SEQ ID NO: 663595 - DNA, 441 bp, Homo sapiens
ggatagcacggtgctatagtgtataataatgtatgtatacttgaaatttacaaagagagtacgtcttaagtattctcaccacaacaaaaaaggtaactatgtgaggtgatgaagatgttaactaacttgattgtggtaatcttgtcacaatgtacacacatgtcaaaataatcaagttgtataccttgaatgtaaacaatttttatttttcgattattcttcaataaagctggggaaagaaaatctcattattgtggtttttgttttgtctttttttttttttaaaaatgcagtctgcctctggtcacccaggcgtggagtgcaggggattgatcaaagctgatgtgcaacctcgtgcctcccaagttcaagccattctcctccctcagcctcccaagcatcgggaactacagatgcccaccacggggctaatctcaaccg

SEQ ID NO: 663596 - DNA, 130 bp, Homo sapiens
taggatacagttttctaggtctctttatatagatctgatactgaaagcaggaaaaattacatatacaaggccacaatccaaaatctggattagtatttagagactgaaaatgatattttcctctatgaaa

SEQ ID NO: 663597 - DNA, 538 bp, Homo sapiens
  misc_feature (9)..(9): n is a, c, g, or t
  misc_feature (118)..(118): n is a, c, g, or t
  misc_feature (146)..(146): n is a, c, g, or t
  misc_feature (165)..(165): n is a, c, g, or t
gagagctanttctgcaccacagcacagtcacatgtgactccttgagtctgcagcactcttatacacactgtattctaattttatcatcctgtatcattctaggtgtcagaacatctgnagtatagatacatttttactaatgatgnccttagccattatatattntgctctgtttccaaactacatagacacaccctgtagttacttatctatgactgtttcaccctctaggtcacaagttacttaaggccagggaccctgtcttattacttcttacctttcatagctataatgcccaattttaaatctaactttatcactataatttcaatttctaatacaacaattgttataatgtcataacaaagaaaacttgccccaacgatattcgtagaatttttatatccttagcatttaccgtaaatgaaaaacatagtaacaaatgcctataatcatataaatgaccttctcagaaaaataatgtttcactttttcctcatatagtgactggtaaaatgtaaaatatgaacaagcaaaa

SEQ ID NO: 663598 - DNA, 212 bp, Homo sapiens
acggcttcaactggaactttaggaggctgagttgggaggatcgcttgaccccaggagttcaggaccagcctgggcaacacagtgagacctcaactctacaaaaagatttaaaattagccaagcatagtggtacgtaccttttgttcccaggtactggttgggcagggtgaggtgaaacggatcacttaggcccaggtagtcgaggcttcagt

SEQ ID NO: 663599 - DNA, 175 bp, Homo sapiens
tgtaggacagcaatctcatcctctgctggtgatgggaacagaatgatggccctcagcagtgtaccaccccaacaaggaggccagcaacaacaaggtccaccacctcctcagtgaaagccacaaggaccaccccaacaggtaggccatccccctcctcctcaaggaggtgcgacgg

SEQ ID NO: 663600 - DNA, 109 bp, Homo sapiens
ccccaataataagaaaatgattattcttggctgaagcgttgaaagaatcatgcactcttcgcgccactatctaatgaaatgacttcccaatgtaatgtatttattacag

SEQ ID NO: 663601 - DNA, 209 bp, Homo sapiens
gactgataaaggcatgaggatgtggcctgcatgctgcctgatcttgcctagaaccagctgcacctgctgttctcttgcttatgcaaactggctgcacctgctattcctttgcttatgccccaacccttggctatcctaactccctgttctcctgcctattactgtattctctacttctaaataaaaataaaacaaaatacaaattaaaa

SEQ ID NO: 663602 - DNA, 438 bp, Homo sapiens
ctaacgcttatacttcctggcactgtagagcccagtctcatcttgtactttacctgccccaaccctaaaatcagccatttctccaaggtgtcctggttccttctgttggagaagagtattggaaaccactatctggtttctaaatgagcttgatgcactcattactgctagggtatcactgcttctaggccctctcaggggatagttaggaagtaatatatatatatactgacccacacatatcttcgtttacttccgtatctgtctgtatataaatataaacatgagtttatactgatatctctgatgctgatccagcaccacagagttcattctagcattctcttccttgcttctttctctgaaagtgagaaatttggctgatttaatgaataatacatgctaattttttcaactctaatatatatatgaagtata

SEQ ID NO: 663603 - DNA, 377 bp, Homo sapiens
  misc_feature (6)..(6): n is a, c, g, or t
  misc_feature (98)..(98): n is a, c, g, or t
  misc_feature (127)..(127): n is a, c, g, or t
  misc_feature (227)..(227): n is a, c, g, or t
  misc_feature (305)..(305): n is a, c, g, or t
  misc_feature (335)..(335): n is a, c, g, or t
  misc_feature (374)..(374): n is a, c, g, or t
tggaantggcgaaaaggtgcatgtcccctggaaggagcatctctaccaccctggaatctgggctgtcccctccagtggccatcttctttgttatctanactgacccaggctggaaagtggcgaatanagtgtgtgcccaaggagccccactcattccaaagccggctgcccctgccagagccatggcggggtcttcgggacgaggccctggaccaggtcagtggganccctggctgcatcttcgtccatgcaagcggcttcattggggtcaacccgccgagagggtgccttgagcatggcccgtncaccttggcccagcggctcatacctcccanaaatctcctagtctaataaaaccttccatctcattcttnaaa

SEQ ID NO: 663604 - DNA, 588 bp, Homo sapiens
atagagcatcatgaaaagcagcagaaatgatgaaccaataaaggacaaaaatggggagtcaaagaatcttgcttcctttgagtttatgacttctgatataagtgcaaaagaagagctagtttggcacccggttaaatcaagcacttctttggactttctggagctaaattacagtttagacaaaaatgctgacacaaccatgaaatggcagacaaaggcatttccaatagttggggagcctcttcagaagcatcacagttgggattggggctctcttttgttggagggatgtactaattctcagcctgtaaatgcagcaggccgatattttaattcaaaggtgccaataacacggaccaaatcaactccttttgaattgatacagcagagagaaaccaaggaggtggacagcaaggaaaacttttcttattgggaatctcaaccacatgattcttgttttgtagagatgccggctcaacaagtaatgcatgtttcttcaacagaactgaattattcactggcatatgactctaacacacgaatacgtactgcctctactgtaacgccccatgactctagtgctcttgg

SEQ ID NO: 663605 - DNA, 611 bp, Homo sapiens
gacagttgttccatggaataagggaagggggagtgtagagcagtagcatgaagcctgagccagatggagagcccaacgcattcaactctcgccaggacatgacttggtcgtcatcggatgacaacacagctgctggtccttctagtgtgggtggcgagttagatatggggaggcatccatgacgaggattgcatgggccatgacatgagcggatctcaagtgtctgcattgaatcgccaagcaccacaacggaaagagccaggccccgaggacaagttgcatgagcagtgtcgaccctggaggaagaatgcctgctgttctaccaacaacagccaggaagcccataaggatgtttccctacctatatagattcaactggaaccactgtgcgagagatggcacactgcctgcaaaccggcatttcataccaggacacctgcactctacgagtgctcccccaacttgcgggccctggatccaggcaggtggaatcagagctggcgcaacatgagcgggtactgaacgtgacccctgtgccaaagaggactgttgagcaatggtggcgaagatcgtcagcacctcctacacctgaaagagcaatggcacaaggc

SEQ ID NO: 663606 - DNA, 422 bp, Homo sapiens
ctcaaagaggaacctgaccatttccactctagacactggttgccagaaactgattgaacatgccgaataccgcaaactacgaactttcaatgagaagcgcatggccacggacgaagctgccgacgctctgggaagaacatggaagggatatgtcgcactaaggcaaggcggcaactacagacgcggtttccgcactaagcatggactgttgacccatggcagcgaacagccgttactgaaatagaggcaaactgtgatacaaccatcgagcactggacacagaatataagaatggctcgtgaatgcactagcaaggctgaaccgaccgaactgaacttgattattgtggacagaagggtattcctggactgactgattctacactgcctcaccgtcttgtacccagacgagtttgcagtctc

SEQ ID NO: 663607 - DNA, 777 bp, Homo sapiens
  misc_feature (650)..(651): n is a, c, g, or t
  misc_feature (777)..(777): n is a, c, g, or t
gtaaaccatagcaaactaaaggagcatgctataacaagatgaatgggctgggcgcagtggctcatacctgtaatcccagcactttgggaggccgaggtgggtggatcgcctggggtcgggagttcaagaccagcctgaccaacatggtgaaatcctgtctctattaaaactgtaaagattggtcgggcctggtggcgggtgcctgtaatcccagctactcgggagggctgaagcaggagaattgctggggcctaggaggcggaggttgcagtgagccaagatcacgccattgcattccagcctgggcaacaagagtgaaactccatctctaaataaataacgtaaatacatagatgaattttctcctaaaccaaatggaacaagcttctgtgtactcacaattggagcagagctacctttggctacacagtgccttacgagcagatttttggaaccaattgtgcacagggtccaggcgtaaacacatggactttcccaggaggaaagattgtggcgcccctagtagtcaacacttggagcgtacaaaacagcgctgcagcatgttggccacagaaaagtttttcttctctttcctttggtgggtcccttctcgtaagctctatgatcgacgtatgtacgtagtcttgtcnnagtgacgcggagacaagcagatcaccgtaggcggtaggagcgagagacaggatgtgggaagagcaggcgcgtgagacagagacgcgaggcaagcagggaagcggcacaaggcagacgagcgcggcn

SEQ ID NO: 663608 - DNA, 98 bp, Homo sapiens
agagaaaaactaggctaggtacgaggcgggggtgaatcggccgaggggagagtacggcagggcagcgctgcgcggggcctggggctgacccgtctgac

SEQ ID NO: 663609 - DNA, 132 bp, Homo sapiens
aaaaaagaaaccaaattaaacggggtttttggggcccaggttttggacaaacaaaaacggccggggatttaaaaaattgttggttttcaaaaaggaaagcagtttttttaaaaccaaccccaaaaaagggga

SEQ ID NO: 663610 - DNA, 2675 bp, Homo sapiens
ggccgccctggcccgcccggccccggggaacctagagtcgcaggcgcgtcttgaaggacggaattcggcgtcggactctgcgccccgcgtagttccggtggcgactgcggcgcatggcggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtggtgtaggggtttgttttgagtgcagagcctttccaggacttctgttgtcagagaaccctggagttggtctgtccctggctggtccaaggatttgtagctgttgtgaaggtgtgagaccatcagataggcaaaagaccccgttcgttttctgatgaaatgttctctctttcagaagagagagagaggtgcatttagaaaatatgcaataaattgaagtgagtgttcaaagtattgtagaaggaatattgtactcagtctttaggattagattaagtggctgttggtaacaaagattagtggagaagctgtataatcgtacactggttttcacttttgaaaggaatccctgtcaaatggtttagtgcttaatgctgttatgtcatattgccctaatctctatttttgataaaattggataaggagtgaaagagtatgctgaccacctatgttagaggaagtacagaagatgcaggggtgtggtatccctgggtccagtccctcacctggtacctttgtgcatgttgccttcattcctgagcaggtatcatcctcagggaaccagcatggcacctaccaggccaggctctgttcttaggagcaaggagcttcttgcgctaacagttctggcctgagacctggattgagccttggcagacttcttgtctaaatgttggccattcagtctcaggccctctgttccatggaattgggaatctccaggtgacctaatcctcattggtggcttgatgtttgctggtatcttccaaactcagttcccagactagattgatacctggagcccagctgcctactcagcatttccacttgggtgcttcataggcatttcaaacctgatgtgtttaaaacacttgattaggctccggttttcctttggcttctgcttttcagtgaatggcatgactgcctatgtgggtggcaagccacccaggtgccgaggaaagagactgagggcacgagctgttccagtataataaaatatataaaataagaagagttatactagatctagatcatagacatgattatatgtgagtatcattaatcattagtttatagcaattactctttattccaatattataataatcctcactctacaatcataacctaggaaaaaccaggccatacagagataggagccgaggggacatagtgcgaagtggccagaagacaagagtgtgagccttctcttatgcctggacagggccaccagagggcttggtctagcagtaacaccagtgtctgggaagatgcctgttgcaaagtggaccatggtctagcagtagcatcagtgtcaaggaaaaacacccactacttagcagactgggaaaaggagcctccctttccccgggggagtttagagaagactactcctccacctcttgtggagggcctgacatcagtcaggcccgcccgcagttatccagaggcctgtctccctgtgatgctgtgcttcagtggtcacgctcctagtccgctttcatgttccatcctgtatacctggctctgccttttagatagcaggagcaaattagtgaaagtactaaatgtctgatatgcagaaataatggcataagctgtctctctctcttctctctctctctgcctctgctgccaggcagggaagggccccctgtccagtggacacatgacccatgtgaccttacctattattggagatggttcacattccttaccctgcccctttgtcttatatccaataaatatcagtgcagcctggcatttggggccactactggtctccgcgtcttggtggtagtggtcccccaggcccaggtgtcttttctttt

SEQ ID NO: 663611 - DNA, 896 bp, Homo sapiens
caggctgtaccggtcggagagtgtatggatcgactgcggcgcatggcggtgagcggtgtggagaagacgcgcgggtggctgggccttgcattgttggcggctctcggtgaccctcgtgctacccccctttctccaggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcaagggcgggcttcggtcgggaagggtggaatccacgggtgcgaatccacgggcacgtgtgatctggggtccgcggagttaaggcggggaggggcatgggatggggccggcggctatggttttccagtgccctctcacagccacttccccaaatccatcacaggcacaacagttggcccaggaattggcttggtgtgtggagcaactggagctgggcctcaagaggcagaaacccaccccgaaacagaaagggacccttctgtagagctgggggatgtgaacagtggcactgcctggccttgcaggtgctgggcagagtatggagttggtggggctttgcggcggggtggtacagaggtccgtaatagagggtgtccctaagtccttaatttaattcgcagaagaagcaggcattggaagcaatcgaaacccgggcagaaaagacgc

SEQ ID NO: 663612 - DNA, 289 bp, Homo sapiens
caaagccagagcaggcattttcacatggctggagcaggaagaagagcgagtgagggaggaggttccacacacttttaaacaatcagatctcacaagaactcaggacaggggcaagggggaaatctacctccatgatccaatcacctcccccaggccccacccctaacattggagattacaagatgacatgagatttgggtggggacatatcagccactatagtgggaaaggtgatgaacagaattagttaagataagcagtgctcctttatgatggaagcataagcaac

SEQ ID NO: 663613 - DNA, 473 bp, Homo sapiens
  misc_feature (73)..(73): n is a, c, g, or t
  misc_feature (79)..(79): n is a, c, g, or t
  misc_feature (85)..(85): n is a, c, g, or t
  misc_feature (105)..(105): n is a, c, g, or t
  misc_feature (111)..(111): n is a, c, g, or t
  misc_feature (350)..(350): n is a, c, g, or t
  misc_feature (440)..(440): n is a, c, g, or t
tatgttagaggaagtacagaagatgcaggggtgtggtatccctgggtccagtccctcacctggtaccttttgnatgttnccttcnttcctgagcaggtatcatcntcaggnaaccagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccgggtactccctgcgcgtcccgcggagcccggcttccnggcccagtttccagcgcccggaatccttccactgtctgtctctgcccagagcaacctacgtgcagtaacgctgactccagagcgcacccnttgggcgatgaaggcggcacagcgtcgtaaaaa

SEQ ID NO: 663614 - DNA, 548 bp, Homo sapiens
gttctgtatctgtgaaaaaataaatttcttataaaactcggaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaagaaaaaaaaaagcaaaaaaaaaatataaaaaaatagaaaacaataaaaaataatgatgcaaaaaaaaaaatcatcaacaacgtaggggacggattcatagaagtcgtactcgatgtagtcgtcgcgaacccagaacaggacagcgacaataattgcccattccgaatggtgcccgcttggcccaaaccgaatattcgctggtgaaaccgaatgcacgtcccaaagagccatacaatggtacccaacacggcaacaacgtgcgcacgcacaaactgagtaaaaccacaagattacaacaacgaaagagagagagcagtaagtaatgcaggaaagcagacacaaaattgcgttagacgggcacgcctccgaaactcctgaggtgcactaacaacagcacgcaacgac

SEQ ID NO: 663615 - DNA, 3343 bp, Homo sapiens
ggccgccctggcccgcccggccccggggaacctagagtcgcaggcgcgtcttgaaggacggaattcggcgtcggactctgcgccccgcgtagttccggtggcgactgcggcgcatggcggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtggtgtaggggtttgttttgagtgcagagcctttccaggacttctgttgtcagagaaccctggagttggtctgtccctggctggtccaaggatttgtagctgttgtgaaggtgtgagaccatcagataggcaaaagaccccgttcgttttctgatgaaatgttctctctttcagaagagagagagaggtgcatttagaaaatatgcaataaattgaagtgagtgttcaaagtattgtagaaggaatattgtactcagtctttaggattagattaagtggctgttggtaacaaagattagtggagaagctgtataatcgtacactggttttcacttttgaaaggaatccctgtcaaatggtttagtgcttaatgctgttatgtcatattgccctaatctctatttttgataaaattggataaggagtgaaagagtatgctgaccacctatgttagaggaagtacagaagatgcaggggtgtggtatccctgggtccagtccctcacctggtacctttgtgcatgttgccttcattcctgagcaggtatcatcctcagggaaccagcatggcacctaccaggccaggctctgttcttaggagcaaggagcttcttgcgctaacagttctggcctgagacctggattgagccttggcagacttcttgtctaaatgttggccattcagtctcaggccctctgttccatggaattgggaatctccaggtgacctaatcctcattggtggcttgatgtttgctggtatcttccaaactcagttcccagactagattgatacctggagcccagctgcctactcagcatttccacttgggtgcttcataggcatttcaaacctgatgtgtttaaaacacttgattaggctccggttttcctttggcttctgcttttcagtgaatggcatgactgcctatgtgggtggcaagccacccaggtgccgaggaaagagactgagggcacgagctgttccagtataataaaatatataaaataagaagagttatactagatctagatcatagacatgattatatgtgagtatcattaatcattagtttatagcaattactctttattccaatattataataatcctcactctacaatcataacctaggaaaaaccaggccatacagagataggagccgaggggacatagtgcgaagtggccagaagacaagagtgtgagccttctcttatgcctggacagggccaccagagggcttggtctagcagtaacaccagtgtctgggaagatgcctgttgcaaagtggaccatggtctagcagtagcatcagtgtcaaggaaaaacacccactacttagcagactgggaaaaggagcctccctttccccgggggagtttagagaagactactcctccacctcttgtggagggcctgacatcagtcaggcccgcccgcagttatccagaggcctgtctccctgtgatgctgtgcttcagtggtcacgctcctagtccgctttcatgttccatcctgtatacctggctctgccttttagatagcaggagcaaattagtgaaagtactaaatgtctgatatgcagaaataatggcataagctgtctctctctcttctctctctctctgcctctgctgccaggcagggaagggccccctgtccagtggacacatgacccatgtgaccttacctattattggagatggttcacattccttaccctgcccctttgtcttatatccaataaatatcagtggtggccccgaatgtctggctgcgctgatgtttgctggatgcagagcaaggggggcggggtggggagtgtgagtcatctccggtgattgatggggtcacgcgggtcgcgtttccaccggacggggggcccctccctgtttggcggcccaggtggagagagagaggaggcggcttatgccattgtttctgcatttcggagacttttggtgcttttactgattttgctgctgctgtctggagggcggggccgggtgtacagagtggagcaggagggtgaaatgggggcgtggccgctgaagcacagcatcgcggggagccggttaggcctccggataactgcgggccagcttggctggtgtcgggccttccacaagaggtggaggagcagagtcttctctggactcccgcggggaaggggagactccctttcctggtccgctgggtggcgggtgtttttccttgacactggggctgccgctggaccatggtccacttggcggcgggcgtcttcccggatgctggcgttgccgctggaccaaggagcccttctgctggccctgtccgggcatgacaggggcctcgcactcttgtcttgtggtcacttctcactgtgtctcctcggctcctatctctgtgtggcctggtttttcctgggttgtggttgtggagcgaggattattgtagtgttgggatggagagtggttgctgcagactaatgattgatgatattaatatataatcatatct

SEQ ID NO: 663616 - DNA, 297 bp, Homo sapiens
acaaaggcatccaggccacctctagcccaggctgtggagggcccagtgagaatgtcaggaagctgtctcgtgcagacttgaccgattacctcagcacacatttccagggccccttcgattggtgctggcagcagcttggatcatggagtgtaccaccagcaacttgttagcacctcgccccaaaagcaccttcggttggattcccattggccattttgcacgatgacgcttgtgcccacctcttactccattgccgttttcactgtggcagttgagacccggccaccggtgatgatg

SEQ ID NO: 663617 - DNA, 3360 bp, Homo sapiens
caggctgtaccggtcggagagtgtatggatcgactgcggcgcatggcggtgagcggtgtggagaagacgcgcgggtggctgggccttgcattgttggcggctctcggtgaccctcgtgctacccccctttctccaggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtggtgtaggggtttgttttgagtgcagagcctttccaggacttctgttgtcagagaaccctggagttggtctgtccctggctggtccaaggatttgtagctgttgtgaaggtgtgagaccatcagataggcaaaagaccccgttcgttttctgatgaaatgttctctctttcagaagagagagagaggtgcatttagaaaatatgcaataaattgaagtgagtgttcaaagtattgtagaaggaatattgtactcagtctttaggattagattaagtggctgttggtaacaaagattagtggagaagctgtataatcgtacactggttttcacttttgaaaggaatccctgtcaaatggtttagtgcttaatgctgttatgtcatattgccctaatctctatttttgataaaattggataaggagtgaaagagtatgctgaccacctatgttagaggaagtacagaagatgcaggggtgtggtatccctgggtccagtccctcacctggtacctttgtgcatgttgccttcattcctgagcaggtatcatcctcagggaaccagcatggcacctaccaggccaggctctgttcttaggagcaaggagcttcttgcgctaacagttctggcctgagacctggattgagccttggcagacttcttgtctaaatgttggccattcagtctcaggccctctgttccatggaattgggaatctccaggtgacctaatcctcattggtggcttgatgtttgctggtatcttccaaactcagttcccagactagattgatacctggagcccagctgcctactcagcatttccacttgggtgcttcataggcatttcaaacctgatgtgtttaaaacacttgattaggctccggttttcctttggcttctgcttttcagtgaatggcatgactgcctatgtgggtggcaagccacccaggtgccgaggaaagagactgagggcacgagctgttccagtataataaaatatataaaataagaagagttatactagatctagatcatagacatgattatatgtgagtatcattaatcattagtttatagcaattactctttattccaatattataataatcctcactctacaatcataacctaggaaaaaccaggccatacagagataggagccgaggggacatagtgcgaagtggccagaagacaagagtgtgagccttctcttatgcctggacagggccaccagagggcttggtctagcagtaacaccagtgtctgggaagatgcctgttgcaaagtggaccatggtctagcagtagcatcagtgtcaaggaaaaacacccactacttagcagactgggaaaaggagcctccctttccccgggggagtttagagaagactactcctccacctcttgtggagggcctgacatcagtcaggcccgcccgcagttatccagaggcctgtctccctgtgatgctgtgcttcagtggtcacgctcctagtccgctttcatgttccatcctgtatacctggctctgccttttagatagcaggagcaaattagtgaaagtactaaatgtctgatatgcagaaataatggcataagctgtctctctctcttctctctctctctgcctctgctgccaggcagggaagggccccctgtccagtggacacatgacccatgtgaccttacctattattggagatggttcacattccttaccctgcccctttgtcttatatccaataaatatcagtggtggccccgaatgtctggctgcgctgatgtttgctggatgcagagcaaggggggcggggtggggagtgtgagtcatctccggtgattgatggggtcacgcgggtcgcgtttccaccggacggggggcccctccctgtttggcggcccaggtggagagagagaggaggcggcttatgccattgtttctgcatttcggagacttttggtgcttttactgattttgctgctgctgtctggagggcggggccgggtgtacagagtggagcaggagggtgaaatgggggcgtggccgctgaagcacagcatcgcggggagccggttaggcctccggataactgcgggccagcttggctggtgtcgggccttccacaagaggtggaggagcagagtcttctctggactcccgcggggaaggggagactccctttcctggtccgctgggtggcgggtgtttttccttgacactggggctgccgctggaccatggtccacttggcggcgggcgtcttcccggatgctggcgttgccgctggaccaaggagcccttctgctggccctgtccgggcatgacaggggcctcgcactcttgtcttgtggtcacttctcactgtgtctcctcggctcctatctctgtgtggcctggtttttcctgggttgtggttgtggagcgaggattattgtagtgttgggatggagagtggttgctgcagactaatgattgatgatattaatatataatcatatct

SEQ ID NO: 663618 - DNA, 1092 bp, Homo sapiens
  misc_feature (1)..(1): n is a, c, g, or t
  misc_feature (680)..(680): n is a, c, g, or t
  misc_feature (806)..(806): n is a, c, g, or t
  misc_feature (939)..(939): n is a, c, g, or t
  misc_feature (943)..(943): n is a, c, g, or t
  misc_feature (985)..(985): n is a, c, g, or t
  misc_feature (989)..(989): n is a, c, g, or t
  misc_feature (1009)..(1009): n is a, c, g, or t
  misc_feature (1077)..(1077): n is a, c, g, or t
  misc_feature (1080)..(1080): n is a, c, g, or t
nttcagaccaacataacggattgggtacatgaaaatacatggaagggttgcagtatccacattctcttacagatagtaagaaaggatacgcctcttcgggggatggagaaggatatgcacatcgcccagacgaacgaccacgccaacagacacacccgagcgagcgcacgcccacactgagcgcctactgaggaaacatcccccgaatgacgccccccaaccaccacaagaccggcgatattttgagacaacaggacactagaccaccggcacggcacgcaccccgccgctactacctcacaacccacgcccaggagaggccagagagcatccgcggaacaccatccggaagacgcagaccaccgccggctcgcagcggtcagagtcagccgatgatacggttaccccgctcgccacccgaacctcagaccccgagacgagcaaagacatcgcgttcacctcacatcaggcacgccgctgctccgcgcacccaaagtacatcggtatcccgagaggtcgaataaaggatcagaatagtacgagtagatgcattcccagccgcacaacccgcactcgcgcgcgacccgacaagccacgaacgcagacactacgaagacgcgagaacctcgacgctgacttaccctgaccgagaacgaataagagaggaggagacgcaaagnacatacaaccgcagaaaccccaggcgaccagcacacgacccgaccgtgacgcgactccgtgcacgagcctggccgagcaagaggatagtagaggcacgtatgcagagaagaagcggcgacagagtnatagtccgaggacacgcgcaccacagcgcggacaggcgagctcgcggacactcgctctccagtaacactatacgcgcagagcattatgaggattatgacgacagacgtgcgtgtacgagacgcatcgtacgantagnactgacatcgcgcgagtcaagtactatatgcaacgcgaccangcancacacgacagcgcgcatgcnccgccatagacacgcagtcgcgcacgacctatgcatcaagtgccagagatacgtacagctatacatangcntatgaaagtatc

SEQ ID NO: 663619 - DNA, 433 bp, Homo sapiens
tgcgtccggttacgtggcttatcttgtatcccagcactttgggagccgaggtaggagaattgcttgaacccaggaggtggaggttgcagtgagccaagatcgcgccattgcattccagcctgggtgaccagagagaaactccggctcaaaaagaaagaaagaaagaaaaacagccgggcacggtggctcatgcttgtaatcccagcactttgggaggccgaggcgggagaatggcgtgaacccgggaagcagagcttgcaatgagccgagatcgcgccactgcactccagcagggctacagagcgagactctgtcccaaaaaaaaaaagaaagaaaagaattttgattctctgaccagtatctctcaggttgctgcttcaagccacggtcaacccacaagccacggtcaacccacaagccacggtcaacccac

SEQ ID NO: 663620 - DNA, 1084 bp, Homo sapiens
ggccgccctggcccgcccggccccggggaacctagagtcgcaggcgcgtcttgaaggacggaattcggcgtcggactctgcgccccgcgtagttccggtggcgactgcggcgcatggcggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtggtgtaggggtttgttttgagtgcagagcctttccaggacttctgttgtcagagaaccctggagttggtctgtccctggctggtccaaggatttgtagctgttgtgaaggtgtgagaccatcagataggcaaaagaccccgttcgttttctgatgaaatgttctctctttcagaagagagagagaggtgcatttagaaaatatgcaataaattgaagtgagtgttcaaagtattgtagaagg

SEQ ID NO: 663621 - DNA, 319 bp, Homo sapiens
  misc_feature (76)..(76): n is a, c, g, or t
  misc_feature (80)..(80): n is a, c, g, or t
cttcccgcatctaaagaagtccaggtcttactcctagaggccacatgcaagagaactgaggcatcccagctgacanccancacgcgcgggggggcgtgtgagtgaactttcctagaatacgaccctccagctcccatcaatcaagactgaagatgatatagccctggacagtgcggcttgactgcagcctcatgagacacccagagtcagaccacccagctaagctgctcctggatttctgagcggggagaaactatgatacaataaatatttgttgcaagccactaaaaaaaaaaataaaatgggctcgttggcctca

SEQ ID NO: 663622 - DNA, 2597 bp, Homo sapiens
gcggaccgaaactcgcgcggtgacatggtgagccatggccagggtacaaagtgatcctccatcttaaagaagatcagacagagtacctagaagagaggcgtaggggtttgttttgagtgcagagcctttccaggacttctgttgtcagagaaccctggagttggtctgtccctggctggtccaaggatttgtagctgttgtgaaggtgtgagaccatcagataggcaaaagaccccgttcgttttctgatgaaatgttctctctttcagaagagagagagaggtgcatttagaaaatatgcaataaattgaagtgagtgttcaaagtattgtagaaggaatattgtactcagtctttaggattagattaagtggctgttggtaacaaagattagtggagaagctgtataatcgtacactggttttcacttttgaaaggaatccctgtcaaatggtttagtgcttaatgctgttatgtcatattgccctaatctctatttttgataaaattggataaggagtgaaagagtatgctgaccacctatgttagaggaagtacagaagatgcaggggtgtggtatccctgggtccagtccctcacctggtacctttgtgcatgttgccttcattcctgagcaggtatcatcctcagggaaccagcatggcacctaccaggccaggctctgttcttaggagcaaggagcttcttgcgctaacagttctggcctgagacctggattgagccttggcagacttcttgtctaaatgttggccattcagtctcaggccctctgttccatggaattgggaatctccaggtgacctaatcctcattggtggcttgatgtttgctggtatcttccaaactcagttcccagactagattgatacctggagcccagctgcctactcagcatttccacttgggtgcttcataggcatttcaaacctgatgtgtttaaaacacttgattaggctccggttttcctttggcttctgcttttcagtgaatggcatgactgcctatgtgggtggcaagccacccaggtgccgaggaaagagactgagggcacgagctgttccagtataataaaatatataaaataagaagagttatactagatctagatcatagacatgattatatgtgagtatcattaatcattagtttatagcaattactctttattccaatattataataatcctcactctacaatcataacctaggaaaaaccaggccatacagagataggagccgaggggacatagtgcgaagtggccagaagacaagagtgtgagccttctcttatgcctggacagggccaccagagggcttggtctagcagtaacaccagtgtctgggaagatgcctgttgcaaagtggaccatggtctagcagtagcatcagtgtcaaggaaaaacacccactacttagcagactgggaaaaggagcctccctttccccgggggagtttagagaagactactcctccacctcttgtggagggcctgacatcagtcaggcccgcccgcagttatccagaggcctgtctccctgtgatgctgtgcttcagtggtcacgctcctagtccgctttcatgttccatcctgtatacctggctctgccttttagatagcaggagcaaattagtgaaagtactaaatgtctgatatgcagaaataatggcataagctgtctctctctcttctctctctctctgcctctgctgccaggcagggaagggccccctgtccagtggacacatgacccatgtgaccttacctattattggagatggttcacattccttaccctgcccctttgtcttatatccaataaatatcagtggtggccccgaatgtctggctgcgctgatgtttgctggatgcagagcaaggggggcggggtggggagtgtgagtcatctccggtgattgatggggtcacgcgggtcgcgtttccaccggacggggggcccctccctgtttggcggcccaggtggagagagagaggaggcggcttatgccattgtttctgcatttcggagacttttggtgcttttactgattttgctgctgctgtctggagggcggggccgggtgtacagagtggagcaggagggtgaaatgggggcgtggccgctgaagcacagcatcgcggggagccggttaggcctccggataactgcgggccagcttggctggtgtcgggccttccacaagaggtggaggagcagagtcttctctggactcccgcggggaaggggagactccctttcctggtccgctgggtggcgggtgtttttccttgacactggggctgccgctggaccatggtccacttggcggcgggcgtcttcccggatgctggcgttgccgctggaccaaggagcccttctgctggccctgtccgggcatgacaggggcctcgcactcttgtcttgtggtcacttctcactgtgtctcctcggctcctatctctgtgtggcctggtttttcctgggttgtggttgtggagcgaggattattgtagtgttgggatggagagtggttgctgcagactaatgattgatgatattaatatataatcatatct

SEQ ID NO: 663623 - DNA, 805 bp, Homo sapiens
atctcaatttgaattgtatctcccagaattcccacgtattgtgggagggcaccagagggaggtaattgaatcatgggggccggtctttcccatgctattctcgtggtggtgaataagtctcactagatctgacgggtttatcaggggtttccgcttttgcttcttcctcatttttctcttgccccttgccacgcaagaagtgccttttgcctcccaccataattctgaggcctccccaaccatgtggaactgtaagtccaattaaacctctttttcttcccagtctcaggtatgtctttatcagcagtgtgaaaacggactaatacacatggtaattccatgtttaactttttgaggaacagccaaactgttctccacagtggctgcaccattttacattcctgccagccgctcatgaagcttccaatttttccatatctttgccaagatttattattgtctgtctttttgattgtagcctttctagtgggtgtggagtggtatttcattgtggtttgatttgcatttccctagtaattaacggtattgataatcactttcatgaacttatttgccacttgtatgttttctttggataaatgtcttttccggtcctttgcctattttaaaatggtaccatttgtctttttatcgaattataataatatttatgtattctggatactagatccttattatatatgttatttgcaaaaattttctctcatctgtgttggtctttcactttttgacagtgtctttaataaccaaagttttatttcaaagaaaaaaaaaagaggaagaa

SEQ ID NO: 663624 - DNA, 1140 bp, Homo sapiens
caggctgtaccggtcggagagtgtatggatcgactgcggcgcatggcggtgagcggtgtggagaagacgcgcgggtggctgggccttgcattgttggcggctctcggtgaccctcgtgctacccccctttctccaggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcaagggcgggcttcggtcgggaagggtggaatccacgggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtggtgtaggggtttgttttgagtgcagagcctttccaggacttctgttgtcagagaaccctggagttggtctgtccctggctggtccaaggatttgtagctgttgtgaaggtgtgagaccatcagataggcaaaagaccccgttcgttttctgatgaaatgttctctctttcagaagagagagagaggtgcatttagaaaatatgcaataaattgaagtgagtgttcaaagtattgtagaagg

SEQ ID NO: 663625 - DNA, 1160 bp, Homo sapiens
ggccgccctggcccgcccggccccggggaacctagagtcgcaggcgcgtcttgaaggacggaattcggcgtcggactctgcgccccgcgtagttccggtggcgactgcggcgcatggcggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtggtgtaggggtttgttttgagtgcagagcctttccaggacttctgttgtcagagaaccctggagttggtctgtccctggctggtccaaggatttgtagctgttgtgaaggtgtgagaccatcagataggcaaaagaccccgttcgttttctgatgaaatgttctctctttcagaagagagagagaggtgcatttagaaaatatgcaataaattgaagtgagtgttcaaagtattgtagaagggaagataaagagaaaaaaaggggggggggcaaaaatcccgggggccaatttagcgacgttttgtaagggcccttgg

SEQ ID NO: 663626 - DNA, 1823 bp, Homo sapiens
ggccgccctggcccgcccggccccggggaacctagagtcgcaggcgcgtcttgaaggacggaattcggcgtcggactctgcgccccgcgtagttccggtggcgactgcggcgcatggcggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtggtgtaggggtttgttttgagtgcagagcctttccaggacttctgttgtcagagaaccctggagttggtctgtccctggctggtccaaggatttgtagctgttgtgaaggtgtgagaccatcagataggcaccccctgtccagtggacacatgacccatgtgaccttacctattattggagatggttcacattccttaccctgcccctttgtcttatatccaataaatatcagtggtggccccgaatgtctggctgcgctgatgtttgctggatgcagagcaaggggggcggggtggggagtgtgagtcatctccggtgattgatggggtcacgcgggtcgcgtttccaccggacggggggcccctccctgtttggcggcccaggtggagagagagaggaggcggcttatgccattgtttctgcatttcggagacttttggtgcttttactgattttgctgctgctgtctggagggcggggccgggtgtacagagtggagcaggagggtgaaatgggggcgtggccgctgaagcacagcatcgcggggagccggttaggcctccggataactgcgggccagcttggctggtgtcgggccttccacaagaggtggaggagcagagtcttctctggactcccgcggggaaggggagactccctttcctggtccgctgggtggcgggtgtttttccttgacactggggctgccgctggaccatggtccacttggcggcgggcgtcttcccggatgctggcgttgccgctggaccaaggagcccttctgctggccctgtccgggcatgacaggggcctcgcactcttgtcttgtggtcacttctcactgtgtctcctcggctcctatctctgtgtggcctggtttttcctgggttgtggttgtggagcgaggattattgtagtgttgggatggagagtggttgctgcagactaatgattgatgatattaatatataatcatatct

SEQ ID NO: 663627 - DNA, 1030 bp, Homo sapiens
cggaggcgccgtcctcccgggtccgccggtcccgtgagctcccgtgggccgcagtattggcgtcacagtggttgatagatcaaacccatggacgttggttctgtggtacaaatggagtacaggactcagtcgtcacggcgctgagtgagagaagccttatttccaagatggagaagaagcggagaaagaaatgagaagcctctcttcaggctgaaccacaaacaggccatgggattgaacttttactgtatgtcgggcaagacgtgctacgatggcgtgatcagctaatgttgcagcttttagctgaaacaacaaattcacctgttctaactccacagacagacacagcagtgtgcatcttgcaatatatgcaaatgtttactgagtcatattcgcgttgtgacccatgaagcttgtcaaccatctggcctgcttctgcctcgctggctccttgctctgtgcggaaagcaaaccatcttggtgcgacagaactgtgcacacacaaggcacaatcctttgttgccacacgaggcccccatggcccctgtgtgcgtgtggtccccacccttgcactttttcgcaacggctgggacacttcctcgattcaaacaagccttggtgcgacattatcgcacatcatcattcggtggcgctttccaccatggcgaataccttttaccagcgctaaaagcctaagcaaacagttccactttagtttgctcaaacgttggccccatggacacggagcaggcaggcaaagggactaacgccaccaacattcggcgacggcacatgcgacttacccccgtcccgaaacacgcaaacgtcgccacgtccccgcgcgactggaccctacaccccccttaggccgggaagtccacccgggacgggcgcggaactccccacggcaactacgacaacagcgcaacgaccagccgacgcaacaaagccgggagcggccggcctcgacgccgccgcggacacagacaatccagtgcccgacgagcgagttccgacccaacggggggtc

SEQ ID NO: 663628 - DNA, 132 bp, Homo sapiens
aggacctccgctgccaatggcacactgtgcttggttgagttcacaaatctgttgtaacctgtagcttcctgtactttctggctctctctactgtaaggtttgttctacagatctgaaagcatggctaggcgg

SEQ ID NO: 663629 - DNA, 173 bp, Homo sapiens
atcctagatatagtgtccatatcagagtggacgttcctcagatgtcactgccatgggcaagagcatttccaaagtatagtagtgtcccagattatacacgaagatctgtttgatacacgaattgactaagaatactgtctgtcttaagaaaaacatgacttctttgccttcca

SEQ ID NO: 663630 - DNA, 395 bp, Homo sapiens
gagacagggtttggttttgccacccaggctggagtgcagtggtgcgatctcagctcactgcactgcaacctctacctcctgggctgaagcaatcctcccacctcagcctcctaagtagccgttgcatgccaccatatcaggctactctttgtattttttgtagagacagggtctcgccatgttgcccaggctggtctcgaactcctgagctcaagcaatctgcctgcctcggcctcccaaagtgctgggattacaggaatgagccaccatgcctagccagcttttacttaattttaaattgtggggatcccactcaaccaaaaaagaatagcattgatagcaccttcaaatgttctagtcgttttcctgtaccattagatctagatagcgagttc

SEQ ID NO: 663631 - DNA, 191 bp, Homo sapiens
  misc_feature (14)..(14): n is a, c, g, or t
atcactgagcaggnactcacggctcatgagctgagatgctgccactgcactccagcctggacaaccggagtgagttcctgtaacaacaacaaacccaaaagaataaatagaaaattggaattgtttatatctgtttaagaagttgaatctgggctgggcacagtggcccacgcctgtaatcccagcacttt

SEQ ID NO: 663632 - DNA, 731 bp, Homo sapiens
  misc_feature (7)..(7): n is a, c, g, or t
atcgatntccattggtaggaagcggcgcacatggggtgggaccccggaaattcggccataatggccgggaagtcagggccggccgcaaccggcgtcagggcggttggctctggaaagttaaggctgggtggcctttgggaagccagggaaagggactttaatcggggtaactacggggggcacagggccaggttcggccacaagttccgggagttggagtttcaaccgaccggaaggtaaaaatatgccaccaccagcatttccaggatggaggccaggaccagaaaggaggctaaggtccataaaaccgggagggaggacctgaagagattaattgccgccggtgaaattcccaaagaggatgatgcatgggggcctcctcctgaccgaggggcccgccagaagctggaaatcgcaattgaagataaccacatttctttaacatcataaaaaatgggttccttaatggaggcaaatcattccagggttccaaaaggctaacaagtatttaataacctggacaagaactcaaagggttgggccttaagcctaatgggatcacatttaaggattaacccaatctagactggaaatgggggcgtcattggcggtgggcgggatgtagacttggccatttcacctaatctcatgtcacttacacatcaacggccgggcttaataacgatttgcctgcgctctgaccctcactcaattaaccgctcagactccct

SEQ ID NO: 663633 - DNA, 1002 bp, Homo sapiens
ctcaacgacggcagccagtgctgctggggtcgtgagtggcatggtggactccatcacccaggccatcaaccagctagatgaaggaccaatgggtgaaccagaaggttccttcgtggattaccaaaccaactatggtgcggacagccaaggacattgcagtgactgttcaggagatggttaccaagtcaaacaccaggccagaggagctgggccctcttgctaacctagcatgagcagttgacgtatggcctgtctgggccatcggaaggccaagcctgctagacggtggctgctgaaaatgaagagataggttccccatatcaaacaccgggtacaggagctgggccatggctgtgccgtgtctggtcaccaaggctaggcgcctgggagtgcagccccgagtgatgcctacaccaagaaggagctcatagagtgtgcccggagagatctctgagaaaggtctcccacgtcctggcgtgcggctccaggctggggaatcagtgggcacccaggcctgcatcacagtagccatcgctgatgtctggtatcatttgctgacctcgtacagacaacatcatgtgcgcagctgtggcacgctcaatcgtgagggtactgaaactttcgctgaccaccgggaggggattctgaaactgcgaaggtgctggtggaggagaccaggtctggttgcacacgcagtgtggagccaggagacagttggcgccggcgccccatgctccgggagaaccaataccgggcgcgcggatgtggcaagccgggttggccagccgggacgcgaggaaccggaaaccagggggcatagctaaggaagaaaaggtaccaagccggcgaccaccaaggctgacgcgcaccgcaactgcgaaaccacggtggcaaaaaacgcccgaagaccaggcaccgcaaaacggaaaagagcaggacggaagaaacaaaggaggggtaaacgacaacaaaaacaagcacagagaaaaaaaaaaaagcaag

SEQ ID NO: 663634 - DNA, 410 bp, Homo sapiens
  misc_feature (4)..(4): n is a, c, g, or t
  misc_feature (206)..(206): n is a, c, g, or t
  misc_feature (213)..(213): n is a, c, g, or t
  misc_feature (368)..(368): n is a, c, g, or t
  misc_feature (370)..(370): n is a, c, g, or t
gctncttaaactttcattttgtcccattgttaccctggttcttctgagcgcccagcttacccaccgagctcctttcggtcatcctcaggtttcctttgatgatgcgtcctccacttccacatgctctagctactggggtcttcatagccccacgctgggcaccagaaatgttggggtgatcaggcccaacaccaggccatgggggntacaaancccagcaggatcaaaggaatgagaaaagacaagttaagagtgtataaagtaggtccaggggcccagcgctagattgggggccgtgaaggccccaagctctgggatctcacactatttattggtgatcaaacaaagaagcaggtggtgaggacatnanggtaaacaggttagggcgttgggatttgggggtagaaagt

SEQ ID NO: 663635 - DNA, 124 bp, Homo sapiens
gtggggaatgaggatgataggcaaagcagtgtgagaaatgctacgtaggtggtgggaagcggaaagcagcatgagtcggtcaacgccgcaagtttcggcgtgatgggtacgggagctcgaatac

SEQ ID NO: 663636 - DNA, 427 bp, Homo sapiens
  misc_feature (97)..(97): n is a, c, g, or t
gtgattttaagggaggagacaacccttcatactgtcttatgcccaatttctgcctccaaagaaagaagtaaaatctaaaaggcagaaatgaaatccncaagcagacagcctggccccacatcctgggcctggtagttaaagattgacccatgacctaatcggttatgttatctatagattacagacattgtatagaaaagtaccatgaaaatccctgtcctgtcctgttccattctaattaccggtgcaggcagccccgagtcacgtacccgctgtttgctccatcgatcacgaccctctcatgcggacccccttagagttgtgagcccttaaagggacaggaattgctcactcggggagctcggtttttggagacatgagtcttgctgaagctcctggctgaataaagccctttcttctttaaaaa

SEQ ID NO: 663637 - DNA, 131 bp, Homo sapiens
gtgggtggcagtgaatacttatcactcatattctccttcagagcaacatcagaatcgcctgagaactgcaatgaacaatctgaccactgtgaagcaggcctctggagataggacaggcctctggagttggg

SEQ ID NO: 663638 - DNA, 1959 bp, Homo sapiens
agaaaaaatgtgctgcgttctgaaaaataactccttagcttggtctgattgttttcagaccttaaaatataaacttgtttcacaagctttaatccatgtggatttttttttcttagagaaccacaaaacataaaaggagcaagtcggactgaatacctgtttccatagtgcccacagggtattcctcacattttctccatagaagatgctttttcccaaggctagaacgacctccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcatcgagacctgaagccgagtaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgccctgtgcaccatcaccaagaccatggactacctccattcccagggggttgttcatcgagacctgtttagaggattcagctttgtggcctcaagcctgatccaggagccctcacagcaagatctgcacaaagtcccagttcacccaatcctgctttgtaattcatgtttgagatgggtggccactgtacagatatttattacgctttccagactttctgaatagatttttttgaataaacatggttttatg

SEQ ID NO: 663639 - DNA, 389 bp, Homo sapiens
gtttttatttaaaacaagtatccatcatatctgtattacctacccaaagggtcctgttgttgatagatggttatttttgaaaattataagggaaactagtctaataggaccttttcttcaacaaaaaaggcagatcccccaagacgtttctcaggtaatgatcccgtgaatccggttcttagcattgaggcctaccctcatcaagccagcacatcctgcctgctgtcagctggtgggttattcttcagtaccctatcccatagccggaccttattccgtttacacagtttgtactttcagaattttcaaatagtaattgtcatttagactttacagtctgggaaataaagactagggttgtttcttaagtagctcagttatataaagtt

SEQ ID NO: 663640 - DNA, 986 bp, Homo sapiens
cgaatgcctcctttgacgtagagggcatccaggaccgtgtactttacgtattgaaagctctatgacaagattgacccagagaagctttcagtaaattctacattttatgaaagacctgggcttagacagatttggaccaagtgcgagattatcactggccactggcaagacgaacttctgggctttgaacattcctgatactagactgctgaaaagcttaactgtgtccacaacgaaacttgtacgcacttacacttgcagactacagaacggatgtactatgacataacagtatcagacccctctcggctttgcctgagacgaggactcagactgatagtgaccgccaatgctctggcagttgaggcaccacatgtcttggccattctttgcctgacctcatgacagcagtgcattctgcatgcgactttgtatttaccacttcgtactgtgtcatcactccttattggaaaaagtaaaaaatcctagtagagacgacccatgggacagaatgagagaaaacaatgaagaatgcaggcaacagatcgtgacacacggtagatgagaaccaaccaatcatacataaggagagacagaaggagatagagtgagaaagaacaaagacgacaggtatggatatcaacagaaggcgtgggagaggccacgagcgcaagggagaccgggcccatgacagagaggaggagacagaggggggacggcaggtgcacggaagagcggggccgcttgcgagcgctcggaggggagggtacggaactgctgtaagcgctcacgatctggattgtggatgggcgcttgctgtctcgcgagctgcatggtggatatctcggtccgtgggggtgggacagggttggggcgaacgagatcacaggatggggggcgtaaagtaaacgtggatatagcgtaaggaggatgttgggcagccgtgcccgttgtttagtgtggtgtggcgggtgcagtctcgctga

SEQ ID NO: 663641 - DNA, 246 bp, Homo sapiens
tttttttgccccccttggtgtggaaaagggcccgggtttcccctttttttcctttttttcccccgaccggggctggggggccccccttttttcccggagggggtgggcccccccaggggggggggttttcccaaaaaaaaaaatttccaaaaggggccccccccccccccctttggggccttgggggggccccccttggggggttttttttttttttttttttatttttagcccccccccccttta

SEQ ID NO: 663642 - DNA, 1276 bp, Homo sapiens
  misc_feature (1260)..(1260): n is a, c, g, or t
aaggaggcgcggtggggccgccgccaagaaaggtgcgcacagggggaaagaggagcggaggtggttcacagccccgggggcgcaaagccggtgcgccgcgtagagggaaggtgggccaaggggaaaggagcgcttatcgggagaagaccggcgtgtggtaagagaggtagggccaggttgccgcgtgcggaggcgtagcgcggcttgacaggccaaggaaaaggggccacccttgccaggccggggggggaaggccagcgaggtggaagcaggggccctggcaagaaagccagtggagaaagggagggcaagggtcgcttcggggtagcgggtgcgtgagaaccagccagaggagccgcgaaagccgttaccggagccacaggagtgtggatgggactgggaacccgtggtaaagagaggcgcagaaagggggaagggaagtcaggaagtccttgcgtggtgtgccgctggaagcgcggatgagaggtgggagagaggcgaggcgcagagagaagctggggggcagataggaggagcaaaggtgtgcaggtgagaaaagggctgtgtgtgccaggcgtggagtgtgtgcagcgagcgcgtagagagtgagaaggtgggagatagtcggagcgggtttcataggtgttgcgagagtaggtaagttgcgtagtaaatttgttagagagcagggtagtgtgtgcgtaaggtgcagggcgcaaaaggggagtggaggagagcagtgtagtgggagagttatgttcagagatagagaagctgagagagtgggttgtgcagtcgtggtgcccagggcgtgagagaagtaagagtgctggtgcgttagaatggagaccagtgcacggagagcagtcgtaagagcagtaggaggagagtggaagtgcgaaagccagctgatatagttgcagtagctctgggggaaagggaatgtgatagagagttgcgttggaagcaaaaaaagcgccagtggaggaaaggagggctagagtgaagcaggttgctgttaagagaagaaagaaaaagaagtgttctgaaagaagtggaagtgatccgttgaaaaaaagtgctgaaagtgataaaataatagtgggaaaaagcatcaaattgcttgaccaatctaggctcttcaagcattctatgcacagtgctcgtagccaggttagtggtggtccaagctcgatggggcattcacaagcttagagctagtcagactttagaggaaacagtactgctggagcacccttntactgctggggacaga

SEQ ID NO: 663643 - DNA, 439 bp, Homo sapiens
  misc_feature (330)..(330): n is a, c, g, or t
tcactcctcccgccccccgcccagatctgagagggaccgaaaacacacccccgactcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctccagtgtttgcagaaaaatcaaagccaggggggtgagcccgccggctgtcaaccttcccgccgcctcccccgccccactctgctcccncaagccgagaacgggctgcaaaagtttgcaacatttctggggggcggaggggggaggggaggggggtcctccgggctcggggcgccgccgcaggctcgcgcgcggccgc

SEQ ID NO: 663644 - DNA, 101 bp, Homo sapiens
  misc_feature (86)..(86): n is a, c, g, or t
gtgttgactctcacttttccagcacgggcagtgaacatggactttacctccaagcatgcggcctgctacttccagtgtagtcaggnaaccccccccgcacg

SEQ ID NO: 663645 - DNA, 1047 bp, Homo sapiens
cgttccaagtccctggcgagatgcatttcctgagctgaagaaggacccagacatggtgaaggaggatcattaatgaagaagaggtgcagtattctcaagactctcagcagagggcgtcgcatcctggacaggcaaattcagagcctgggagaaagtaagacattcccggagaaactgcttggctcctctatgacacctatgggtttccagtggatctgactggactgatctgctgaagagaagggcctggtggtagaccatggatggctctcgcacgaggcagaggacactggcccagctgaaatcacagggcaagggcgcagctggtggggcaagagcctcatccatgctggcaccattctaccgctatcgaagagctccggcgccccggggtctgccacgtcccagatgccttcccccaaagtaaaatttaccatgttggactccagtggtcgctatgtatctgacgaaacaacagttgggccacccgcgcgatggctcatgcgcccgcggacaaacagactgtccgaggaccgacggtgtcccacacggccacgcacgtcgctcgacgctggcgctgcccacaggaacctcgccctactggccagcaccaaagggagcggccagaatctatgaacgcacggctacacccggcgaagcgggcatgacagcaccgaacagctcacacaacaggtccacagcgcaccaccgcccaccggcccgcacgagccgcaggcccacccctcgaacccatatacggcgaccgaaacggcggaacagcacgccggaaactgagacgcccgaaccacgccccacaccgggaaccacacagacacatgtgcgaacccgcacacacgcatgggaccgcacaaccgccagagacagaccgacccaaaacacgccagcccgccaccaacaacgcgacgaccaccaccccacaccacctccacatcaccgcacgaacgcacaagccccaacagaccagcaacagcgccacgccccccaacaaccagaacacaaacacagaacacaacacgaggaacagcc

SEQ ID NO: 663646 - DNA, 346 bp, Homo sapiens
  misc_feature (17)..(17): n is a, c, g, or t
acgctcacactgcttancttaaatggctaaagagctgctgctcctccggaggtacatttcaccagccctggtagacggtgcggcagatgcccagtgcatcagacccaggcagctccagacaggccagccatgtatgaccagtgtcctgcctcgcctgtgcttgtcattctgggagctgatttgatttgtgtattactttatttcatttcacacaatcatatgtgctcacgaactgttttcaaaagcttcatgcatcttcaatcacttttttcaaggatgctcaactctggtttggctaggcccccaagtcactctctccttctcttgtccctgccatttgaatggc

SEQ ID NO: 663647 - DNA, 721 bp, Homo sapiens
ggctgcaagtgagctctccttttgagacagtccagatcagattgtcaccagcgataggccacattccagttagaactcaattggtctcccaaatttgcagacaccaagcgtgatttaaaagctgagctttttatcagaaagcttttctctgatgttcttaagtgttatgtgactgcgttgaacttatcaaacaacgtgctacatgtttagaatcccagatactcctgaattttaggatacgaactaattctgattgtgtcgtgcccaagtaccctggtcttgtgttctaatgtatagggaccgaatgccacattgctttttatatttcgtttctttgttgtgaactgcttgccagaaaccgaaaagtagctttgttttcctcttgtattgtgctactttgcagtatttgtgtgtgtggtcttttatttccttaatttgaaagggacagcactgtgtagtgtttataaactaaatgaagataagactattacttcttgtataaacattcatgctgagaacaactcaaagcagtagccacatggtgctggctcctttgcagcacaaacctggtcattttgatgaccgtacaacaggaagacttgaaaaatcacgtggattcatattaccaccgctctcatttcatggagtcgttctgatcaaaaaagctcacgtcgtatttcttcttttcctttctctgttctagaaatacggcgttggtacc

SEQ ID NO: 663648 - DNA, 897 bp, Homo sapiens
  misc_feature (892)..(893): n is a, c, g, or t
ggcagtccaaccctagccaataggggagagacacaaaagtagggactagctgcattaggaataagaaccctttcccctctcttatccagtatgctcttgccattgctccatccgcaagactcacccttctatagaagtaaatttgccttgctggagtgttaacttgttgctggagtgctaactcttcttgtgtgtcatcaaaaagttatttccaacatgaagctgcacccttggtggagggaacatctgacgaagttcaatgttggggaaagcaatatctggaaagattgaacagtcagcaggagaaacacctaggaaaattacaaggcctgtgaaagaaacatctgagaaatttgcatggccacaagaaagaccttcaaagaccacacaggaggaaaaagaaacatctgtaaagactgaatgagtggcaggagtaacatctaataaaattgaagtttggaagaaggaacatctaagatgatcacatgtcctacaaaaaaaagtacaaaagcaagtacaaatgacagggcggaatctgtaccaaggctggggtgcagtggccaatcatggtcactgcagctcaaatctggggtcagcagactcctgtgtcagctccagtagctgggacccggcaagcagaactcgaagttgtagagaacagagtcagatgtggtgcatcagatgtttccactttttcattacatcagatgggtggcggcgctcactagggaaccacactcttttcaccggttgaaggaaggcgggggacaaactccaagggcgcggtcaagggcggagctctcacacacacggcgggcggacacaagtgattctgtacgccttctccatctctcatgtcttatatctctatcctcaattcgtagcacacggnnaatt

SEQ ID NO: 663649 - DNA, 480 bp, Homo sapiens
cttgagagtggggtcagggataaaagactacatattgggtccagtgtacctgctccagtgatgggtgctctaaaatctcaaaattcaccactaaagaatgtatccatgtaaccaaaaaccacctgtacccccaaaactattgaaatcttaaaatagtaataattaacaaagtaaaacaagatcacaccctggaacaattggaggattgcttgctgccctgcatcttaaggcgtattctagcagcaaagcctgtgatgcactgacttggggcaagtaatccctcattctgagggcaaagggagaagatgttcctcgcgcagggaaatgaagtcttttcttattctccttgcttgagcctaaccacgtatgttcgtccagtgtagaatacatggcgcctttttgtcctttttggtattggtggaattaaagtactttttccatatctttccacttttccttagagaacttaaataaagttca

SEQ ID NO: 663650 - DNA, 149 bp, Homo sapiens
gccccaagcatgtagccaattttttttattgggaatatgccaattccattcttttcccttatggtctatagaactggggttttcttttttctatccaagagggatccagcgaacttttttaggttaaatccgaataaaagaactttact

SEQ ID NO: 663651 - DNA, 772 bp, Homo sapiens
ttacggacgaggacgcacaacctgacgtcatgctcctttctctctccccggacagaatgagcttcaccactacgctccaccttctccaccaactaccggtccctggagctctgtccaggcgcccagcataacgagacgacccggaccggtcagacagcgcggccagcgtccatatgcaggcgctgggggctcatggttcccggatctccgatgatcccgactccaccagactttcaggggcggcatggggtccgggggcctggccacgggatagccgggggatctggcagcgaatgggaggcatccagaacgagaaggagaccatgcaacgcctgaacgaccgcctggaccatctataccctggacaagagtgaggagcactggagaccgagaaccggaggctaggagagcaaaatccgggcagcacttgaggagcaagaagggaccccaggtcagagcactggcgccataacttcaagatcatcgaggacctgagggctcagctctatcgcacaatactgtggccaatgcccgcatcgtcctgccagcttgaccaatgcccgtctagctgctgatgacttatagcgtccagtcattgcagacagagctggccatgcgccagtctgtggagaacgacatccatggggctccggacaggtctttgctgaccacccaatatcacacgcactgcagctgggagacagagatcgatgctctccaaggaaggacctgctcttctgaacacgaaccacagcgcacgtacacgcctcca

SEQ ID NO: 663652 - DNA, 100 bp, Homo sapiens
ctgttttaggacatagatatttgtctgctgtgacactgcctttggttccgtaaattcccacaaggtaagacttggcaggcattaaattttatagtttggg

SEQ ID NO: 663653 - DNA, 311 bp, Homo sapiens
gctctgttgcccaggctagaatgcagtggcacgatctcagttcgctgcagccttgacctcttgggctcaagtgatcttcctgcctcagcctcttgagtagctgagactataggcatgctcactacacgtggctaattttttattttttgttgagatagggtctcactatattgcccaggctggtctcagactcctgggctgaagcagtcctcccaccttggcctcccaaagtgctgggattataggtgtgaggcaccacttctggtctcaaactcctttttaaaaaaagtctcccaggcccatctcttaca

SEQ ID NO: 663654 - DNA, 243 bp, Homo sapiens
gtcactctagaggatcgttaattgagggcgggtggggaacacagcgcccccatctatcctactctaccagacttgcaggcttattacttgtgggacacgagagcgtcagtaggcaccctcagattcactaccagacaatgtaatccccgtgacggctttgatatatttgccgcgaggataagaatgtccttggataagaaaggcaactactgggatcctatgaggatacctcaggctgtctga

SEQ ID NO: 663655 - DNA, 849 bp, Homo sapiens
  misc_feature (496)..(496): n is a, c, g, or t
gagttcgagaccaccctggcaaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacattagaatttgggattccttgggtcgggttctcccaaatttctttggaggggtccatgtggtcaactggctttcagctttggtttgggcaacccccgtgcccgaagttcgcatataggctgttcttcaccctgttttccaaggcttgaggaacagaaagtagcctcgtgtttggaggaggtggaagttaagtatacatttattttttacggtgactgtgtccagggaccactttttacaaaaggcctggttcccttcatggtttctggnaaacggaaagttctattcaatatggtctccccttggaatatagaatagttttttaaatacgggcttatttggaaaaacttctgagtttattcaattgtttgccaataccttccaaagtaggtaatatacagagacgtgtggtgatcagatggttagaaaaatttcttgggatattcaccattcgaaaattcctttattagtgaatgtcttgggactttaatctaaccaaaagttgcacatttattctgtgtgcattttcatattggtgtcacaggtttgtgcaacattaaatacttagtttgggttagaaaacacaagaaccacaagataaatagagaagaaaaaaaaacggc

SEQ ID NO: 663656 - DNA, 216 bp, Homo sapiens
ccaacaagcacaacatctgctcccacaacgagcacaacttctgcccctacaaccagcacaacctccactccacagaccaccacatcctctgcccctacaagcagcacaacctacggctcctaccacctagcacaatctactgcccctcacaaccatgcacaatctactgccccttacaacccagcacaggtggactcctctagacgtcgaccctgc

SEQ ID NO: 663657 - DNA, 565 bp, Homo sapiens
ggattgcgaccattcctcagaattctagatttctctcaactacgagcctggagtactcgggtacttgagtacagtggctcaccccagtctcctggttatatgaacttcttcacctcagcattacattcattaccgacagattacctaggaccagtacgatttggggtaatcaacaaataaacatcttgcgaaactggtatccttagtacactctggaagtgtgtatttacctagacatttcaacacatcacttgtcttccccagggaaggtcctgaactacacagctgaaaacctctgtaagtgggccttagaaaaccaggagacgctctttcggtggctgcggccacacggaggcaagagtctcctgctgaataacgagctgaagcaaaggcacagcgctgtttctgttcataccttttaatcccctggacgaaagtcatcctttaaatagacgagatcaccgaagtgagcttggagtacaaacaactgtcatggggaccaggtggtggagcgtctccttcagcacctgcggagggtggatgctccagtgctggagtcctggcc

SEQ ID NO: 663658 - DNA, 142 bp, Homo sapiens
tatgaagaaccgggtctgtcacgagtcaattataagagtttgtacagatgatgactgcaaagtgaaggcccccgggcagctggcgatgcccgtactcttgatctctctcttctcgcgcgcgcactctctcttcaacactccc

SEQ ID NO: 663659 - DNA, 1125 bp, Homo sapiens
ttttaaatcttgtttttgtgtagccgttcatgttcgatgtttgataccaagatatgtttcttacctatcatgactgcgatggatattgtctatctggataagtggggtccgtaggtgctggtgatctcgtacgcgtctttatagtgtgctttttcgtccactgctagggcagggtatatagtacgtgttctttctgtaataccgcacccttgtaactactctttagcgtgagccctagtcggtgaacatggccgaggagtcgaagtcactgtgcgtgtcgccaatgtgtaatgacatggtactactctactctcccctggtgtggaatggtaccagccacccccaaggccttgtccacaagtggattgaagtccacgacggatggggcccttcctgctgaatccgattatcaggtcctggctccggaatcatcttgcaagaccaagtcacaggagtcattcgttagatttgccccgacgaatcgattgcaaggattgtgcccatcctcgagaattccacgagtgcatatttcagcgctagatctggtcgtgcctccctgagggcgtaccatgtcgcgcttagtgaatggccccgcattctgtagatctccaatgcgcacaagggtgcacatgcctgcccgcgcacgcatgcggcttggtgccactagcgggtgtatcacacccagccctgcctggcctagctgcttctgcaccgagatatttgagagagtgtggctcggggacgatacagcctcatactagtgatctctccgcgcctgatgacacaactagcctgcctgtggtcagcgacccaagcgttatcatgcctggtcaagaagcgagggccattgggccaggttccgctgatcgtgggcatcttgctggtagtttcgatggactcctggtccttgcatctctgatatataggacgcagactctatgaagcaagacttctctcgtaccccagttgccacatagcagcagtcactggctgcgtctacccggcatcttctgctcgtgtcccattggtgagaatgagccccgtcctcagtgggcagcaggttctgagtactctcatatgatgctgcgattttcctggagttgacatacacaccgagtatttccc

SEQ ID NO: 663660 - DNA, 262 bp, Homo sapiens
gctttcatttgagtgagagtaaaaggggatctaagaataaagtaaaaataaaagagactcagtagcatcttagttctgagacccagagaccatttaggaggctactgtaatgtcaggcagaataacaaagcagaaggtggctgggggtgaccctggagtcactggatggtgaagaaggggtggagttctgatcacaggacaaccagagagagactctcagtgagtcaattaaattttgcctaaacttagttttccccactac

SEQ ID NO: 663661 - DNA, 351 bp, Homo sapiens
gatgtataactgtatcacttacaagttcatcttttctttacataatagatgagttccaaagaactactatgtagaaatatttttctaagtattttataacattttaatgtgcaatgaaaagtgcttattttaaaaaggattacttggtgctgttctcatgatagtaagtgagctctcttgagatctttttgtttaaaagtgtgtggcgcctccactctctctctcttgcccctcctcctaccacatgacagtgcttgttcccgctcgccttctgccttgattgtaggtttcctgcagcctccccagaggccgagccgatgccagtatcatgcttcccatacagcctgcaga

SEQ ID NO: 663662 - DNA, 123 bp, Homo sapiens
ggtgaagaaaaatgtgtgagatcatggattttttagacagttctaccgtcatccggcaccggtaaggctgcacttcggtgcgccgcgtccccgcttacaaattgtactggccctgcagtaata

SEQ ID NO: 663663 - DNA, 346 bp, Homo sapiens
ttagcgtcacagtatagctacatgagctgagcggctgaaatctgacgacacggcgttatactgtgcgagagaaacgggtccacaactatagatcgggcagttattgtcttgactcactgaggccaggcaaccctggtcaccgtctcctacagcatccccgcaccagccccaaggtcttccctgctgagcctctgcagcacccagccagatgggaacgtggtcatcgcctgcctggtccagggcttcttcccccaggagccactcagtgtgacctggagcgaaagaggacagggcgtgaccgcatgacacttcccacccagccaggatgcctccgggcacctgtaca

SEQ ID NO: 663664 - DNA, 1057 bp, Homo sapiens
agacgagcctggcgcggtggttcatatctgtgatcccggcctctctgatcttgcccaggaggctactggatctgcgagtgtctggagttcacgaactatatctggcgcttaatgggtgtctctgattaaaggaatgcccccaattcggctggagctttgcatggactagtttgcctgtaagtaccaagtctacatactggggaggcgtgacagattggaaagaatgtggtgtgacccaccggtgaggcgtaagtgtatgcatatgaagatcgatgagttggctaccaagtgcattatcggacagtgcattgtgtgatagggaaggagaagaggtcatttcgtatataaacaacaaatagacaatcataaatatagaagttggtaggaaaaaaaggggagggtataggaaagcttggatagaggactacgaagctgattggggggaggaaacgacaaggccagtggtagaatcactatgaagttaggtcgcgggtgatttacgtggaccatagtaccttagggaaaaagatggggaaagatgcactggaatgtatgagaaaaagtgtgatgtttgacaagaatgaggtcaagggactggttgatgagtagtgggggatcagttacatttaccatttgcgaagaacgggatgggaagaccacagttgagaaatggtggtctaagaaacatgagggtaaaggaagaaatgattagagaatgtgagagggagcagtgagacccaacagccacactaatagccgtggaacccaacgcgcctgtggaaaggattccggtactggcccaactgcactattccacgagcaggcgcaaatacaacccacaacatagtgttgcggcgcccacacgtccggagaagcgacaaactcagcccgttaagacagtgcgataccttggagccggtgtaatcacactttctgcgcgagccacatggacaccattgtgaagactgcgacgtagtaacacatggttccagtcacaagtaacaagtacgagtgcgccagcaaccgaccagtctgcgggacagagaccagaggaacg

SEQ ID NO: 663665 - DNA, 189 bp, Homo sapiens
tcgcccgaatctaatacggtcatatgttctgagtatcagtatatagacttttatagattttcttactttatttttttggaccaaactcacagcatgcagaagttctggggccaggaatctacatctgtgccacagctataaccagagtcacagaaccgacagtgctgcgtcacacagggtatcggggat

SEQ ID NO: 663666 - DNA, 112 bp, Homo sapiens
aattagtcctataacattatcacagcaactgactatggttatactcagaggcaacaatgaagcaccaccaccaccacccccagctactacacaaaactaccaggattcatac

SEQ ID NO: 663667 - DNA, 422 bp, Homo sapiens
tcgctcgggttcgcgcgaggtttagcgaggtctgcctataagatcatcaaaaagctatctagtggtgagtatgagtttcgcaatgctccttcagtagaggatcatgatgcgactgtcattgcgtcgtcgttcgagtttgctcggcataatagttatgaggatgtaagtccgtgggcgattatgagaatgactgcgccggtcaagcttcatggggttcggatgagaatggctgttactactaggcgctcactgtggcttattgacgagtatgcaatgagcgatctcaggtctgtttgtcgtcggccgcatggcgcttgttctcattatgcctcatagggatagtacaaggaaggggtaggctatgtgttttgtcagggggttgagaatgagtgtgaggcgtcttataccatagccgcctagtt

SEQ ID NO: 663668 - DNA, 176 bp, Homo sapiens
gctataccttctgcatgatgaattaactagaaataactttgcaaggagagccaaagctatgacccccgataatccagactgagctacctgaagaactagctacaaagagcacaccctgtctatcgtggcaacattagtcgggacagatttataaggtagaggtcgacaaaccctac

SEQ ID NO: 663669 - DNA, 323 bp, Homo sapiens
atataaaaatacaaaaattagctgggtgtggtggtgggtgcctgtaatcccaactactcaggagcctgaggcaggagaattgcttgaacctgggaggtggaggttgcaatgagccgagattgtaccactgcactccagcctgagcaacaaaacaagactccgtctcaaaaacaacaacaataacaacaacaaacaaccaaacatttttttaattatactttagttttgggtacatgtgcacattgtcgaggttagttacatatgtatacatgtgcgtgctggtcgcgtgcaccactactgtatctagatagtatttccatgct

SEQ ID NO: 663670 - DNA, 476 bp, Homo sapiens
aagactaggccgacttgtcacgcatgtcagcaagaaggacctgtacctggccgtgtgttcaacccaccgcctttgagttgacacagatgcaaccccttgaccaggacatctacgggcgcgaggacgtggcagccccaagctgttctacgccgaccaccccttcatcttcctagtgcggacacccaaagcggctccctgttattcattgagcccctgggaccaggcacccccagaatgacctggccgcagtgagacggattgagaaggagctctcaggaggggcttccgggcacactctgaccaagaaccatcgtgcctggcgttgtggggatgaactttttgttttgttccttccttttttagtcccccaaagatagggagggaagggggaacatgatctttttttgctatcaatccaagaacttatttgtacattttttttttcaataaaacttttccactgaaaaaaaaaacaa

SEQ ID NO: 663671 - DNA, 399 bp, Homo sapiens
ggtcgacgtgagctgtgattgcgccactgcacaccagcctgggcgacagaatgacttcatctcaaaaaaacaagacaaaacaaaattaaaaaaccctcaatcttgataaagtatcttttttttttttgagagaagtctcgctcttatcccccaggtttgagtgcaatggctcgatctcagctcactgcaacctctgcctccggggttcaaatgattctcctgcctctgcctcccaggtagctggtattaagtcacctgccaccacgcctgtctaatttttgtatattttagtggagacggggtttcaccatgttggccaggctggtttcgaactcctgacctcaagtgatccgcctgcctcggccttccaaagtgctgggattttccaaagtgctggca

SEQ ID NO: 663672 - DNA, 977 bp, Homo sapiens
gccacgcggtcgaaagacagtcggaacacgtatagcctattattcggcgcatggagcgtggagtccgtagagcacagctctaagcctccttattcgagccgagcgggggccaggcaggcaaccttctaggtaacgaccagatctacaacgtgatcgtcacagcccatgcattggtaagaatcttcttcatagtaatacccatcataatcggaggcttggcaactgaactagttcccccgtaataagtcggtgcccccgatatggcgtttccccgcgagtaaacgaacgagtaagcttcatgacgtcgttgacctccctctctctctactcctgctcgcatctgctatagtggaggccggagcaggaacaggtggaacagtctaccctcgccttagcagggaactactcccaccctggagcgctccgtagacctaacacatgcttctccttacacctagcaggtgtctcctctatcttaggggccatcaagtttacatgcacgaacaagttgatccaggtataaaaccccgctgccatgaaccgcaatacaccaaacgcccctcttcgtctgatccgtcctaatacacagcaggcctacttctcctatctctcccagtcctagctgcgggcatcactatactactaagcagaccgaactcaacaacaccttgttcgaagcccgccggaggaggagagcccatttctatagcaaacctagttctgatttctcggtcacctgaaggttaaaaattcttattctaacaggggtcggaataattccatatgtactttactactcggaaaaaagaccacttgggtgcctaggtatgggctgaggcatagatatacatggatcaaggctaacgcgtgagccccaaaattaaggtcgaataaggttaaccgaggcctatgtcccggaataaacggtataccacggggaagataaggatctccccggagaaaaaaaatggagtggc

SEQ ID NO: 663673 - DNA, 316 bp, Homo sapiens
atggtctggtacactttaatagtgtaggaagctgaatcatttatgcaggagagaggtcaggcttgatacgggaggatcctattggtgcgggggctatgtatgattatgggcgttgcttagtagtagttactggttgaacattgtttgttggtgtctatcttgtaattgaaattgctcggggacctacggttactgtgattacggactagggttacgactgagtggaccgacacaaagacaggacgtaacgtttaacttatgccttttcgggttgagggacttgccgcggtggcgcgggtacccgcgctcgaattcg

SEQ ID NO: 663674 - DNA, 1090 bp, Homo sapiens
gatcgtccctgggttgtgtgacccgtgttggcctgctgctcgaaaaatgccggggctatagacagatcgtgactcattactcctgtcagcccggatcatggtgtggtgccgtctcgtgacacggcactatggattcctggtctatgcacacatgggatagccgcgtgaaactatcctcctgtcatacacactacgttggccaggtcatagggcgactattcatattgaggggttgctcgagtgcgagtgtcatgctagatgattgagcacgacgacatatagccagtttggctagcatattgggagacgcgaacgagtagagtttcgcgcgcgggacatttagtcttgagtagccgccatggtaacctcataaggaggggggctcacgaagggctgcaagcatatgtggcgtgcaataactcgtgacttaattgagtttgcacaccttcgcatgcgccaagatcacgctttgtgagatgcgatacactcgtagagccaatttgggcgctttatgtcaagttgcgatccaaacaaagacctgaatccccatgtggtccccattggttggcatggcaaaagttgacgaaaccacggcgacaagtccatacggttaggaccgccggcagcacaattttgcgtggggggggtcgttgggcggagggcactggtattttaacgctctaggtaatacacagtgggcaagggggaaaattccctctgcgctgagtatcgcggttcccggcattgcaagatggatgcattgagatgtggttggccctcggtatgcgaaattccgaagccatgtgtgtgtgtctccgctaggacaaggccacacccgtttgggaatgttgttaatggccgccgattgccgatgaaaaattaaccaagcgttggacttcgcatgtgtcagattaaaggcaagttggccccattagtgcacgtactctggtcgcgtgtcaccccgtagggagaacaaccttatggtccccaaccgagggtttgactccccaattgtcgacggttccttgtaccctggtgcacacttttataaacacgtggtcgcaatattaaaaggcccaagggtgccccc

SEQ ID NO: 663675 - DNA, 941 bp, Homo sapiens
  misc_feature (938)..(939): n is a, c, g, or t
  misc_feature (941)..(941): n is a, c, g, or t
gactggctgctctgaaaagccatctttgcattgttcctcatccgcctccttgccgcgcagtcgcctccgccgcgcgctcctccgccgcgggactccggaggtttatcgccagagtccctgaatctcgcttctttttaatcccctctgcatcggatcaccggcgtgcccccaccatgttcagacgcagccgttagacaccagcctccgaaatcaccacccaaggacttacaggagacacacgggcacgttggtggcaaagaggcagaaattgaaagaagacgcccctgttaaacggggaatgccatgagggaaaaatgccggagcaggaggctgaccaatgaggtagacgaagcaacgagcacacgaaggtggggaggcaaagaggaggaggacaaagaaggtgatggtgaggaaagaggatggcagatgaagatgaggaagctgagtcagttacggggcaagcggcagtgaagatgatgaggatgacgatgttcgataaccaagaaggcagaagacgaggaaggatgactagacaggcaaaaaggaccatttaacaaaaaaaaaaaggccggcggtgacctattaacctccaattccggttcagaaattaaggtggtcacctttgagtataaagagaccgcccgccaccgtggaggttgcaccggaagatgaaaggcgtttccacaaaccaaacaaaccatgggaatttggcaccgggcgacacacaccaaatccaggccgctgttcttaaagcacttaaaaggacatgctgcgttataccttaaatatcgtcaatttgaggggcataaacttcgaacaacagtgggtggtccatcgcatctgggcgctaatcaggaaacgtaccagagcaaattgcgccctgttgtcattcgagcacaattctttggtctttcgacataccactcctcctcggtgtnnan

SEQ ID NO: 663676 - DNA, 255 bp, Homo sapiens
cgcgcgtgcgtacgcgagtacgctgagggtcgctgcgggagaggcgtagcgcaagcgacgagacgtacgcaggagacacgccggcgacgccgacgcgacgcgccgccgagccgcgcagcgcgccggacgccggtcgtcacgctcgacgcgcgctgagcgcgcgccgagcaggccgcgacgtcgcacgtgactgtcggtctcgcgggacgtcgcgaccttgaggtgcgttcgatcgagcgcgctggagagttgagg

SEQ ID NO: 663677 - DNA, 206 bp, Homo sapiens
aggaaagatgcccagactatagtaaataggggttaacagagatggaacattcaggtaccaggcttgtgagctagagaggtgacacactgcttacttaatggtgtcttatgtaacctacctcccccactattctttctttacttttctttttctttctttttttttttttgggtttggtttttttggtttttgtggtttttggggat

SEQ ID NO: 663678 - DNA, 386 bp, Homo sapiens
taatttttacataagaattattttccagcttccccgtaaacttggttgtcaaaaattatcccaagaactgctgctgccctaattgtgtccgctgcccagtttttgaataggggcccccatgatagtgttgagccctgtaatagggtaagttattatttcccttccattggaactttttcaaggccaacccttggtataaacctaaaattgtttaaaaattgggagttaaaaatggttatctttggcaaatggcttagagaaaaaaatgtaaaattgggttttaacttccccagcctttcataaatttgccccagggctatttggggattacccttaaattgaaaccatgttgtttttttcctgattaataaatttggtggcccata

SEQ ID NO: 663679 - DNA, 130 bp, Homo sapiens
gctaactggctgtatgtggctgcctgtccaccaaacactacgtaccgatgctaacgccacgcaggcggtgggcgcgggggaatcttcctcccctgccccgggctcggagttatgcatccggagccctgcc

SEQ ID NO: 663680 - DNA, 1162 bp, Homo sapiens
ctcagccctgtggttacatgccgctgatgtatctaagaagcatgtcactttcagtgttccctccctaactccctgacctgagaaccctggggcctgtggggcagtttgatgcctcctctcccttctgtgcggtctgctcccagatgccatggcccatggtgaaggacagagtgtgtgtgtccttggtggccttggtggggatgttgcgtcctcagctccctcccctcagcccctgcccctctgagtagcaatagaaactgaccctcgtctaaggccaaaaatgaaagactagagaagtacagagatggatcagtggagcgaggacccctgtatagaaatttgctgccccaacgagtgaggcaccacgagatgtaactcagcgatttcctcggcctttgtgcgtgtacgacaatacccgggaggccccctcctttgtggggacgcgtgcgccttgtcctatatatgctcccttcgcgctaccacccgaggctcgcgctggggctcctctcgcacatcgacttccttggcttgcttcctctggcgcggccataccttccgggcgcctcgcgcctgtggcgttcgcgactgctctttcgccgtgcggcccagaggcgccaaccgccccactggccacccctctctgctagcggccgccgcgcggtgccggcaccccctctttcacataggccggtgcccccattaggcccccaaccccctgccccctgtcgcgctggcgcaacttcctagcccggtcacccttcctcctacgggcggcgccacagccccctttggtggcccccgcactctctctgcgcgccacgcggtggtctttgtaatcaacggcggtggccggcgtgtactccaacccgcccccgtgctccgcttggccgccccactcttgcttcttctggcgcccgtcctcccaatcgggcgcccacagtgccaccacggcacctactgtctttgggcgcgtctacccaccagcgccccggacgggcgacacccatacatccctctaccccatcgccttgtgccacgcgccgtgcgcacccgctcgccccgcgtcactcctttactgtactcttctcccccctctcgcagtcggtgtcctccgtccctcgcaccgccgtggcgccgtccattaaacaacgcggcgggcgtc

SEQ ID NO: 663681 - DNA, 349 bp, Homo sapiens
ggaagagtttccgagttcgtgaagaggatggagaggggtgccgcatgacactcttccaacttcagaaaagccaagagagtcaaaacagaggatgagacaagagaacgacccagaggagcacgaaagaagtcaccgaagaggagaaaaccaaggagggcgcagccagaagccaaaggggtcaaggaggaggtcaagttggcctgaatggacctctccagctctggcttcctgatgagatccctcaggtttcttccccaaaccctcagattttatatttactatttcggtgtgtatttatatcagaatttattagatataaatatccccaggggacagaaaccaaggcccc

SEQ ID NO: 663682 - DNA, 237 bp, Homo sapiens
acattagccaactgcaagggaagcgtctgcgggggcagaggatgccagccctgtcctttgctcacccgtcgttccaccatacaggaaccctagaccccggccttgcttccacagagaactggcaggagtcccctggcctggccatcacagggactcacatcggagccttttaaaactccacattgtggctgagcacagtgattcactgcctatcatccaggactttgggacgccgag

SEQ ID NO: 663683 - DNA, 661 bp, Homo sapiens
cagacactgtgaacctacttgagggtggagggtaggagaaaagtgaggactgagaaactgcttattgagtactatgcttattacctggatgatgaaataatttgtatgccaaacctccatgacacgtaatttaattatacaacaaatctacacatgaacccttgagcctaaaataaaagtttaataataaaaaaacaaaaaaaaaaaaaaaaacaaaaaaaaaaacaaaaaaaaaaaaaaaacaccaaaaaaaaagagagagagggggggcggcgccgcccaacaagaatccttcccgccggggggcgccccacatcgagccccgccccccccgcttttctttgcacacggggggcccccccttagaggagggacgctctatattaaaacccgcggcgacgcgaccggcggccccgcggctctattatataaaacacgagaccggtgttaaagagcgtgggaaacaacacaagctagctcagctagcggggaggactctctgttatgaaaggagggacacccccttaattctcgctggggggggggagaggaaccactcaaggtttggggcaaaacatcctcactcacaggaagagatatttaacgagcctccctcggggggactacttaataactaatttttagagggataatataaggg

SEQ ID NO: 663684 - DNA, 898 bp, Homo sapiens
  misc_feature (319)..(319): n is a, c, g, or t
  misc_feature (418)..(418): n is a, c, g, or t
  misc_feature (462)..(462): n is a, c, g, or t
  misc_feature (526)..(526): n is a, c, g, or t
  misc_feature (533)..(533): n is a, c, g, or t
  misc_feature (538)..(538): n is a, c, g, or t
  misc_feature (798)..(798): n is a, c, g, or t
  misc_feature (816)..(816): n is a, c, g, or t
  misc_feature (820)..(820): n is a, c, g, or t
  misc_feature (825)..(825): n is a, c, g, or t
  misc_feature (853)..(853): n is a, c, g, or t
agcggggggtgctggaccaggctggagtgcagtggcgcgatctcagctcactgcagcctccgcctccagggttcaggcgattcttctgcctcggcctcccgagtaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacntcgcaactacgtgactcgctactgccagggccccaaggaagtactcttcctgggcatgaaccctggaccttttggcatggcccagactggggtgccctntggggaagtaagcatggtccgggactggttgggcattgtggggnctgtgctgacccctccccaagagcatcctaaacgaccagtgctgggactggagtgcccacagtnagaagtnagtgntgcccaattctggggctttttccggaacctctgtggacagcctgaggtcttcttccatcactgttttgtccacaatctatgccctctgcttttcctggctcccagcgggcgcaaacttactcctgctgagctgcctgccaagcagcgagaacagcttctgggatctgtgatgcagcctctgccggcaggtgcagctgctgggggtgcggctggtggtgggagttgggcgactggcagagcagcgggcacgacgggctctngcaggtcttatgccagangtcnaggtngaagggctcctgcatccctctccccgtnacccacaggccaacaagggctgggaggcagtggcaaggaaagatt

SEQ ID NO: 663685 - DNA, 208 bp, Homo sapiens
aagtctagagacgagatgggaaagtagctgagacaagatagctagggaaactttaggctagatacaaaattcacacatgggaaatggcacggactctggggagactgggaagtgtcctcagccattcagctccttccggacgagctcttcatagttgatacaaccatgtgctgtcttcttgcccgtgccaccagcttctcgttctctg

SEQ ID NO: 663686 - DNA, 493 bp, Homo sapiens
  misc_feature (56)..(56): n is a, c, g, or t
  misc_feature (89)..(89): n is a, c, g, or t
tttacccccccctggtttttaatcctccaaaaaccttattgaacaatgggggtggntttacccccccccattgggaattcagaccctgnctttttggtggttcccggtcccaaaggggaaaaaaactgttttgggggcagctttatccccaaatttgggccttttttgcgggtcccggggggggaaattaagtgaggccccccaaaaccttgggcctggcccatttttctgaatgggggggggcccggcctttttttggcccaaaaccggggcccaagaaattttgattttcccaaggtgtttgtttagcccccccctttaatttcctttggccccttatagaaactcatatggtccccttttttttttgatactccccccacttgattccgggggatatccttttccggggttggtttgggtttaaaaggaaaatttttagatccccttaccctgggtttaaacctttccattaaatccttttggctgggga

SEQ ID NO: 663687 - DNA, 431 bp, Homo sapiens
  misc_feature (24)..(24): n is a, c, g, or t
  misc_feature (58)..(58): n is a, c, g, or t
  misc_feature (66)..(66): n is a, c, g, or t
  misc_feature (188)..(188): n is a, c, g, or t
  misc_feature (221)..(221): n is a, c, g, or t
  misc_feature (257)..(257): n is a, c, g, or t
  misc_feature (318)..(318): n is a, c, g, or t
  misc_feature (331)..(331): n is a, c, g, or t
  misc_feature (366)..(366): n is a, c, g, or t
  misc_feature (396)..(396): n is a, c, g, or t
ttctcagcaatgagcgcctgttgnactgctttgtgagcctccgggagcaggtaacctncgcccaanccgcctaggactccacatcaggcaggcacaggactggccccttgtcctcataaaaactctcagtacagcttaaactctgtaagatctaaccagcaggaggaccctcgcttcctctccgcatncttgcacctcttgcttctgagagtcatccagtnccagttctgtgacttgcattgactggctcaatcaanctacaactcaagcagtcacggggagaaggattgtagatgggcagtgactcacagggtcagnactcgggggagcngagtcaggaggtcagtgggcctggaaagaaggggnaagctgggtgggtaacgttctgggcccagnaagaaggcagagtttctccgcagggtgtgttcaag

SEQ ID NO: 663688 - DNA, 410 bp, Homo sapiens
tcttgtactgtacaagatgagagatggtggtatgaaaaagatttaaaagttatttaagaggtagcattggcagtacttggtaattaataaaagttcagatgtgtggaagagatggagaactcaaagatgactcagctttctaagacattgttaaatgctgttccatttactaaactagatattaaaaaaagaacagatttgggggaaagttatatacaatccatatacaatgtacactctcagatttcattaaacatcttgttctaagactatataaaactagagttggctaggcatggtggcttatgcctgtaataccagcactttgggaggctgaggcaggaggatggcttgagctcaggagctcgccaccagccttgcaatatagtgagacccccatctgtacaaaa

SEQ ID NO: 663689 - DNA, 215 bp, Homo sapiens
ttagggagctacggtgggatatcgcttgagcccaggaggtcaggctgcagtaagctgagatcgcaccactgcaccccagcctgtctcaaaagttaaaaaaaaaaaaaaaaacctgccaaattgtttcccaagtgattggtcccgtctctagtgtatagagagtgctttcatctggttctcacactggctaccagggttctccctaaaaaccctaa

SEQ ID NO: 663690 - DNA, 877 bp, Homo sapiens
gacccggctgactgcactcgacagcttagggtcgacacgaggctccctggacaaacctgactccttcatggaggagaccaactcacaggaccagcgtgcccctagcggtgttcagaaaccagtcccctcgggagcagcccctggatgcccgaacactggcttggtgttcaagaaccccttggggtagcatcccacgagtatgcaagcagggcctgcccagtgtctgtctaccccaagatcaggcccccgggctggcgactacacctaccgtgagggccttgagcacaagtgcaagcgggacatcctgctcggcggctccggagcctcggaggaccagacctggaagcggatccggccccggcccaactaagagcagcttcgttgggctcctacgtacctgtgccaaagacagtgatttaacaagcaggacctgtaagtacggggggatacaactgcacctttcgcctaccattcaggagggagatcgacgtgtggaccgaggagcggaagggcaccctcaagcgcgactgtcttcgacccgctggggggtgccaagcgcgggaggcctcaaccatcggcccaagctccttgaagggaccaccagggcatcttcaacgttccatctggggaggatctgggttgtgacaagtaaaccccgggatcatcacggcacaggaccccaggactctccgtctgtctgtccaaacctggtgtgcaagcaacagtttctacaacaacaagtgcctggggacattgtccggtccacctccttaaggtatccagatcggcagtccggggcccttcacgtcgagtggcgcctaaggtgggcaggtgctgcggagaagtgccattgcaagtttcgaacagggtggtgtgc

SEQ ID NO: 663691 - DNA, 1455 bp, Homo sapiens
gttgtccatcgcacgattgcgccacgctgtctgtccagatttgcgtaactagccttgctgggtagctctactgcctggtagatcgacgtggatccagaccctggatggggcgagactgtcgctaacgtcgtactagagtagcaattggaggggaggagattggactccttcgaactaccttcttcagttggaggagcgggtcgtctggtgagcaacgtgccccgggacttgggtctgtgagattttgagacaagctcaacaagtcaatttgaattggaagctttccgtcaccttgggacagcctcaacctgtgccaggactcttaccactcgcgttggaggcagactcctatctagaggtccaagggacatgattggcttgtgcacataaacttaattgcctcgaaggtggcacctcatcactcacgttaggacataggcgaccgaatcacctttgaacctctcgcttgatttgggaacccgagaatttccggctcgcgacctcgtgctttggacgcatgattgcagccagatgtctctcagaagggcgctttctattgcggtagtgtccaaacaacgcctgtttgggtgggggggggacacctaggggtgatcttggggggtttttcacccttacccccttggcttcagttgaggaaacaccgctacgttccattccatgctctgggagtaccagttggggggaaccgaacaagtcccaaaccgccttggggacagatttcttcaccaattattaaagccccaaagttaaggacgcccagagggttttttcacctggagtcttgggaaggttctgcaagtgcccgttagcacaaaattcccgcaatttccttccacccaaccccaagcgaacccaagggcccctgggcagctcagcttcctgacattttggttgggcctttccacggcaggcataggggaccggctgggagaggcccacccttgatgtaaccactcacttgctccgggctagcacaacacccctccccactcatcgggacgtggccccgcaatccttagcacttataacctttaaagccggcctctcattaaggacgaaaaaattggcggaccctgccaatcacactgggtgaaccccttgagaacctcgagagcagaggccctgcaattgtttcaccctggcgcgcgcttctcgaaagccaaccttggttgggcctcaactcccaggacacatattacccctggcgccatttttgccccgtaggtcccctcgtgtgagaaagcccccatgaaaccgttcttcgcgggaattcaccagagaggcttaaggaccaaccacagtggtagagtgccccccccagcgaaccgagtagcaacccacgtgggtgtcccacccaagcatctctcagtaacctcctcgcttgggcccacacttcccccacggtcgctaaccgcagctccatcgtataagata

SEQ ID NO: 663692 - DNA, 232 bp, Homo sapiens
aaattggggtatgataataggtgacgacgagggaacttaagacgagtgctcgaaagagatgcacttggttcagcctgcaataggttataacatgaatcatcatttcggactccttagtcagcactgaagacctcagggaatctggagccatcggcacgtgcaagactcgattttctccaaacgctgcatctgcaatagcagagaactctccagagagtgcctcagtccttgg

SEQ ID NO: 663693 - DNA, 645 bp, Homo sapiens
  misc_feature (186)..(186): n is a, c, g, or t
atgctggctatcggcttcctctccctgccagtttcccagcagatctgcccatggggagcagccccccgaagggcagtggcaacatcaagcagaggtacagagtgcccgagaagcttcgagtgcaattgcatgaccatgttccacgcgtgcttcatagtgcaggcaacaccatgcagaaccaaaatncgtgtgttggtggcaagatcctccgtcgttccgtgcacaacgcttgctgttgaactggagaatgagaacgaggaacgggggctagggcccgtaggtggagggtgtggctgcccgtcttcgacagtggggcgacctaggaacaccggtctgtgaacaggagaggacatctgtggcaggagcttgaccatcgttgtgatcttgtggaaattagttttgttattgttggtctcatatttgtagtttataattgttttgttgaagtttgctcttcctgagttgtactatacaagcgatacctcaatgcgggtagcctgtcttatctcgtgtcatggccctgtgacccctggaactgcggggcactgtgtcaaagcactgttaacggagacggctgactgtgtctgtgaatggtgacgaacttcccaaggggctctgagcatagtagaattctgtcgactgatg

SEQ ID NO: 663694 - DNA, 157 bp, Homo sapiens
ccccccccctttttttggtttccggggggttggtgggggggggggggttccccccccccctcccctcccctgggggggtttttggtcctggggtgcctttttgggccccccttgttccttaaaaaaaaattttacttccttttttttttcccggcca

SEQ ID NO: 663695 - DNA, 315 bp, Homo sapiens
  misc_feature (69)..(69): n is a, c, g, or t
  misc_feature (71)..(72): n is a, c, g, or t
  misc_feature (74)..(74): n is a, c, g, or t
  misc_feature (78)..(78): n is a, c, g, or t
  misc_feature (91)..(91): n is a, c, g, or t
  misc_feature (93)..(93): n is a, c, g, or t
  misc_feature (114)..(114): n is a, c, g, or t
  misc_feature (221)..(221): n is a, c, g, or t
  misc_feature (283)..(283): n is a, c, g, or t
gaccgctagcccgcagcgctcggcttcctggtaattcttcacctcttttctcagctccctacagcatgngnncnaganccctccttgctgntngccgccctcctgctgcttctntccggcgaggcgccgtgcgctgcgacacacctgccacctgcacctatcttgacctgctgggcacctgggtcttccaggtgggctccagcggttcccagcgcgatgtnccctgctcggttatgggaccacctgaaaaaaacgtcgtggtgtaccttcagaagctggttcngcctatgatgaccttggcgtttctggcctttt

SEQ ID NO: 663696 - DNA, 113 bp, Homo sapiens
gcgccgggttaagaaggtccaggtatgccagaaggtccaggtccagaaggtccaggtatgccggcatacctggaccttctctccactattatcctttaacccgagcgctacca

SEQ ID NO: 663697 - DNA, 307 bp, Homo sapiens
actctcttgatttctgtggacaccaactgggtgtcctacaaatcaattcaattctgacactaccaggattagcatcacatcccacaagttatgggctcggtcttacaaaccgcccccacttaagacactaattgagtccagaacctctcatctctacaaaaatttttttaaaaaattagccaggcatgattgcgcgcttctgtattcccagctactggggaagctgaggccaggaggttgaggctccagtgagccatgatggtgccactgcacttcagcctgggcaatacagcaagaccttgtctca

SEQ ID NO: 663698 - DNA, 185 bp, Homo sapiens
  misc_feature (121)..(121): n is a, c, g, or t
acacatcaccgcatgattgcagtccaggtctgtctgacaggggagatcagcatctgccccttggtcatcctgtgggctgtgggaccaggcctgtactcaaggcaaggtaggaacagtcttnctgttttcttcagggttgcaagcagagtgtccatgctgtgctcagattcaatgcagaccttctt

SEQ ID NO: 663699 - DNA, 133 bp, Homo sapiens
gctttcctttattataacctctagatcagtttgtataaaatcaaagacaatagctaatattagatatatgtccaaaagcatcaaggagcacaactaatatatgggatgacttagctcctgtaataattattgt

SEQ ID NO: 663700 - DNA, 1986 bp, Homo sapiens
  misc_feature (204)..(204): n is a, c, g, or t
  misc_feature (1100)..(1100): n is a, c, g, or t
atgaccaagtctacagtgcgtttgcgtatgagtgtcaagagtgactagagctaaagacattcgtagtgtgtcatcgtcacaatagcctcgcatagcatcgagatgcaaatgtcatctctctccggaggctggcctagaagcagtcgtggtcatatcggggaactcgagagatcgacgatgtgactaggcaagacaagcactagnacacatacaatcaaccctgatggcaacgcaacaatcatcacaaaatcgtgtccatgagttgcagaccagtgagtgcagcgcagcgagtatcagtgcgtatatcattgagcttgcctagtcagctagcacgtagaccagtccttatggtacttatccacgagaaagtgggccatgggggggcaggaaaggcggatattcatcgctggtactggcacgtggtgagaccagccgacaagaacgaaacttaggtttattccttcatgtggtcacacaatggccctggagaaacatccttggggcccccctataaaattccactaaagtgagcgagacattaggccagcgagttctgccaagcgtaggcgcagccgtaagtgcgcatggaatacgtgctcaatacgccaatttcccattgtaagaccacaaagggttgagcgaggacaccggaactgtagaccgttcgcccggcacacacggttgtccttgggttcgaatcctgtgagcgggaccaaagcatccctcaggaggaaagtaggcttcggacaacgacgggaccactaaccacactttacggcaaatttaacaaccgtcacacttttgtgttggagccctgttgacacccgtggtaacgtgtgctctcccgaccgcacaacacggttcctagggaacccacagatggaataaataggagataaagcataaaaacagctttcgaaaacataacctttggtcggttggatcggacttccaacgcatcagagttggatgtgggcgacgaagagatcatatgtgaggtttggtatggcaattgggggcgcactgctaggagggtgtccagaacaacgttaacatctaacttggggttggttggcacatttgaggcaatacctaggagntatggaattaatagacactttgtgtaccgctaaaagaaatagttcgcaccgggtggcaggttaccccacattggacgcccccaacttgtggaaggggtagaagcgcgagccaggcactgccaggaaatacaggtggcaccaaatcctagacctccccacacaagttcaaagagaagcaagacaactggtagctaagaacacagcgcaatagcatgccaagggaaggtaacaacggcgcacgcagggaggaacagaattgccggaacaccgaagtaaaatacacaaggagccatcactggggcaagcccgcaatcgtaaccccctgaggagcagcgtcagagccgagggaagaagactcagactataacaagaacaccccttattagaaccaccacactgggtgggtgggacgcacgccgaagcacaacaacacacacccccacgcacagcgacgcaccaagcaacacaaagcccatcactccaagacaacatggacatgacgcgaggcgcagccccgactatactcgagatacggatgctagcagcacgagacgagcgcacggccggctcaaacaactacagagagagacgacaggaacgaagacatgatgaaaagccatggaccggagcgacacaactctcagcaaggacgaacgacgccgcacgccaccacgcacacagatcgcgacgcacaccatgtggcggagagggagaaccaccgacacgtgacgaatacgtcagccacggccacgcagcgaggaagagcgaggacagagcagaacagcaatgcgaacaacaccctgcgaccgagcagaccgaagcgactccaacaccacgcatagagcagacaggacagccccgaggccagcggcagagagagaagggg

SEQ ID NO: 663701 - DNA, 236 bp, Homo sapiens
gaccccgccaggggcggccgggaccgcaaagccccgggagcccgcttaaggaggagcggcaaacgcagcgttttaaaccgcagccgggggtgcccccgcggccgagggccgacctcatctttaaccgttgcaggaaaagccccaagcggaagttggggtttcccgtttgaggttggagggcagtccccagctagggtttcggcccttgccgccccgggcctgtaaaaacgtgtttt

SEQ ID NO: 663702 - DNA, 413 bp, Homo sapiens
agtcaggcgaagtatggtgtgtctgctactaaacctttcttacattctctgtcatctcccctcatcgcagaggtctaaacttcggtcttctaagtttgattgggccctaaggcactgccatgtccatcattgtcagctagcgacacatgaacaccggaaacaaacataacttgtggtcccttaccacgagcgaaagagcgtcagctactcgggtgtaggcggggaggacgggaggcctcacacaagaggtggatcaggcgaagactgtggccaataaagctaaaactcacctgagtagtaaaaaactccagttgacacagagtagactacgaaagtggcttaagcatatctgagcacacactagctacgacccagggtgggataagataccccacagtcttggccggatgggt

SEQ ID NO: 663703 - DNA, 507 bp, Homo sapiens
  misc_feature (7)..(7): n is a, c, g, or t
  misc_feature (40)..(40): n is a, c, g, or t
  misc_feature (70)..(70): n is a, c, g, or t
  misc_feature (91)..(91): n is a, c, g, or t
gtccctncccccatcagccccccgtggcctacgcctttangaaattgctgcctcaatccttgtatcggtnctgaaaacaaccgttttgaanggaaaagttaatgcctgatttttagttttcctattgccatataaattatgggatctcccgtaaatgcatgttggtagatttcagttaaaactcccttaaacttcatttaatttacttcactttgaaagttgaacttggctgggagccatggcacatgcctgtaatcccaacactttggaagtctgaggcaggtagatcacttgagcccaggagtttgagaccatcctgagcaacatggcaaaaccttgtctctacaaaaaatacaaaaatcagctgggcgtagtggtgcacacctgtagtcccagctacttgggaggctaaggtgggaaaattacccgacccgaggaaggcaagactgcaatgagccatgatcgcaccactgcactccagcctggatgacagagtgagaccctgtc

SEQ ID NO: 663704 - DNA, 137 bp, Homo sapiens
tgaccggtggttgtgtgatcaaattatgtgttctcaggaaagtcatgtcagtggtatgtatatcattgttgggacgattagttttagcattggagtaggtttaggttatgtacgctagtcgagtgccaatgttggat

SEQ ID NO: 663705 - DNA, 409 bp, Homo sapiens
ctttccggatccccttggcgagaggcggggggtgtaacacctcagagcggtcctcttctctagaggggaggttttcaagaggtgcatcatcagcattaccggtgacctggcgggaaatacaaatcctcaggccccacctcagacctacggaatcagaatctcggggggtgggcacagcattctgattaaccaaaccctccaagtgattgggatgtattctaatggggagaccatctctagaaaagaatggctacctctggtatggaggtacaaaggacggacctcttacatcagggaacttcctttcccagagctcctcagggaatcaggcggaagtcagtcttcttctaagagcacattctaactcagtttttttcctcggtcctaggcggcttccctcttccccggg

SEQ ID NO: 663706 - DNA, 394 bp, Homo sapiens
  misc_feature (226)..(226): n is a, c, g, or t
  misc_feature (379)..(379): n is a, c, g, or t
gttcagacagcaattaagggctgggcacggtggctcatgcctgtaatcccggcactttgggaggctgaggtgggcagatcacctgaggtcaggagtttgagaccagcctgaccgacatggtgaaaagtaaaaatacaaaaataaaaaaattagctgggtgtggtggtgtgcacctgtagtccctacaaaaataaaaaaattagctgggtgtggtggtgtgcacctntagtcccagctactcgggaggctgaggcaggagaatcgcttgaacccaggaggtggaggctgcagtgagccaagatcacgccactgcactccagcctgggtgacagagcaagactccatctcaacaacaacaacaaaaagggattaagggggnagccacctggcttcc

SEQ ID NO: 663707 - DNA, 423 bp, Homo sapiens
cctaggcacagtggcttatgcctgtagtcccagcactttggaaggctaaggtgggagcattgcttgaccccaggagtttgagaccagcctgggcaacatggtgaaaccccgtctctactaaaaatacaaaaattagctgggcatggtggggagtacctgtaaccccagctatttgggaggctgacccaggagaatagcttgaaccagggagtcagaggttgcagtgagctgaaaatcgtgcaaccgcactccagcctggtgacagagcggatccgtctcaaaataaatacataaaataataagaaaaattaactgggcatgatggtatatacctataatcccagcttcttggaaggcttagacaagaaggatcaattgagcccagaagatggaggcagcattaagccagaactgctccagtac

SEQ ID NO: 663708 - DNA, 122 bp, Homo sapiens
aggcgttgtcagtgcggatgagtttcagcgaggggatcagctcttccgcatgcgggctgtgaaggacccattgcagatagggttccacctgtagtgctacagtggtgccacctcagtatggt

SEQ ID NO: 663709 - DNA, 232 bp, Homo sapiens
gtgagaaggatgagaaaagcgagagtgatgatgagaagcgtgagcacgatgaggatgctaagaaggacttcgtaaagatggagaagagtggcgtgacccacgctgccgatgtgcggaatcagactgagcaccagccctactacacatcgtctcctaacaggactgtctaggaatggcatcagactatacactgtcatgagcaggatcacactgccgtgcccacagaccagac

SEQ ID NO: 663710 - DNA, 373 bp, Homo sapiens
acggacactggctgattttaaatgagcgtaaaaggccgtctaactaatgcaggttcccctatgcatatagaaaaggctaagtatgtttggtcacttcatatgtaacaaggtgccctaatgttgtgctgtattcctgtggctttttccggtggaaccattccattcaggagcaaggagcaccattgattccaatcttgtggtggtgtttactaacccttccctgaggtttgtgtatgtttggatatttgtggtgttttagatcactgagtgtacagaagagagaaattcaaacaaaatattgctgttcttcagttttgtttgtggcatttgaaattactcaaatttaaaataaattactgggctgtggttaaga

SEQ ID NO: 663711 - DNA, 316 bp, Homo sapiens
aactgagcaactgcaccgagcctgggtcagcccaacacagggcgggtggacgtgctaggcgaggaacaagcaatcatgtttgcgtccccgtccgtcacattttccaaatcccttgcaggcagatagatactgacccataatatttgccgtgtcttggaaaagtcacaggtgacagacctcctgtagtcccacactttggagggggtacatgttcaagagaccctgacaaggaagggagttgagcgctgggtaggctactgctgaacagtgatttcttacagaatatatctcagagatgccagaaaccatcatctga

SEQ ID NO: 663712 - DNA, 401 bp, Homo sapiens
agagctattgttagtgtctctatgagcaatcgagtagaacttacacatcctaggatatctatcttcgtaattaattcttaaggtctcaagtgactcacttcatgttgtctctagatgtacatacccccaagcaagttgggggaactgagataacaattaaatcaccttctctgaagttctggctctgcagagaccaaaccttactgacttgtacagacttgtacaagtaaagacttatacagatagattttagtttcaagttacaatccgtatcttcctctttttttttttttttcctggtgtgggagtctaattaagaaaacgggataaatgacgctgtaatcaaaagttgcctggggtcctgatattcttctctgacctcaattcccggattgcatata

SEQ ID NO: 663713 - DNA, 840 bp, Homo sapiens
  misc_feature (60)..(60): n is a, c, g, or t
gctcagacattgggggacactctcagctctcggcgcacggcccaaggttccttcaaagangtctacatgtatcacgaaatccatgtgcaagctcagcttggagggtgatcacatctacacccccaagtgcatatgggtctgtcaaagcctataataacttagatgctgagcgggatgctttgaactattgaaactagaccatcaagaccaaaggtgtggatgaaggtcatccattgtcaacattttgagccaaccgtcagacaatgcagcagagacaggatatcgccttcgcctaaccagagaaggaccaaaaaggaacttgcatcagcgactagaagtcagctcttatctggcacacctggcgcacggcgcatgtagggcctattgaagacaacctgtctcaggatgacgcttctagtagactaaatagcttccatgaagggcgctggtgaaccgacagaggactcatctcattgacgatcatctgctccatgaaccaaccaggcagctgcaggcacattaacagagtctacaaggataatgtacaagatgtgatctggagcaaggacattatttcggatcacatctggatgacttccgcaagctgatggttagccctggctaagggtagcaagagcagaggatggctctgtgatggattatgaactgattgcacaagatgctcggggatctctcatggaagctaggagtgacagacggacaaggaacttgatgttcccaaagtgtgctccataatcatgaaccgaacggaccgttggcccaaactcaaaaggtaatgataggttcaccagttacagccttatgcccggttggaaagga

SEQ ID NO: 663714 - DNA, 589 bp, Homo sapiens
catgtaaagcctttaaagcgaatcctcagaaatggtctaaataaaacacttgatatgcctagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggagaaaaaaaaaaactttttgccccccttgccccctctcttttttaatcctgaaaattttttttctccccccccattttgagcctttttggcccattccccctttaggggggggtttaaaaaataccggggccggtttttaaaaacggggggggggaaaaaccccgggggtcccccaattaaaccccttggaaaaaaacccctttttccccgggggggtaaaaaaaaaaaggcccccccccatccccttttccaaaaatttgccccccttatgggggaaaggaaatttgaacgccttattttttttaaaaaaccccggtaaattttttttaaaaacgttttttttttaaccaaaaggcccaaatggggaaaatcccttttttaaaaaaatttttaagaccgcgccc

SEQ ID NO: 663715 - DNA, 2722 bp, Homo sapiens
cccgggggagttgatagaagggtccttcccaccctttgccgtccccactcctgtgcctacgacccaggagcgtgtcagccaaagcatggagaatcaagagaaggcgagtatcgcgggccacatgttcgacgtagtcgtgatcggaggtggcatttcaggactatctgctgccaaactcttgactgaatatggcgttagtgttttggttttagaagctcgggacagggttggaggaagaacatatactataaggaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggggaaaacatatccatttcggggcgcctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaagactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcggcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagatatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaactggtgaactgtcatcacagagcctagaggctcacagcctcctggaggcaagcagcctccacttcggcatcacggacaatagtaaccaggaaaccagcgctcgcgcgggctagccggcactgcagcaccctccacaccagaatggaggacactctcgtgcgtctgctgcctcaggaatctcctgaccactcgtactccctccgacttctctagacatctactcctccctgctagcttatccgcattcctcctcttccacctcctcatgcgacgagagcgcccaacccgactcacacacgtgaacctgacctgccgcgcactatgtcgcagctcccacccgaccagacggacaatacgcgccagcgactggtccccccacgacgactccctgccaaccaccgcgacagaaccacctacgaccggcactccctccaacccctgcgaaggcacctcaaccccatggaatcctggccagatggtcccatcccaattcagcttcaggcaaaccgaaatataattaagtcctcctatagaccctacactcccccatccctcaccctcatatttcttaacgggacccctggacaacattaccaccagtccactcccaaccgacac

SEQ ID NO: 663716 - DNA, 2687 bp, Homo sapiens
gaattcctgacacgctcctgggtcgtaggcacaggagtgggggccaaagcatggagaatcaagagaaggcgagtatcgcgggccacatgttcgacgtagtcgtgatcggaggtggcatttcaggactatctgctgccaaactcttgactgaatatggcgttagtgttttggttttagaagctcgggacagggttggaggaagaacatatactataaggaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggggaaaacatatccatttcggggcgcctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaagactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcggcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagatatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaactggtgaactgtcatcacagagcctagaggctcacagcctcctggaggcaagcagcctccacttcggcatcacggacaatagtaaccaggaaaccagcgctcgcgcgggctagccggcactgcagcaccctccacaccagaatggaggacactctcgtgcgtctgctgcctcaggaatctcctgaccactcgtactccctccgacttctctagacatctactcctccctgctagcttatccgcattcctcctcttccacctcctcatgcgacgagagcgcccaacccgactcacacacgtgaacctgacctgccgcgcactatgtcgcagctcccacccgaccagacggacaatacgcgccagcgactggtccccccacgacgactccctgccaaccaccgcgacagaaccacctacgaccggcactccctccaacccctgcgaaggcacctcaaccccatggaatcctggccagatggtcccatcccaattcagcttcaggcaaaccgaaatataattaagtcctcctatagaccctacactcccccatccctcaccctcatatttcttaacgggacccctggacaacattaccaccagtccactcccaaccgacac

SEQ ID NO: 663717 - DNA, 409 bp, Homo sapiens
  misc_feature (326)..(326): n is a, c, g, or t
cattgctcaagtataggatccccccaaactctgaagtagagcccagaggttccgcacccctatggaatggcgcactctgttgctgaccacccagtagccatcagagagtcgcagccacatctgggtaggcacggccacgtggcattagagtaactgaatggtgccagtgtgggggatagagcccaggaacttcgttacagcttcctcgtggtatagagcctgtgggaacacattgctgaagccaccacctgtgatatagcccacaatttcattgtgtaatgaggaaaggttccgaaagtatgtgcctcccactgtggtcacatagngtctggagacaggagagatagggcgactcgggtgtcccccagacacagccccacacggggccacactgacacgtgagcgcgtg

SEQ ID NO: 663718 - DNA, 335 bp, Homo sapiens
  misc_feature (174)..(174): n is a, c, g, or t
attcggcacagattagtctattctcatgctgctatgaagaaaatacccgagactgggtaatttataaagaaaataggtttaattgacttacagttctgcatgaggctgaggaggcctcaggagacttacaagcatggtggaaggcacctcttcacagggcggcaggagacagantgagtaaagggaaaagccccttataaaaccatcacatcttgtgtgaactcactatcacaagaacagaatgggggtaaccactcccatgattcaattacctcccaccaggtccctcccaccacacatgaggattgtgggtactacaattcaagatgagattt

SEQ ID NO: 663719 - DNA, 686 bp, Homo sapiens
  misc_feature (156)..(156): n is a, c, g, or t
  misc_feature (197)..(197): n is a, c, g, or t
gggggccccccccccccctcctttttttcctcccagggcctcttcttggtggggccagaagggggcggtggattccccaatattagggggttgcctcccaacccaaaaaaaaaaattagacctggggcgctttgccccctccccccctcccccccnccgcgccgtggtttgttataaaaaaataggtttggcccggnccccccttcaggccaggggaaacggggcccccccttgcccttttttagggggcccccccggccctttcaccccccttcctgggggggtgttttcccggctttcctttttgggaggggcccccccccaagggggtttgggacccttttccgccccttttgggcttttaggggggggtcccccccccccccttcccccgggggccagggggggggccccccctttttttgtccccccccccccgggggctggcccccaatccggccttttttttttccccccccccccgggccccccccggggggggggaaacccccccggggggccgcccccaagagaaattttttttttccccccccccccccccggagctttttccgggggggggggccgggcccccggggggcggggggggcccccccctttgggggggggggggggcccccttttttccaagggtgcgggggaaaaaaaaacgggtttttttttta

SEQ ID NO: 663720 - DNA, 588 bp, Homo sapiens
ggtggtaggcagtagaatttgggcaagtctataactgagtagcactaaaatattagatataaggaaagtaagggcttgtatgtaattaatagacttgaaagaaaattacagaattattttcttaccagatatatgttatatttataactggcacatgtccagactttattgttaaatatgaatgcatatctcaaatacattttgtgtgagtgggcaaataaaatgcatggatacaataattaattgtctttataggcaataatatttacagttcgaaaaacatatattccccaaaatagagaagtcactagtctagatacagtaaacttcctttaaaactgaagttcttacttaattcgaattagatccagttagtaattagaccaatagtatatttactacttagatacagtagacatgatcttttgatttgagctatacaattattgtcaaagaatgtcagaagagagggacttagacatcatctaatccagcttcatgctcttaaggataaaaagcttaaggcctaagatattattttaatttcttatttcactacatgctatattaatgatataatttccaaat

SEQ ID NO: 663721 - DNA, 594 bp, Homo sapiens
catataacatttaattttttatacttacttagcttttaaattccatgacaaaaatgtttcatctgtacacataattactaaaattatttcatcccaccttttttaatatacattatgggtatttatttttttaaaaaagcaacaggaaaatattaatagatttaaataccccatgtaggcaaaacacactaatatttatggcttctaaacctgttagggatttccagggaaacttgttacaagtcataatgctttcataatctgccaggaaaagatcacattaacatccctatatgcttcagtacaaaggtatgctataaaccacactgggtaaaagtaatattcctggttttattttgggaagtaattattagtaagttaatgcttattaaatatatccttaaaaatttccatcacttcagaaacccataaagttagtgagctaaaggtttgtttttgggtattcttttgttaaattcaagtaaaacctttcatcttaaaagccaaaatggggcataatagctttacaaaggtgccccagttaaatctttgggacaggagacaggaagggtacctattcaggaacccctccaa

SEQ ID NO: 663722 - DNA, 872 bp, Homo sapiens
taggaaaagggactttattaaaaaaaagtcatctgtgattgactagttaaattaccatgctgttgacattaactcggggttgaaacctacctccgtcaaataacaaggggactctccaagcaaatgtctacacggcaatccaagcagaactcaaaagcccagagggagcacgggagacgaggccatcactccacttcccagggcgacaaccactttttggtaaacaccggtcagatgctaaaaatacggccttacacactaccgccaccaaagtttataagcaataagatcagagagcaggagcagcgtgcgagcacctctaacagtccaggctgaggcgctgaaggtgagttcccagggtgaggtccactctgcccggtctcgggccgcaccagggggctgcgggggcctgatagccgaggggaacaacgccacctacgtgcgattagggtcgggaagattccggcagtcaactcgggcctcatcgggggcgcgggctcccgggaagcctcggaggcagtgtgtggccccctcggcctcgggggagctgggcaggaagaggcgtggctaaaggcgggcccctgggtgtcaaaagcatccaggctgggccgacatggggcagtgaggggcagggggtctgcccggaaagccacaccggaaggcggggagctcgcacaagcaacaccgcccgcaaagagacgtctaaaaaccaccggtggtgaggaaaagtcggctctaaagactcctgagtagagtcctctcggtgccggcgctataagaagagggggagacacacgaagcgggttccgacaacgaggaggcaacaaagcaggaaccagaagatcgccgcagcggcccacgcccagacccac

SEQ ID NO: 663723 - DNA, 246 bp, Homo sapiens
  misc_feature (47)..(47): n is a, c, g, or t
  misc_feature (65)..(65): n is a, c, g, or t
ccccaggaggtagcaggtgacacatcgttcttcaaagagggtgttcnagcgggtgcccctctacngcccaccacagtataaagagaaaggagacagctggtgtgctggggggagggggagaggggatccagggttagtaggctaagaaccaactcccccttctgtaaccacagttttccggagggggccctctcccctaaccaccgaacacggtatagggagatcctcatagcagtcgacgctgca

SEQ ID NO: 663724 - DNA, 419 bp, Homo sapiens
cgcaattctgttcaaagtgctcactatgttgaagcatgccagaaaaactcctccagactttggaattctcaggcgcaaattgatcaaaaattagctaatcagattaatgatctctgccaaagtgtaacctggctgggagatagagttatgaacttgcaacaccgtatgcaattacactgtgattggaatacttctgattattgcataacgccttatgcttataatcaagatcaacatagctgggaaaatgtctcaagacatttaaaagcctgggatgataacttaaccttggatatttcacaacttaaagagcaaatctttgaggcttcacaagcccatttatccacagttccttggctcacacatttttggaagggcataactaaaaatactaaaatgattttaatcccttcaaatgg

SEQ ID NO: 663725 - DNA, 261 bp, Homo sapiens
tcagaggatccatgacgaggagaaaggcttcagcagaacaaaagaggagcgacgaactcgaggagctaaaagcgaggcgcgggaaggggcctttggccacggtggattaacgaaatctggcaaaaagtaagctgttccttgtgccttggggagatgggtgaccttttattccatctgtatttaaaaccttctctatatcctggcaataaacatcttttggccaggtattagctgggactaaggtgtggcttggaaatagct

SEQ ID NO: 663726 - DNA, 465 bp, Homo sapiens
  misc_feature (320)..(320): n is a, c, g, or t
  misc_feature (373)..(373): n is a, c, g, or t
gctcagccgtgccccctcaagactcttgtgaagagagacggatatgttcacacctaagcgtcagtattttccctgctaagggttattacgtcttttcccctctcagatcttctttgaggccattcctccttgctccacagctcatcccagcgcgttggtctttactgcttgtatgtccacgttgctcgactatggaatgcagctgcatacaagcttcagttcgtagagaagcccttgttgttcaaattctttttccctaaatcctctcagagtaccaaaatccccttctcatcactcccctccaaagaggtgactgggcnctgcctctgtttgacaaacctctaacccaggtctgacacagctgttctgtccnttggagctgtaaaccagagagctgctggggattctggctagtccgtcacacctccacccttgctctcacccaggagatccagtcttgtgttg

SEQ ID NO: 663727 - DNA, 932 bp, Homo sapiens
tgcttggacggaacccggcgctcgttccccacccctggccggccgaccatagccagccctccgtcacctcttcaccgcgaccctcgtgactgccccataggcccccgccgcctgcctccagcgcctgacgcagaccactcggcgcgcccggcgctgtcgccctactccttaggtcgcccgtcctattgagcggacccgctgtcctacccatcgcgaagagttggccccatgtaactgcctacctagtggatctccatgtagggcgcggccgagtctcacctcgtcctaggactcctgacccgtgcgcaagcgtcctacgcgcttcccattacgggttctcaccttggtccctactggttccttaagctatcatttcttgacaccgtcagaattgcacttgttgaggcttttctggaccacggaatctttgtagggcaacaagacagttaacctttatacgtataccaacttcgatactttcgttcaacttgcacggtgcaaggaaggggcgcaatgaccaaattgcctttggcagaaacaacacctcggaatttgtacaacgggccctttggccaagtaaaagctccaaaacccggaatcgggccggcgcgggcaccggtaagaaccttcggtttcccctttcgaaggtgcatagataccaaatgtgaacgaagcccgaaggcaacctggttttgaaaatttgcccaaccgtgggtgttgccaaagccacaggaacccgggggggctcctctttgccccccgaagttttgcccccccacacccttggggggacacaacacttttggctttgggatccaaatctttctcaaaagaccaaatattgtttttgggcccgcttaacgacaaaagccaggcgacccatacagttgggttccgcgcatctactctccagaggtccccgaacgtaaccc

SEQ ID NO: 663728 - DNA, 263 bp, Homo sapiens
gccatgaagtccctgtctctgctcctcgacatgtggcttatgggcctaggcagacctgcctgtctctagccaggcaccctgctggtgcatctgcagtgtttggttctgatggcaggcatgcagcagcaggcacaaggtgcctggcccaagcagcacccagtgtgaactagcattgtgagcagaccatgggacaccagagggagcaaccagccagcacccagtgccgagaccatacgacaccatgcagcatcatatcgtcagat

SEQ ID NO: 663729 - DNA, 400 bp, Homo sapiens
gtagccaggctagagtgatggtgtggtctcgagcacactgcaactaccacctcctgggttcaagcgattcattctcctgcctcagcctcccaacgtgctagcatctcaggcgtgaggccactgcacgcatggaccgaaagcaagctatctcatcccaagcgccaacctttatcaagtctagcctagtcttctatcgtctcctatgtgtccctcatgagtgatcacttctgagtcactcctgcgtggagagctcagccactgggggcgatatctttcccattggcacagtgtggttattggaagtatcctctttttagaacagaacacggattggaggtgctctctggggatatcctcctaccaagctgactgtagagatccttgtggtgcacagggagga

SEQ ID NO: 663730 - DNA, 136 bp, Homo sapiens
tggcgtatctagaggatccctatgagtaggaagatcagtgtttgattttcagtccttgtgatagtttgctgagaatgatggttttatgttgttaatgtggtgggtgagtgagccccattgtgttgtggtaaatatg

SEQ ID NO: 663731 - DNA, 824 bp, Homo sapiens
  misc_feature (497)..(497): n is a, c, g, or t
  misc_feature (505)..(505): n is a, c, g, or t
gggagaaaggagagaaaggaaagtcgcgagtgagcctgccgaccaccatcagcgcagcagtcctggagctgtgagtgagattcgggaccgtacattcctgacctacccctgtcgtcccgcacatccggccgcttctgtccatcgcgtatcccactatccacagcacaatctcgcttaaaatatcactgggtgcggaatatacctcaattgacacgttacgtatggggcgatgcaggtaggacattgggccgttcaccctcgtagcgatattctaccatagagaaggccactaatcagtgacaaactcgggcagctgcagatgtcggttcgatcccatgatacaaaatccctcgaagaaataacaagaaagcagagacagtgaggagagagagattcaacgcaacagtaccgcaggaatgcaagaagagccagatgatgacgcgaagtacagacactgaacccgaaagaaagtgtcgaccagacagagggcaatgcanactaaganctcaggaccgttgagggcaacagcgggtgggcacccccccgaggaacgctgggtccgcatccaacgcgtggtctcctgtgcaatagacgagtcagtagtcacaacccacggcatacgaggtaggcacgcagctcagggtccaggatcctgtctcggatggcccatctacctcgtctccggcatggacttatgccgatcacgagactcacgatcaagagcagggggtcacggaccgacgggggcgttgacgtgcacggggtgcgcagggagacacgaccgttttggggactttgtggccggcagactcgtcgtgcttcgt

SEQ ID NO: 663732 - DNA, 696 bp, Homo sapiens
ggttccggactccagctgtctcgtcttcagacagaagatgaagaacctcggggtggaccatgggtatctcagccctggcagtggtgaatgtcagctcagcctcagaggttgagcttctacattgatataggacatgatccacatcgcgggcacctaagggtcggtccaggcagtttatcggggatttcttgcagtgccgtcagatcctagcaacattttggaggagcttatactctgaaccctgaatgaagatgggagacacgaggaccttggatgcatattcgactatcaacagttgcgagcgtaacccttagtatgtggactgtaattgatagggcgaggaacgtggttatcttggcttacaccggtgtacaaacccgtttgatcgcgtacgcattcatgcccactctaagggcccttgtcagacctcacgtataaccagacgtttagaagggaacccgaaagctggttctcaacatgttggactcttcgacgctatgaaggaatcgtttgggaagtctcacgagaatatacaacataatagacataggacatacataaagagaggcggtggggtcaggtgacgtgaggtgaagggggtcaaaatgtggcgtgaaggaaagtccaagggggggctttggcgcaaatgaaggtagctgcggggagggaggttggttgaggggtgaactagggggg

SEQ ID NO: 663733 - DNA, 963 bp, Homo sapiens
gtccaagaaagagcaagagaggcatgatcctttatgtcacctattctcctcctgaagatgaccatgccatcatatttggcatctatctgtttgaagccagttgctaggtccagtcttctcttgagggtgggcatttacagcacagcagtgtgcaatcacacaggaggttaaaacatcacaccagcacaggcgacagcatgctatgtcacaggctggtgcaccattcttcacacaggcgcagtatggtccaagcacatgcaatcaagcaaccaaggcatttcaccagtcatatcccaggggtatagtgggcagcacagggcagcagtcatagcaatctcatgtctcagcgggtcaatgggggaacaatctcaccttgccaaggtaggttcgccataattgcagcatcaggccttggctgtcgcacatggatataccaggcaagtgtaaccagcatgcacagtaatcacgagcagcaaggcacccttgcattgaattccgtctttgtacgatcaccattctcactttaaagtttgggatatatctagggtgtacaaccccacgcccgggaccccgaaaggctacgaaggtcattagcagggagggagatactggttctcttcccagcagcaccacctacactagcaggttgcccagttgacacggctacgcgacagttgccataaatgacagggcaactaggacagtgtaccagggaccatattatcaggaccctttcataaatagtgtctcataggcgaggctcctgggtgacctacctttggcctacgttacgaaaattcaccgtttcccaagaaacgccctgcttaggaacggcaagtatagccatggttattcgggcccacacatatggtgtgccccattggatcagtgtactgtatatcctgggctatcacgggacaatctcccggcattacgcacacgggggcactagaatgtgtgggc

SEQ ID NO: 663734 - DNA, 117 bp, Homo sapiens
atcgtaaataacaatagattatttctggaacctcgtatacacgttgaatactcacatagtcaacaacgtacattaaaaacggaaacaaattcggaccttgaacattcttttactttt

SEQ ID NO: 663735 - DNA, 893 bp, Homo sapiens
  misc_feature (14)..(14): n is a, c, g, or t
  misc_feature (44)..(44): n is a, c, g, or t
  misc_feature (52)..(52): n is a, c, g, or t
  misc_feature (60)..(60): n is a, c, g, or t
  misc_feature (62)..(62): n is a, c, g, or t
  misc_feature (88)..(88): n is a, c, g, or t
  misc_feature (94)..(94): n is a, c, g, or t
  misc_feature (100)..(100): n is a, c, g, or t
  misc_feature (129)..(129): n is a, c, g, or t
  misc_feature (144)..(144): n is a, c, g, or t
  misc_feature (146)..(146): n is a, c, g, or t
  misc_feature (149)..(149): n is a, c, g, or t
  misc_feature (154)..(155): n is a, c, g, or t
  misc_feature (159)..(159): n is a, c, g, or t
  misc_feature (162)..(162): n is a, c, g, or t
  misc_feature (195)..(195): n is a, c, g, or t
  misc_feature (213)..(213): n is a, c, g, or t
  misc_feature (247)..(247): n is a, c, g, or t
  misc_feature (251)..(251): n is a, c, g, or t
  misc_feature (253)..(253): n is a, c, g, or t
  misc_feature (255)..(255): n is a, c, g, or t
  misc_feature (279)..(279): n is a, c, g, or t
  misc_feature (281)..(281): n is a, c, g, or t
  misc_feature (317)..(317): n is a, c, g, or t
  misc_feature (327)..(327): n is a, c, g, or t
  misc_feature (344)..(344): n is a, c, g, or t
  misc_feature (388)..(388): n is a, c, g, or t
  misc_feature (390)..(390): n is a, c, g, or t
  misc_feature (411)..(412): n is a, c, g, or t
  misc_feature (414)..(414): n is a, c, g, or t
  misc_feature (423)..(423): n is a, c, g, or t
  misc_feature (433)..(433): n is a, c, g, or t
  misc_feature (443)..(444): n is a, c, g, or t
  misc_feature (504)..(504): n is a, c, g, or t
  misc_feature (556)..(556): n is a, c, g, or t
  misc_feature (560)..(560): n is a, c, g, or t
  misc_feature (565)..(565): n is a, c, g, or t
  misc_feature (575)..(575): n is a, c, g, or t
  misc_feature (585)..(585): n is a, c, g, or t
  misc_feature (649)..(649): n is a, c, g, or t
  misc_feature (727)..(727): n is a, c, g, or t
  misc_feature (729)..(729): n is a, c, g, or t
  misc_feature (773)..(773): n is a, c, g, or t
  misc_feature (790)..(790): n is a, c, g, or t
  misc_feature (805)..(805): n is a, c, g, or t
  misc_feature (809)..(809): n is a, c, g, or t
  misc_feature (885)..(885): n is a, c, g, or t
tcggtttttctttnaattatttaccaaaaaaaaaaaaaaaaaanagtgattntttccctncncccccaacatttccgtttaccaaggncgagtnggaganaaattcattgaacaacgatttgtgccccnggcctggagcaaatncntcnccccnncccnacnccaccccaggcagcagggacagggcaaagggcnccaggcagaaatcctggnggctgggcagcagagtggcagtttggcgatcgcntctncncnccattcccagagcattcagacccntncccgtctgtccccccaccccaagtcccccagtcccncaaaggaggnagggagtggggactgcnggaagcaggacaggggcccgggtggcctgggcagccccccacananctggcagaggggacaaccccnncntctattgcncaccctggcncagccccccnnccccgagcagtaggccacaaaatgaaaaactttccaaattcagagagccgcggtgctgtntgccaggctcaaggaggggaggtgtgtggttgtgtggcttgttctggaaganaganatgtntttttaagtnactccatganggggccaaggcaacaattttgcctctttgcataaggggtctggacatctcagggtcctgtagtnactgggcctcttcccaggcgagttcagaagcctcggaagaagcctttcccccaccggcggacctcctggctccatcanangaagaggcagcccccaccggccacaccagcccctccggactgtnacgacttttggccactnggggcgacctctttntctnaacacctggagaattctgtaaaatgaccctggagaaaaaccttttatactacatgtttttccataaaatggcagcnaagtcccc

SEQ ID NO: 663736 - DNA, 176 bp, Homo sapiens
accgtgccgtgagactcatatctcttctctcttttttctagcagttttattgagatggaatccacatcccatgcaattcacttacttcaaatggatattcaatggcgtttaactatatatcacagaccagtgcaagcaccaaccttagatccgttttagaacattctcattagccc

SEQ ID NO: 663737 - DNA, 239 bp, Homo sapiens
  misc_feature (45)..(45): n is a, c, g, or t
ccctttttccttttttccccttttttggcccgcctttcccatccngggggaaactttttgattggcagtttgggtcccaaccagggattgttttggtttttgttccctttttgactgcccaaggggttcaaaaccccagcaatcccttcctttccctccctttttttttggggggagttggaagggactaaaattgtggggggaaggtagggggcccctcaataaaagggaaaccccca

SEQ ID NO: 663738 - DNA, 139 bp, Homo sapiens
cacccttatcacaatacaagaacactactgattactcctgccatcatgacccttggccataatagtgatttatctccacactagctgataccaaccgaacccccttacgaccttgaccgaatggggagtccggaactag

SEQ ID NO: 663739 - DNA, 916 bp, Homo sapiens
gtgtactacccggtaaagggctcgaatggacgtctatccgtgaaggttctctacctgtaccctgacggacaacgtcattatgatttgagattattccttaaccataccagtattatttgacgcttactgcatctgcactcgagaggatggttgcttttgatcaaccatgctgccggcctgatagtagtcttccaagcagccaatggtggaaggagtctacacagtagcattgtggtggattcctgaaagtctccgatacagcataggggcctcgagcgtcactgggttgttgagtcaaccttcatgcacgctgtgaagattactttggcgagctacaggttgctcaggacagatcaagttgggctaaatgcattattgcaacggcctgatgatgattccatgtcgttatagtgatactgcagtagggtgcgatgctgatctataatttgttattagccgatcattctggttagcagtcaattgcagaagaaactgttagacaattgtggtatgaagaggatatcggagtgtcatggttcttagaagtgattagctcttgtagatagaccgaggtatttggcaaataggaggggcctaagcggtgaggatgtttgggcctcagatgatgtccggtgtcttgaatcgcttaggtcagatatggtccactacatgctactggcaccctgtgcctccttgaaccatgcggtttcaagcatagaagggtgacgccacggtccagcaattagtctttgggttctggcaaccttggctgggctggtttttgccgctcacggggtgaggacccccgggaggggagaccagggtctgcgacacggttgggcccacctgtcccccgtgctttgaaagccagcgcacaggaacaccgactttcttgtggctcgcacacctccctgaa

SEQ ID NO: 663740 - DNA, 178 bp, Homo sapiens
tggctgcagttaaaaggtcttttgcattttgctctggctttcaggccaaaagcatgcatttttttacaagagcatcccaacaacatgctgtaaatatttaaagtttaaccttatgtgttgatatttgaaagaaaagccctttgaatatttccttttttaaaaataaaattgcccatta

SEQ ID NO: 663741 - DNA, 843 bp, Homo sapiens
  misc_feature (1)..(1): n is a, c, g, or t
  misc_feature (183)..(183): n is a, c, g, or t
  misc_feature (191)..(191): n is a, c, g, or t
  misc_feature (200)..(200): n is a, c, g, or t
  misc_feature (363)..(363): n is a, c, g, or t
  misc_feature (370)..(370): n is a, c, g, or t
  misc_feature (397)..(397): n is a, c, g, or t
  misc_feature (480)..(480): n is a, c, g, or t
  misc_feature (519)..(519): n is a, c, g, or t
  misc_feature (548)..(548): n is a, c, g, or t
  misc_feature (573)..(573): n is a, c, g, or t
  misc_feature (575)..(575): n is a, c, g, or t
  misc_feature (633)..(633): n is a, c, g, or t
  misc_feature (641)..(641): n is a, c, g, or t
  misc_feature (653)..(653): n is a, c, g, or t
  misc_feature (670)..(670): n is a, c, g, or t
  misc_feature (739)..(739): n is a, c, g, or t
  misc_feature (779)..(779): n is a, c, g, or t
  misc_feature (824)..(824): n is a, c, g, or t
nttcaagacaccgaaatcagttaacaaatataagaactaaacattaattagtgacagtaaaatggcagaaagcaaatataaaatacaaaaaacagctttactcagactttttgactgccatgtcctcctttagaaggactacagtgtggctacttggtctcttctggggcagaatgtggcagncctgaggngtgaaagcntctgccggtgacagaaacagctcctaccacagtaggggtggtctcagataaagcagggatggcttctggagtggaagtggctcctgtgtcactgggggtggtgtcagatgtgaaaggctggagtgtcttgacggcagcgggtgtctgtgggactgggtatgangtcagcntgaacagtcatggcctcttcttctgtntccaattctgtttcttgattttgaacttcctcaccctcttctaccataagcaggtggtagttgtataaagtctgatgataatnatgtatagctgtattaaatgcaatgtgcaatgttgtatnaaaaagtttgccaatctggggccataatnttttaattatttgtacttcatgaananggtctctctccattctttctagtagttgggaaaggttctgttggaattatatgcaatnaagggggngagcggtgagcngactgaaagctggagtnagtacaaaacagttttggaagagggatactctggcgaagatataaagtccaagtttggctctagacatngccactaccaagcgacggacatccctcagatggcccactnccctggttcgtaccacacaaagaagaatatagttattctgttgancttgaaatctatcaacagt

SEQ ID NO: 663742 - DNA, 1336 bp, Homo sapiens
cagggaaccccgccccctgcctttccctctcccctagaaaagggggggcctgtctcacccccgagacctccatatggagcactatagtaccacatccgagaaaggctcatgtacagtcgcatatgctctatccacatccagagcacctagcatgattactcgtgcggtatgcagcaaatggccattggattcgagagaacctgatgttggagacacagtacgcgttggacattgcatcgtctggcgctagatgactgcggtgacacactcgtatgtcgcatattcctgcgctcactcgccttacgccgctccatctgtcgctcaacacgctgtacccaggcttcagcatcatgtcgcacagtgctcgtgcgctatcaagtcggatgtgcgcgagtgatcaataccgtagtgtgtgggcatacacttgatggatcacccctacgcactcaagagtcaaacttataggtcgcatcttaatccaagacatgaagcagacacaccctacagacatgatgacacacggacactctctgactcgcgacacacgacccacttgagtctcacacaagcgagggcaacacaatatctcactcccgacgtcgcgccaacccgcacttaatggtaatacatccaatgtgatatcaccacatcgacaacatcctatgtatttcctagtgcagacttggcaaatttccactcacgtgacgtatatgcagactacggatcaagcggtcgtcgactggtcagaacgtgatccacctcgaagtgacattcaaacaacgacaaacgatcggactcacagacatcagacatctagaagcacggcaacaacctaaatcatacactcagaaacacatcacggccacaccacatgctccaacttcctacaagaacaaactgccgacggcaccacatacaaaccaacaggcagaacagaaaagaacacgccacacgtgacataacgaactaacacaaccaccaacaacgacgcatacacagacactagacgggcacgcccagacgaagaccaggcaccatacgccaaaaaccacgatagcggacagacttaggccagcataggaaccgaccagcagaccagatgaagggacaccaagcacggcggagacagacgacacagagacaccaccaagatcgactccacgatgccaatgagaggacaacggccgcactacacatccacacaacataggcacacagcaatacgaatagagcacaacaacacaacgggtggacacaaaccgcacaaccacaacatgaggcatcgagcacacagcccacaacacaaaaaaacagcgcagcacaacacaccccacag

SEQ ID NO: 663743 - DNA, 1112 bp, Homo sapiens
tagcagtagcaaaaccattttttaagtgcaaaacaaaggctgggtccttgtgctgctcccagctctttgggtttacaaattaggtttgttgggcccacagaaggacggacctttgccccctttcagtgcctcccaggaaacaccttatgccccgtgctcgtggtgcagtgcgggtgtgggcgtgggccccacaggggtgtgcaaggagtgggagttagttgaagggaggttcgcgggaagaaggaagttcgggaaggacgcctaggtgggaacctgtgggcgggggttggggcagggttggcgggctcaagtttgggaaaaaactgtgtggttccagtgtgtggggtgccaaaaggggctctcgcagcgtgggtgcgctcacggtgctccggggtctcacacaaactctcccgtgggttcacacattgccggggagtaaaggagatgccgcctgtgcgcctcacaggtgtgctgtggggccaccacaaggggtttcggccacatcacaccttagagcagagggggtcctcgtcggtggcccgccctggggtgggtgaggcgtgggcgtcggcgtgacaagtggcgtgggcgtgagtcaccctgcgacactgttgtggacagcgcgagtgtgtgctgcgtgagacacagcaagccccgcggggacagcgcgcgctgtggtccccacagcatgtcacggagaaaaaaaggggggcttccccgctcaacagatcacccggtggggtagaacacctccacacgtagaggagtgcaagtagaaaacaggcgccgccctcagcggggaccatcatgtggcgcaccggcgagaaaacgcccccgatcaaaaagagaggaggacacagcagctgcggacccctgtgcacacccacccactggggaaaaaaaacttgcggaatgaaggggacggaaccacagtttttgccgctcctccaactaacggtggccccagaggaacaacgccgcgaactcgaagacacgaaggatcatccatacggaggaggcaagtgagaattatccaccagcgtcacaaccgccccgggaaagatgtcgtcaggtaatggagagcttgcgaccccaccacccaccacattgga

SEQ ID NO: 663744 - DNA, 1173 bp, Homo sapiens
gactatgattaacaatattgtggccgggtgtggtggctcatacgctgtaatcccagcactttgggaggctgaggtgggtggattacctgaggtcaggagtttgagaccagcctggcaaacatggcgaaaccccgcctctactaaaaatacaaaaaattagccgggcctggtggcaggcgcctgtaatcccagctacttgggaggctgaggcaggagacttgcttgaacctggaaggcggaagttgcagtagctgaaattgcaccactgcactccggctgggcaacagagtgagactttgtctcaaaaagacaaaaagaaagactatttttttcactactagggggggggatatatatagtatccgggatcgcctattttcgcacaacataggtaggaagagacgatttcggaatggctcctccatccacaaaaaattgacccaggtatgagggcgacggggggggcgcaaatacctgggatgtgcgatttccccatgaagtatatacatcccactggtaccctcatgggcttttgtaccctcatgattgtgtccacttacacacccgggtcaaaaactacgggaatacacccaggaagctatgactcgccacacacttcattcttggaacacccaacggagggccacacaagtggtccgacacacaatacggggggggccaaacactccaagaggtgtgccccccaaaagcggggggagacacggggggccccggaagacacggggtcaccgagtaccccggaaacctcggacacagcggcaggcttggtggagccagcgacaattcccccccgcaatgtcacagcctaccgcgaataaacccgcaccactataaacgacacctctcctccgttctcatgtctattacttcctcttcgtctatgtatacctttctctcgcgccgtcgatcgacagacgaaaagcaaagacacgacctagcgacgaaacaaacgacaacaatgcacaagaggaccaagccaccgagcagacgacaaacatcaagccaagaaacaaacagcacaaatcgaacaaccgccaagaacaacgaaccccagaaaagagcagacagacaccaacaaaacacacacgaccaccaacaaaaacacaagaccgaagcagaagaacacacgacacagacgacaacaacacgtaa

SEQ ID NO: 663745 - DNA, 384 bp, Homo sapiens
gtgctgtgtggccccttgccccccagtgtgctggatcgaaggggtattttgccactggaggaaagcggaagtcgatctcccagttctcaagagaccagtggcagcctcttgccacagagcccagtccccacagaacacctgtactcaaatgagatgccggaggacagtagcactcccgaagagatgccacctgcagagcccccagagccaccacaggaggcagctgctgctgataagtagcctatctatggcagagacttttgtttgggattaattacggctatgagagatttcaggtgagaagttcctgagacagagagcaagtaagctgtcccttttctgtgtttctctggtctgtaggcacccagatgcacactggcttct

SEQ ID NO: 663746 - DNA, 139 bp, Homo sapiens
tagatctccatctgctgagctgcctctgccttcctgaattcatggcatgaagagggctgacccattgaatggagacattggcctgagagtctcctgtagagcctgtgcgtgttcttccccctgcagctctgctcctgtt

SEQ ID NO: 663747 - DNA, 282 bp, Homo sapiens
agcctgggcgacagggcgagactccttttcaaagaaaaaaaaaacctgaaccagaggggtccaaagggcaagggacaaaacccggcgggggggacccaggggaaccttctccccttatgcctttccatccttgcaaagagcccaccttggctgggagccattttcatggcccacacagagtaggtaaagagtccagttttaagccggccacggtagctcacgcctgtacccccagcactggggaggacagggctgggggatctttggagcccaggagttcga

SEQ ID NO: 663748 - DNA, 424 bp, Homo sapiens
ggcactctaaccatcgtctaccgagcccagcgaacaaccagccccctgatgtgcgctgtctctacaatggtgtctgcctccgtgaccacggctaagcacgagcagatcgtggtcctcgactcgcccatagacctctaattccaaggccccttctcagatgtagtcactacaaatcttaaattgcggaatccatcgtatagataagtgtgtttcaaagtctatactaccgtgcctcaccggtactgtgtgaggtccaacagtgcaatgattgacccagggtcacctgtaactgtttcagtaatgctacagccctttgactatgatccgaatcacaagagtaaacacaaggttatggttcaattgttgctcaactaaacgcttcagatatagaacctgtgtgcaatgagacagaacctcatgaatt

SEQ ID NO: 663749 - DNA, 407 bp, Homo sapiens
aaccaaacggggccgggacttgggggcttacctgcgacaacgggtagcacaggccttttgggagggaaaaaatacccaggttgcaaagcctgaggcctgtgatcaaatgtacgaaagcttagggggactccattcaaaatactacaaacacaaggacccttgccccaaaaacaccagcttcagtggcctgttgttggaaaaggacaaggtgatcctgtccccagaccccttggaaaaggttaaggaaataaataaaggcatgtggaaaaaactgcaggaaaagtttgcccccaagggtcctgaggaggattataaggcctgaggtcaggccttaccttgggcacaaacctaggggtggagttttgtacattgccattgtcaataaaactgccccagtttccccttta

SEQ ID NO: 663750 - DNA, 250 bp, Homo sapiens
ccaatgcagcggactcggtagtacgctggcgctgcggcgcaagaaggtgctgagcaccgagtgcacatggcagctgtacgagtctggctcagagccgcggcgcggcggtcctcgacccccgaccgctgttcaacgatcctgcgtggacctgtctgacagctgacactgttggccccggtcgccggtcgttccaacatttctcacagtccactggtgtgcccgcgggagtacggctagcagagtcgaggcc

SEQ ID NO: 663751 - DNA, 349 bp, Homo sapiens
gggcccccaccatttccctttttttacctttggggttcctcccacctttgagggctccccaccaccaagggaaggcctgttggcccaaccctatttccttttttttttcacttataactcaaaaccctttttgtcctcaagcctttattaatttgtttgtgcacattaagcctaacggttttggggagggggctgacaaaaaaaacggaaagggcttggtccaaccaggtgactttcaaaattcttcaacagggaaagccatccctggtcctgttgttgctcaaggtgttctggtcttgttccgggttgaggttttggggcttaacatccaacaggaccttcaaaaggc

SEQ ID NO: 663752 - DNA, 152 bp, Homo sapiens
gtcagtcggagctacgctgcagaagaaccgcctgcgagtaactacaaagatgcctgtccgtgcgcattctgcggccgtagtcccggcctttcctcggcgggcgacttggttccagaatgctttgggtcagcggcattgctgcaaggacttca

SEQ ID NO: 663753 - DNA, 731 bp, Homo sapiens
tgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaagtttcattacgaagaaacttttatgagacgatttgtacgccaaactatgagggaaaacagggaacaaaattgggaaccgggggagggggctggcagccccctcgcccataaggagcctcccgctcaccgacttgggccttttaagcaacagacacaaggaccaggctccggaggacggaagggggtcacatacgggttcccatcagccgtgccagaccgaccgaccgcccgggcagcagaatgccgcgcgagaacgaggtatgcaccataagacctaacgggagacggaggtcataaaagtggagaatcgtaactaatgggctttaagacccgtcaccgcggaaacctcatgtgaaaataccaagggctagcgtgtaacccgtgtcagtgacatttaagaacactggggaatcgat

SEQ ID NO: 663754 - DNA, 321 bp, Homo sapiens
agccggtaccttttctctctacagtcacaaatttctttttcttttttttttggaaatagagtttcgctcttatggcccgggcgggagttgcagggcttgatctcggcctccgggcaacctcttgtgccctccggggttcaagtgattctccgtgcctcagcctccgcgattagcggggattacgggcttggcgcaccaagcgcccagctaattttggtacttccagtaagaagatgggggtttctccacgtgtgggtcagggtgggtctcagaactcccagacctcagggtgatccacccaccttcgtccaaccaattatg

SEQ ID NO: 663755 - DNA, 155 bp, Homo sapiens
ccgctcttgcgtctatcagctgtcttgataccaacaagaggtcaatgttagaatccctgatggtagcaagatgcgcgtcttctcccatcagcggattttatacattgacctcttgttggttatcaaaaacagcagtctgatgggagcaagatgcg

SEQ ID NO: 663756 - DNA, 683 bp, Homo sapiens
  misc_feature (41)..(41): n is a, c, g, or t
  misc_feature (120)..(120): n is a, c, g, or t
  misc_feature (127)..(127): n is a, c, g, or t
  misc_feature (190)..(190): n is a, c, g, or t
tattattataattattatatacccagatcacttcaggcgtncattccagcagagtggccctcatccttcagaatgtggatctgccgaattgaagaggcctgatttcagctccgcaggggnggatttntgttttgttttcttgttatcactgtcacacagcttataacatgtatgcttttcagaatacagntgtctagccaagccatcaagtgtctgaaattcaatattgggttatgcaaatacagcaaacttttatttaagtagatgggggggggtggttaaaatattaggaatcctagaccatattttcaagtcatcttagcagctaggattctcaaatggaagtggtatatataatatgttaaaaacattttgctttcctggctaattatttgatccttttaaattcaaatttgaatcatttggcatgtatgattatttctggtaaatggacacaggatttaagatggatatttggggggtctatttggtctgatatcttttgggctaattatgagggacccagattggttctttggttctttttttcaaattgggggtagaaatactgggataaatatgcaggaggtgatataaagaattatatcccaaggggatataaaagccattaccgatgaaaaagaaaacaaaagggctcgggtggcctcagggggggagcttgg

SEQ ID NO: 663757 - DNA, 651 bp, Homo sapiens
  misc_feature (71)..(72): n is a, c, g, or t
  misc_feature (77)..(79): n is a, c, g, or t
  misc_feature (89)..(92): n is a, c, g, or t
  misc_feature (94)..(95): n is a, c, g, or t
  misc_feature (100)..(102): n is a, c, g, or t
  misc_feature (104)..(104): n is a, c, g, or t
  misc_feature (147)..(147): n is a, c, g, or t
  misc_feature (225)..(225): n is a, c, g, or t
  misc_feature (231)..(231): n is a, c, g, or t
  misc_feature (297)..(299): n is a, c, g, or t
  misc_feature (442)..(442): n is a, c, g, or t
  misc_feature (501)..(501): n is a, c, g, or t
  misc_feature (519)..(519): n is a, c, g, or t
  misc_feature (537)..(537): n is a, c, g, or t
  misc_feature (539)..(539): n is a, c, g, or t
  misc_feature (556)..(556): n is a, c, g, or t
  misc_feature (578)..(578): n is a, c, g, or t
aaaaaaaaaaaaaaaaaaaaaaaaaaacaaaaaaaaaaaaaaaagcccctccctctccttctgcacagganncactnnngggtaacagnnnngnnggggnnnanggggaggacacaggactagcccaccaccttctcctcccggtcncccaagaagactgcttatagagtggaggaggcaaacaggtcccctcaatgtaccagatggtcacctatagcaccagcnccaganggccacgtggctgcagctggactcaatgaaactctgtaacaaccagaagaaacctgctttgggatnnnagggaggataaagccatgcagggaggatatttaccatccctaccctaagcacagtgcaagcagtaagcccccggctcccagtacctgaaaaaccaggtcctactgccttctggatgctctcttgggccaggaagggaaaagtntgggaggaatgtcttccagctgctaacgagaagtctgcacccacttgaaagggttaggngaataaaaagcagcattntttaaagaactgcaagtngngcaccaccaggcccctnccttggactttcccgtcctggncagcctcagagcctgcacactgaagctgggttcaaatcctgggtccttcctgcctgaaaaaatgacccctgga

SEQ ID NO: 663758 - DNA, 968 bp, Homo sapiens
  misc_feature (41)..(41): n is a, c, g, or t
  misc_feature (120)..(120): n is a, c, g, or t
  misc_feature (127)..(127): n is a, c, g, or t
  misc_feature (190)..(190): n is a, c, g, or t
  misc_feature (819)..(819): n is a, c, g, or t
  misc_feature (829)..(829): n is a, c, g, or t
  misc_feature (968)..(968): n is a, c, g, or t
tattattataattattatatacccagatcacttcaggcgtncattccagcagagtggccctcatccttcagaatgtggatctgccgaattgaagaggcctgatttcagctccgcaggggnggatttntgttttgttttcttgttatcactgtcacacagcttataacatgtatgcttttcagaatacagntgtctagccaagccatcaagtgtctgaaattcaatattgggttatgcaaatacagcaaacttttatttaagtagatgggggggggtggttaaaatattaggaatcctagaccatattttcaagtcatcttagcagctaggattctcaaatggaagtggtatatataatatgttaaaaacattttgctttcctggctaattatttgatccttttaaattcaaatttgaatcatttggcatgtatgattatttctggtaaatggacacaggatttaagatggatatttggtggctctctattgcactgactactataggcctaaaataataacgtccgccattgctataattttttatttcttctcggcctgcgcttatcactcctggattaacactcctcctaagcgatccaactcacgctcttccaggcactatctaccccacttcccccgacctactacaataatcactctttgtaatcttgggtaatctatcgacccaaaaacaattcacaacccacgttactcagcctcgtcaaacctcacaaggagttccgataccccccaaccccctctctttcatctacatccatctttcaccatctataatataaaacaacgagcattagcntcatcggganacctggaactatctcttaatgagtggagatctcaatcatcctcccacacgacgtgctgtcgcaggacgaacggccggacatagtttgtatagcaattcgtcctccccacatacgtaacctattcaccctcacttcgccn

SEQ ID NO: 663759 - DNA, 238 bp, Homo sapiens
tactctagaggatggtttcttgccacgactcgtatggctggacagcacacatggagacgactatgacagctcaagccctacgagacaactcaacaatgggttacatggcagcaaagaaacacctggcgataaaccctgaccattccatcattgagaccttcaggcaacaggcacaggctgctaccaacgaccagtctgtgcagggctctggtcactcctctgccctttactgaaacct

SEQ ID NO: 663760 - DNA, 699 bp, Homo sapiens
  misc_feature (69)..(69): n is a, c, g, or t
  misc_feature (261)..(261): n is a, c, g, or t
tgtctggggggtggcccggggcgccccacagggtcctttccaaggggtgccccggttccaatttccccnacaacccccgacccaaggggctgggacatttgtggtttcccttttaaaggaaaaccactttctcttcaactgggttaaaccgggcgaagtgggttagtctctccaaagggaggctggttccccaaggaaacaaaacctgtgttcggccaacaactgtgtgcgggcctgggggttgcatgtgtcccctggaantgggccctaaccattccaaacccccgcattgcttgtttccccctcctgggccgggggtttggcccccaaagggtttaggaaagctttttccctaaatccccctgtggggtggggccctggaggggtgctctgtgttaataaaaatgtaaggtttgccccccccccctgttgccggcatgggggtagtattaaccccccccccccctttgtttccagcccccgaaaaaggggggctcagggggaggtgtgggggatgcccctaagctcctgctttgggcctgttgttttgccccaacccgccccctgcccggctgcccaaaggggtggatgccccccggtcccccaacaaacctgggaacccaggaaaattcccagggcttggggaattttaaattttaagggccattttttttaataaaaggggcctttgggatccca

SEQ ID NO: 663761 - DNA, 194 bp, Homo sapiens
gatatctatggtacaggaacttttgtagtttgtctgtggagtccaggtgacagtgccattgatacctgcatgactgttttcgtactgattcccttcaaaacgtccatctgcattatcaaacaaaacgatgtctggtgtccagaccgagtctgaaggaacacgtataacttttattccatcttgagcctgtgtct

SEQ ID NO: 663762 - DNA, 252 bp, Homo sapiens
aaagttctcaaggagccaggtccattctgtcctcctcctgtgctatccttcacctgtttgcttttatcaaaaggtagcaaaagagttatgtatgacagcaaagaaggtggcagcagctccaggcatcacatccatatatcacaatgtccacaggctagaagagagaccctctctctctttttttaacctcaaagtaatctccctcagaaacatttccctctttcttcccaaatagatttcccttcatttgtt

SEQ ID NO: 663763 - DNA, 105 bp, Homo sapiens
tttccaaagctggagatctgctacattaacaaggtggagctggtggccattcttccgtggcaggctgagcgctccagatcttcagataggggtacacgagtctct

SEQ ID NO: 663764 - DNA, 207 bp, Homo sapiens
ccatgaaccagatagagcccggcgtgcagtacaactacgtgtaccacgaggatgagtacatgatccaggaggaggagttggaccccgacctgctcctggacccagccttggagaagcagcagaggaggaccttcactgcctggtgtaactcccaccttaggaaaggcggcaccagattgagaacatggggaagctttcaggagtggc

SEQ ID NO: 663765 - DNA, 119 bp, Homo sapiens
ggacttcaagaccaacctgggcaacatggcaagacttgatttctacaaaaaaaaattagccaggtgtagtggtacacacgctctagtcccagtcccagctactcgggaggccaaggagg

SEQ ID NO: 663766 - DNA, 184 bp, Homo sapiens
aggatttcgaccactaggtcgtagaagattcaagtgcagatcttgatgccaacattggttatggaagcacaaaaaaacaaagcacatgctgccatgtggttccggaagttctgggtcacaacgtcatggagctggaagtgctgctgatgtgcaacaaatcttactgtgccgagtacgctgcatt

SEQ ID NO: 663767 - DNA, 113 bp, Homo sapiens
gtgtgatgtatacttagaaatgttacaactttacaaatgttacaaaacattcactaagagctcatatttaacacgtagagcatctagtttcgaaaaatagaaatcaattatta

SEQ ID NO: 663768 - DNA, 445 bp, Homo sapiens
taaaggagtaggatggtatagggtgtaggcatgagtaataggggacatcagtgaggccggatgtcgaatgctctcagctaagccaggaaattcttttgccttgagtctcgtatccagacgttatggttggcagctgctacagtttctctccaatctacagagactaacctcggctttacaaaaccttaaaatttacctcttagactcacatacaaacttacatcagcgagcacacctgtttcccatcccttcgggctggctacacgcatatatcgacgttagcactggcgttcgggaagtagaccctccattacattgttgcgctgggcgactaaaaacgactaaacctcttcggcaaggaaatgctataataccagtcataactctatatgtgcatactgtcttccccagcatttccttgtctacacctttatgcaacagataa

SEQ ID NO: 663769 - DNA, 889 bp, Homo sapiens
gacatggtggcgggcacctgtaattccagctgcttgggaggctgaggtgggagaatctcttgaacctggggggctgctgtgagccgagatagttccattgcacttcagcctgggtgacagagtaagactctgtctcaaaaaaaaaaaaaaaaaaaaaacccagctccgtgacaacttcaaacaggttctctccaggaaaattcgtggtctccaggggctaccaatttggagaaccatgggttcgtggttagaataccactttcattaattattacttactccattcactcttttctattattttaagaagtttactagttagaatgtgttttgcgggagttcacgtggagacctttatttaaaagtgcagctctcgtgattccaggtgagccgtggggtgtggggcctggaaaaagtctggcattattctccccagggcttcccttgggtggctcgccagtgggtcgctggctctggagtaacaaaggggggtggggcgaattagatatggggacgccggtccatttatttattcccattctggacaaattggagtcacaggacgccctctatggtaatgcgacggggggactcaacgtctgatccctggtaacgcgggtttttctcagccgacaacagttttacttggcaaacactgtgcgagatacggtaacttactgaaaggttccctttaaaacctgtgctgtgttgcgaaggttcgaaatgaagcctctaaaagttaaggggcgtccggaacaccccggcgtacccgaggttccaatgggccgtgtccggagaaccaggggctaccgcacgcgaagggatgttgacacgggtgggggtggagcttcaccgaacgcatcaatttggtattgtacagcgcactctc

SEQ ID NO: 663770 - DNA, 166 bp, Homo sapiens
caccgggccggcgacagctacctgacagttctgatctctctcactgacactcagacttatctttctcgaccactctgccaggctgctatattttccaaagctttaacactatgtttcaccactataggtcatttctttggtcacaatagcaccaccggaagttcga

SEQ ID NO: 663771 - DNA, 790 bp, Homo sapiens
  misc_feature (189)..(189): n is a, c, g, or t
  misc_feature (388)..(390): n is a, c, g, or t
  misc_feature (392)..(392): n is a, c, g, or t
  misc_feature (394)..(394): n is a, c, g, or t
  misc_feature (396)..(396): n is a, c, g, or t
  misc_feature (399)..(401): n is a, c, g, or t
  misc_feature (404)..(404): n is a, c, g, or t
  misc_feature (534)..(534): n is a, c, g, or t
gtgctcgtcttttgtgagcagggggcttgggaatgggtgttactgattggttgaggatgaaatcataggggtgtggaaaacagtcttcatcagttgagtccacctctgcatggagccacaggatcagctgactcatgagtcatgggtccaggtggggtcagtctgaaagatctccaaaacaccaattgnaggttttacaatagtgatgttatctacagtgtttccagaaaggggttctgatccagaccccagcaaactaatgtttcctccccattttagaccacatagggtaacttctagacgttgccatggcatttgtatactgtcatagtgctggtgggaggagtgtcttttagcatgctaatgcattatattagcataagcatgnnnangncnagnnntcncttttgttgccatcttgtatttaatgggtttgggctggtttctttactgcatgctgttttatcagtgggttctttatgacctgtatcttgtgccaacctcctatcccatcctgtgactaagaatccacanactcctgagaatgcagcccagcaggtctcagccttattttacctagcccctgttcaagatggagtcactcttgttccaacacctctgacacatttcttcctcccttttacaagaggactaagtgttgtagagggaggaggatccatcatcagtaacttctttgggctgaataggggtggtgatattcctggcctaattattagggtctctttattcagggtagagaggagctcagtcaggaaagcattagtatgga

SEQ ID NO: 663772 - DNA, 1088 bp, Homo sapiens
atggagcggaagtagccgtgggggacatgtgccggcgcggctgggagcggtgtgggcttggcggtgaggccggagcagcacgtgcgcaggagctggagctcctggctgcgtcttccctgcagcgctaccctgcatgcgcctgccagctgccgtggccgctgctggtgggctacctgacccgcttctgctgctgcttgtctgtcctgcttgacccggatggcctgccaaggaacgccgatgcccttgcgattctgggtgctctggggtgctggtgggacaagtttaacgcatgtgtgattggtggacacacgctaggacaggaccgaactttttggtcgtgcggtgaaacacggcctctgggacgcgcacataatgaacgctgtcccaacgttataccgagttccaaggcgaggaattcgcgctgcttgtgatgatccttgcgctgcggcgccttgttgctggatagcacggcaggatctttacgtagattgccaaatccgaggcatttgcctagcacggtgcggccacgctgattggacgtccacccttggtcaaatgcggccctttgggatgtgcatagtctaggcttcgtatgcgaaatgtcgtgacactacattcctctatggacagctataacttgtcccgaacggttgcgcgtactatgctggtagaatcgcactccaccttggaacatagggttgatacgcttgggttcttcccaatgccaaatcacataacctgtgtccccctggatcatttgggtcggttcgggcagcaaatgtgttggaacagggacctgtttccccgtgtgcgcagaagaaaccggggtcgtctcagtcctggtgggactccttttgaccctccaaaacatcaggcaagagaaaactataggtctgcgtgcgtagcagtgttgcttgataagggttagggacgaccgtttggtgctcgttgtcctttggtgttacgctcgcaacgtggtcgtctcgcccctagggtggatatggcacatgtggatggcgaagcgcagtatataattcgtaggcgtcacatgatatgcgcggtaccgttcccgccggtggtctagtact

SEQ ID NO: 663773 - DNA, 1110 bp, Homo sapiens
  misc_feature (266)..(266): n is a, c, g, or t
  misc_feature (1026)..(1026): n is a, c, g, or t
  misc_feature (1029)..(1029): n is a, c, g, or t
  misc_feature (1033)..(1033): n is a, c, g, or t
  misc_feature (1041)..(1041): n is a, c, g, or t
  misc_feature (1043)..(1043): n is a, c, g, or t
  misc_feature (1052)..(1053): n is a, c, g, or t
  misc_feature (1060)..(1060): n is a, c, g, or t
  misc_feature (1065)..(1065): n is a, c, g, or t
  misc_feature (1068)..(1068): n is a, c, g, or t
  misc_feature (1072)..(1073): n is a, c, g, or t
  misc_feature (1082)..(1082): n is a, c, g, or t
  misc_feature (1099)..(1099): n is a, c, g, or t
ggttccgaggcgccgccggtagctggcacgtccggagaactggagcagccatcgtcgcaggtcatggtgtcagtaattaacactgtggatacctcccatgaggacatgattcacgacgcccagatggactactatggcacccgcctggcaaccgtgctcatcagacaggtccgtcaaaatctttgatgtgcgcaatggagggcagatccattatcgccgacctcaggggtcatgagggtcctgtgtgtgcaagtggcctggggctncaccccatgtacggtcaacatcctggcaatcggtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaaccattggctgcaaatgccgtcagctgggcccctgctgttgtacctggaagcctcatagaccacccatcggggcagaaacccaattacatcaagagagtgttttgcagtacatggtgcgcttgtggagcaacgctcgatcccaagcatgataggaagcgagggagcgaaggaacggctcgagtggcaagggatggagcagcaagctagaagcgcacaggtgactgggttgcgagatgtggcctgggcccccgtccatcggcctgcccatccagcaccgatcgctcatgctgctcccaggatggtcgtgtgttcatttggacctgtgatgatgcctcaagcaatacgtgtgtcccctaaattgttgcacaagttcaacgatgtggtgtggcatgtgagctggtccatcacatgtcaacatccttggctgtctctggtggatgacaactaaggtgaccctgtggaaaggagtcagttgatggggcagagggtgtgcatcagtgatgtcnacngggncagggtcngnatcagcatnngtgacgngggcnagngaannagcgtgaangacggtggggctggtcnccaccggcagc

SEQ ID NO: 663774 - DNA, 6789 bp, Homo sapiens
  misc_feature (38)..(38): n is a, c, g, or t
  misc_feature (92)..(92): n is a, c, g, or t
agcgggtgtccggccaagcggcgccctgaaggcgtgtncggccgcagcttaggctctccgggagtccccggagagtaggggcggccggcggngctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcgcgcccgtccgctgcccgtccgaggaggcggagggcgatgacgtcatcgagcggggcgacgggcattgggcgccattttgaacaaggggaaaaaagatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagggcgtggagaggagagctcggggctgctgccacagatcatgctgagccgccagcagctccacctgcccttggctttgctcatccgtggaaatgacaacagcgtgaaaacggcagatgatgtacaaggattatgatgaaaatagtcttgacctcacggaccctctgagaggttcttgaccgttgcaccctcaagggcccacagaccgcactttgagaactgctgcttgaatgcaagctattagcagtaggagtgtcaaggacagggcagacttcaggattaactgttccttctcatctttaccagattgtactggttttgtctcaaaatacaaaaatagagtgtttattatgtaaagaaaatcaaatgatagaacagctgagaacagctggatcaagagcacagagcggaagttcctcttcatcccactgctgtcctggagtcttcctcaggacccactgctcctaactgtatctttgtagatcattttctatgtgtttatttatttatattttaaaacctagtttgtgtataagcaatcttttttaatccacaaatgtggaatcttattctagactttgaataagattttctgtattagtcagtattgttttttgctacttcttttcctttcctttccttttttggaaatagggtcttactcctctgtcacccaggctggagtgcagtggtgcgatcagagctcactgcagcctgatcaggctcaagcaatcctctccctgctcagcctcctgagtagctggaactataggcttgcactgccatgcccagcttttttctattttttgtagagacagggttttgctgtgttgcccaggatggtcttgaactcctggactcaagtgatcctcccacctcggcctcccaaaatgctgggaatacaagcatgagccatggcatgtggccgccacttgccttttttcattaagagtctataattggagatcttacagggaactgggctttctgctcagccatactcgagctcatttgacccccggccactgccccttgaaatcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatccaaacagaagtattgtctttttatttaattttattgcatagaatgaagttatgcagggttcttctttggaactaactgtttgagaaatgtgtgtccttctttggcagcgtgggggtatgtgtgcagcatttctgtccccaagctgctgcccgctgtgtttctgtagaagtagcccatcagatacaccaggtaaggtctgggaaaagccagaaccgaggccacctctgagaaagaaaattgcaaggaagaaccaaaattgctgccatccagtaagcctggtttaaagtagcttcaaattcactacagttgaagaaatacgtgcttgctttctaaggcttttgaaaaagcactttggggaaagtatactttttaaacattgctaaaattacatgcatgctaaatttcatcctgcatttcaagccagcaaaattaagcaattttaattacacgatgccaccagtacgttggtttattttcaaagtaggatctttgataccagaaatcaagattttccaagacaaataatacagagctgtaccaatgctgagtgaccagagcttgcttccgtgggatttaacacacgcccactacgtgtccccgaggggagtggggagtcgggctcccgtgcccctgtggagatggaggtgtgtgctgatcccccgtccgcctgtggagatgaaggtgtgtgttgattcctcctgctgctgtggagatggaggtgtgtgctgatcgcccgtcaccctgtctagatgaaggtatgtgctgattgcctgtgcccctgtggagaaggaggtgtgtgctgatcccctgtgccctgtggagatggaggtgtgtgctgctccctcgtgcccctgtggagatggaggtgtgtgctgatcccccatcccatccccctgtctagatgaaggtgtgtgctgattcctcatgcccctgtctggatgaaggtgtgtgctgatcccccgtccccctgtggagatgaaggtgtgtgctgatcccccgtgcccctgtggagatgaaggtgcgtgctgatcccccatctccctgtggagatgaaggtgtgtgctgatccccatccccctgtggagatgaagggatatgctgatcccctgtcccactgtggagatgaaggggtgtgctgatcccccgtccccctgtggagatgaaggtgtgtgctgatcccccatctccctgtggagatgaaggggtgtgccaatcccccgcgcccctgtggagatggaggcgtgtgctgatccccatccccctgtggagatgaaggtgtgtgctgatcccccatccccatgtggagatgaaggggtgtgttgatcccctgtccccctgtggagatggtgtgtgctgatccccgtccccctgtggagatgaaggtgtgtgctgatcccccatctccctgtgaagatgaaggggtgtgctgatcccccgtgcccctgtggacatggaggcgtgtgctgatcccccgtccccctgtggagatgaaggtgtgtgctgatcccccatccccatgtggagatgaaggggtgtgttgatcccccgtccccctgtggagatgaaggtgtgtgctgatccccgtccccctgtggagatgaaggggtgtgctgatcccccatgccctgtggagatggaggtgtgtgctgatccctcgtgcccctgtggagatagaggtgtgtactgatcccctgttcccctatctagatgaaggtgtgtactgctgatcccccgtccccctgtggagatgaaggtgtgtgctgatcccccatccccctgtggagatgaaggggtgtgctgatcccccgtcttcctgtggagatgaaggtgtgtgctgattcctcatgcccctgtggagatggaggtgtgtgctgatcccccatccccctgtggggatgaaggtgtgtgctgatcccccatccccctgtggagatgaaggggtatgctgatcccccgtccccctgtggagatgaaggtgtgtgctgatcccccatccccctgtggagatgaaggggtatgctgatcccctgtccccctgtggggatgaaggtgtgtgctgatctcttgtccccctgtggagatggaggtgtgtgctgatcccccatccccctgtggagatgaagatgtgtgctgatcccccgtcctcctgtggagatgaaggtgtgtgctgcttcctcgtgcccctgtggagatggaggtgtgtgctggtcccccgtccccctgtggagatggaggtgtgtgctgatcccccgtcccactgtggagatggaggcgtgtgctgatcccccatccccctgtggagatgaaggcgtgtgctgatccgccatcccactgtggagatgaaggcgtgtgctgatcccccatccccctgtggagataaaggtgtgtgctgatcccccatccccctgtggagatgaaggcgtgtgctgatccgccatcccactgtggagatgaaggcgtgtgctgatcccccatccccctgtggagatgaaggcgtgtgctgatcccccatccccctgtggagatgaaggcgtgtgctgatccgccatcccactgtggagatgaaggtgtgtgctgatcccccatccccctgtggagatgaaggtgtgtgctgatccccggtccccctgtggagatgaaggtgtgtgctgatcccccgtcctcctgtggagatgaaggcgtgtgctgatcccccgtccccctgtggagatgaaggcgtgtgctgatccgccgtccccctgtggagatgaaggcgtgtgctgatccgccatccccctgtggagatgaaggcgtgtgctcatcccccatccccctgtggagatgaaggcgtgtgctgatccgccatcccactgtggagatgaaggtgtgtgctgatcccccatccccctgtggagatgaaggcgtgtgctgatccccggtccccctgtggagatgaaggtgtgtgttgatcccccatccccctgtggaggtgaaggtgtgtgctgattactaatccacatgggcaagaacaggatgtccgtcattaccctgaatcaatgctaacacagtgccacttgagttcacattaagttagaaattgagaatctaaaggtacctttattttaactaaaaaataatttatatactgtatattgattgtgacacaatttacaaagtctgaggtgtggaacagttatttaagcattagtcaaccctggtccttaagacagttctagtaaaatgggattgtatatatttgttcaactattttgaccaaaaagttcaataaattttaaatgtttaactggaaaaaaaa

SEQ ID NO: 663775 - DNA, 1209 bp, Homo sapiens
  misc_feature (47)..(47): n is a, c, g, or t
  misc_feature (61)..(61): n is a, c, g, or t
  misc_feature (68)..(68): n is a, c, g, or t
  misc_feature (365)..(365): n is a, c, g, or t
  misc_feature (1125)..(1125): n is a, c, g, or t
  misc_feature (1128)..(1128): n is a, c, g, or t
  misc_feature (1132)..(1132): n is a, c, g, or t
  misc_feature (1140)..(1140): n is a, c, g, or t
  misc_feature (1142)..(1142): n is a, c, g, or t
  misc_feature (1151)..(1152): n is a, c, g, or t
  misc_feature (1159)..(1159): n is a, c, g, or t
  misc_feature (1164)..(1164): n is a, c, g, or t
  misc_feature (1167)..(1167): n is a, c, g, or t
  misc_feature (1171)..(1172): n is a, c, g, or t
  misc_feature (1181)..(1181): n is a, c, g, or t
  misc_feature (1198)..(1198): n is a, c, g, or t
tggtactgaggaggcctagcagggtgaaggcacggtcgcggcttcangggttctcggccgncctgagnccaaatcccaagctggagccgttcagctccctccaccgcttagagatttggggggctctggccgtcccttgcggaccattccgaggggagtccagaggtgtcagtaattaacactgtggatacctcccatgaggacatgattcacgacgcccagatggactactatggcacccgcctggcaaccgtgctcatcagacaggtccgtcaaaatctttgatgtgcgcaatggagggcagatccattatcgccgacctcaggggtcatgagggtcctgtgtgtgcaagtggcctggggctncaccccatgtacggtcaacatcctggcaatcggtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaaccattggctgcaaatgccgtcagctgggcccctgctgttgtacctggaagcctcatagaccacccatcggggcagaaacccaattacatcaagaggtttgctatcaggtggctgtgacaaactcatcaagctgtggaaggaggaggaggcacggccagtggacaggatggcagccacgacaagcatagaaatcagtcactagctgatcgtgggtgactcgaggaatagtgcgcccttgggcccctatctgattcggccttgaccccaacatgaatgctatcgacgagctgctcccaggatggtcgtgtgttcatttggacctgtgatgatgcctcaagcaatacgtgtgtcccctaaattgttgcacaagttcaacgatgtggtgtggcatgtgagctggtccatcacatgtcaacatccttggctgtctctggtggatgacaactaaggtgaccctgtggaaaggagtcagttgatggggcagagggtgtgcatcagtgatgtcnacngggncagggtcngnatcagcatnngtgacgngggcnagngaannagcgtgaangacggtggggctggtcnccaccggcagc

SEQ ID NO: 663776 - DNA, 833 bp, Homo sapiens
  misc_feature (21)..(21): n is a, c, g, or t
  misc_feature (121)..(121): n is a, c, g, or t
  misc_feature (163)..(163): n is a, c, g, or t
  misc_feature (166)..(166): n is a, c, g, or t
  misc_feature (195)..(195): n is a, c, g, or t
  misc_feature (205)..(205): n is a, c, g, or t
  misc_feature (219)..(219): n is a, c, g, or t
  misc_feature (223)..(223): n is a, c, g, or t
  misc_feature (237)..(237): n is a, c, g, or t
  misc_feature (269)..(269): n is a, c, g, or t
  misc_feature (273)..(273): n is a, c, g, or t
  misc_feature (283)..(283): n is a, c, g, or t
  misc_feature (288)..(288): n is a, c, g, or t
  misc_feature (328)..(329): n is a, c, g, or t
  misc_feature (333)..(333): n is a, c, g, or t
  misc_feature (366)..(366): n is a, c, g, or t
  misc_feature (372)..(372): n is a, c, g, or t
  misc_feature (380)..(380): n is a, c, g, or t
  misc_feature (384)..(385): n is a, c, g, or t
  misc_feature (405)..(405): n is a, c, g, or t
  misc_feature (499)..(499): n is a, c, g, or t
  misc_feature (506)..(506): n is a, c, g, or t
  misc_feature (515)..(515): n is a, c, g, or t
  misc_feature (534)..(534): n is a, c, g, or t
  misc_feature (541)..(541): n is a, c, g, or t
  misc_feature (543)..(543): n is a, c, g, or t
  misc_feature (545)..(545): n is a, c, g, or t
  misc_feature (547)..(547): n is a, c, g, or t
  misc_feature (551)..(551): n is a, c, g, or t
  misc_feature (570)..(570): n is a, c, g, or t
  misc_feature (633)..(633): n is a, c, g, or t
  misc_feature (695)..(695): n is a, c, g, or t
  misc_feature (802)..(802): n is a, c, g, or t
atacccacctctgcacaaggnattagtaaaattacagtacagatcaagttccccaaatcatttttaaaagaaacgatcaatactaaatattagcagctaaaacatcattgattcttgtggntttagaactttcacacactgagagctccataagaggaaaaangcnaagaaaatcaacacaattgctcatcagangatagctgtnttttctagtatgtncaanacaaagagtatctnatgttctatcatcttccttcctcaagtttttngggnatattaagtnaaacnaataatcagtgctaagacatgcatcactgtgacataatgnnattnaatcagggctggtcatgctgggactctgctgtntttttntttgggtntganngacttgtatactctattttnagcgtccgaatatggtggttccttttgggtttaatatatcgctgtgggaatggatctcaaagtagcgattttttgcgacactgatcagagatcnaggtgtnacttagganttgaatgtgtgcgagatanagcgacntncntnttcntcttcggataatataaganaggttaaataaaaatagataatacaatttcagatatagaaagtgccaattcaacataaatttntttttgtgtttattttacaaaaagactttagaacacatgaggaacactagatgatgagagtnagcagccttttcagcctttgtttctttcttctttaaatacagatgttgacagttaagatggattagatgcagtccactttttcctcagttggctgatttttttcggnattataaaccatgaaactaaactgagtgaat

SEQ ID NO: 663777 - DNA, 315 bp, Homo sapiens
ttctattccagaccctcaccaccttgtgacatatattgccgcaacccttctgaaagcctccctcatcggaaaatccaaaatctgaaatgcttcaaatctgaaggtttctgagcaccgacaagacccaagtggaaaatttcacaccggacctcatttgatgcgtcacagtcaaaacgtagtcaaagctttgttacatgcacaaaattctttaaaatattgtagaaaattaccctcaggctatgtgtacaaagtgtatcagaaacgtaaatggttttcttgtttagacttgggttccgtcccctgagataacatcat

SEQ ID NO: 663778 - DNA, 718 bp, Homo sapiens
cacagtcacctacacacgcagcagcacgacaaacacaaccggtaaagccctatgcccacacccacaggcttgacattggcaccaccttcgcaccgtgcccaggggcactttcaagacactgcaaccacaagatgttatttattgagctggcgccgggacatgggcggggcctgccctacagtgagcagcccacacaggaacgctcctctcgcgagcggcccgggcagggaccctgtaccaacaccaacacctcctctccagcccaatcttctgggtccagaccagcttgtgccttctttagaaaacactcttaaaccttctaaaaactataaaccttttttcagcacatatggagagagctgacaatcaatgcacattgtataagccattttagcgtaaactggcattgcgcatctctgaagctccctcatggagcctcacagatccatttttagggaagggataaaggctcaaaacgaactgaccacctatgccccgtccaccaggataagtgacacccaagacccaagaaaaaaatgccgaggattcgcgaaaaaaaaccagcctccccgggagcggccaacagcaccaccgccaacaaaaaaaacccaagggtggcccaggcccaaatcgccaaaggcgggggtaaacaattaacgggggcggtttaaaaggccgggaccggaaaaacctgggcaagccaacaaaacgcctgaag

SEQ ID NO: 663779 - DNA, 567 bp, Homo sapiens
  misc_feature (509)..(509): n is a, c, g, or t
gttaactgttgtgcagattttttctgcatgttatggaatcaccttcacccagcccctgctccctctcctggaacgtacttcattcagcatgtgatgtgttttgcaatgtcacatggtatttcatcctttgcttctctctctggtagactgagctcctcaagcttgaaggctggctgtcccccttcccaccccagcccttgtagaggacccagcacgaaggtcatgataggtaacagttgctgagtggtcattctgtgctagagattgctcgcagtgcttttcctatgtcagtgaatcttcacaccaccgaagaaggaaggaaatactgttcttctcagtctcagatgcagaatccgaggcgtgggagcaattaacctgggtcacaaagcgagtgtatggcagggccagggtttggagccacgccgactggccgcagagccgtggagcgctgtactgcttcagcgaccatttgcagccagcacagtactgatgaagccccactgtggcangcgccgtccagccttgggatggagctgttcttctaaagctcggtgaaatctactacca

SEQ ID NO: 663780 - DNA, 1033 bp, Homo sapiens
  misc_feature (38)..(38): n is a, c, g, or t
  misc_feature (92)..(92): n is a, c, g, or t
  misc_feature (975)..(975): n is a, c, g, or t
agcgggtgtccggccaagcggcgccctgaaggcgtgtncggccgcagcttaggctctccgggagtccccggagagtaggggcggccggcggngctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcgcgcccgtccgctgcccgtccgaggaggcggagggcgatgacgtcatcgagcggggcgacgggcattgggcgccattttgaacaaggggaaaaaagatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagactgagctcctcaagcttgaaggctggctgtcccccttcccaccccagcccttgtagaggacccagcacgaaggtcatgataggtaacagttgctgagtggtcattctgtgctagagattgctcgcagtgcttttcctatgtcagtgaatcttcacaccaccgaagaaggaaggaaatactgttcttctcagtctcagatgcagaatccgaggcgtgggagcaattaacctgggtcacaaagcgagtgtatggcagggccagggtttggagccacgccgactggccgcagagccgtggagcgctgtactgcttcagcgaccatttgcagccagcacagtactgatgaagccccactgtggcangcgccgtccagccttgggatggagctgttcttctaaagctcggtgaaatctactacca

SEQ ID NO: 663781 - DNA, 2459 bp, Homo sapiens
  misc_feature (38)..(38): n is a, c, g, or t
  misc_feature (92)..(92): n is a, c, g, or t
agcgggtgtccggccaagcggcgccctgaaggcgtgtncggccgcagcttaggctctccgggagtccccggagagtaggggcggccggcggngctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcgcgcccgtccgctgcccgtccgaggaggcggagggcgatgacgtcatcgagcggggcgacgggcattgggcgccattttgaacaaggggaaaaaagatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatcca

SEQ ID NO: 663782 - DNA, 211 bp, Homo sapiens
cctgtgatgtatccccaacacctgaaaacaggatgaaagccctgtttacttgcaattccttttacccagtgtatcatgtctacctatcaacagaaaattacaaagcatacttaaaatggcagaaaatgcagtttgtaagatgactgaacaatgcattacgaaccaggagtacagtcagtggcagcgagtgtatgggcagataacgggttac

SEQ ID NO: 663783 - DNA, 3609 bp, Homo sapiens
  misc_feature (38)..(38): n is a, c, g, or t
  misc_feature (92)..(92): n is a, c, g, or t
agcgggtgtccggccaagcggcgccctgaaggcgtgtncggccgcagcttaggctctccgggagtccccggagagtaggggcggccggcggngctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcgcgcccgtccgctgcccgtccgaggaggcggagggcgatgacgtcatcgagcggggcgacgggcattgggcgccattttgaacaaggggaaaaaagatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagggcgtggagaggagagctcggggctgctgccacagatcatgctgagccgccagcagctccacctgcccttggctttgctcatccgtggaaatgacaacagcgtgaaaacggcagatgatgtacaaggattatgatgaaaatagtcttgacctcacggaccctctgagaggttcttgaccgttgcaccctcaagggcccacagaccgcactttgagaactgctgcttgaatgcaagctattagcagtaggagtgtcaaggacagggcagacttcaggattaactgttccttctcatctttaccagattgtactggttttgtctcaaaatacaaaaatagagtgtttattatgtaaagaaaatcaaatgatagaacagctgagaacagctggatcaagagcacagagcggaagttcctcttcatcccactgctgtcctggagtcttcctcaggacccactgctcctaactgtatctttgtagatcattttctatgtgtttatttatttatattttaaaacctagtttgtgtataagcaatcttttttaatccacaaatgtggaatcttattctagactttgaataagattttctgtattagtcagtattgttttttgctacttcttttcctttcctttccttttttggaaatagggtcttactcctctgtcacccaggctggagtgcagtggtgcgatcagagctcactgcagcctgatcaggctcaagcaatcctctccctgctcagcctcctgagtagctggaactataggcttgcactgccatgcccagcttttttctattttttgtagagacagggttttgctgtgttgcccaggatggtcttgaactcctggactcaagtgatcctcccacctcggcctcccaaaatgctgggaatacaagcatgagccatggcatgtggccgccacttgccttttttcattaagagtctataattggagatcttacagggaactgggctttctgctcagccatactcgagctcatttgacccccggccactgccccttgaaatcggacatcatttccaccgttgagtttaattactctggagatcttcttgcaacaggagacaagggcggcagagttgttatttttcagcgtgaacaagaggtactggcccagccccgccgtcctgccctgccatgaagtgtgagcagctttctcagcacttcctgcagagaagtctggcaggggtgtgaattctctcttcccttcagggagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatcca

SEQ ID NO: 663784 - DNA, 2572 bp, Homo sapiens
  misc_feature (38)..(38): n is a, c, g, or t
  misc_feature (92)..(92): n is a, c, g, or t
agcgggtgtccggccaagcggcgccctgaaggcgtgtncggccgcagcttaggctctccgggagtccccggagagtaggggcggccggcggngctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcgcgcccgtccgctgcccgtccgaggaggcggagggcgatgacgtcatcgagcggggcgacgggcattgggcgccattttgaacaaggggaaaaaagatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagcggacatcatttccaccgttgagtttaattactctggagatcttcttgcaacaggagacaagggcggcagagttgttatttttcagcgtgaacaagaggtactggcccagccccgccgtcctgccctgccatgaagtgtgagcagctttctcagcacttcctgcagagaagtctggcaggggtgtgaattctctcttcccttcagggagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatcca

SEQ ID NO: 663785 - DNA, 176 bp, Homo sapiens
tagtagttggagaggctcttcttctgctaggaggaggaggaagagctcctggcaatcctggaacaggttctagttagatcccagagtctgtagttccatctttctcttttacttttcctctggctgcctgggatcttccccatttcacattcagtctgcggccatttacaatcaac

SEQ ID NO: 663786 - DNA, 2364 bp, Homo sapiens
  misc_feature (38)..(38): n is a, c, g, or t
  misc_feature (92)..(92): n is a, c, g, or t
agcgggtgtccggccaagcggcgccctgaaggcgtgtncggccgcagcttaggctctccgggagtccccggagagtaggggcggccggcggngctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcgcgcccgtccgctgcccgtccgaggaggcggagggcgatgacgtcatcgagcggggcgacgggcattgggcgccattttgaacaaggggaaaaaagatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaaggagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatcca

SEQ ID NO: 663787 - DNA, 247 bp, Homo sapiens
  misc_feature (30)..(30): n is a, c, g, or t
  misc_feature (33)..(33): n is a, c, g, or t
  misc_feature (58)..(58): n is a, c, g, or t
  misc_feature (126)..(126): n is a, c, g, or t
  misc_feature (172)..(172): n is a, c, g, or t
  misc_feature (201)..(201): n is a, c, g, or t
gaatataactatttttccgtcatcggcttnaanataaaaaggccatgaagaggttatnaagctctgtacggagtccatcatgtcactccagaataacctcaccagagttagaggaaagagtaggtncatttttggcatcagggacataagttgttcttgtctcagttcagcnaatggcagctgattctggcaaccaagatngcaagcatattgctcatcagattgggctcgtgccgaattcctgcag

SEQ ID NO: 663788 - DNA, 3482 bp, Homo sapiens
  misc_feature (38)..(38): n is a, c, g, or t
  misc_feature (92)..(92): n is a, c, g, or t
agcgggtgtccggccaagcggcgccctgaaggcgtgtncggccgcagcttaggctctccgggagtccccggagagtaggggcggccggcggngctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcgcgcccgtccgctgcccgtccgaggaggcggagggcgatgacgtcatcgagcggggcgacgggcattgggcgccattttgaacaaggggaaaaaagatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagggcgtggagaggagagctcggggctgctgccacagatcatgctgagccgccagcagctccacctgcccttggctttgctcatccgtggaaatgacaacagcgtgaaaacggcagatgatgtacaaggattatgatgaaaatagtcttgacctcacggaccctctgagaggttcttgaccgttgcaccctcaagggcccacagaccgcactttgagaactgctgcttgaatgcaagctattagcagtaggagtgtcaaggacagggcagacttcaggattaactgttccttctcatctttaccagattgtactggttttgtctcaaaatacaaaaatagagtgtttattatgtaaagaaaatcaaatgatagaacagctgagaacagctggatcaagagcacagagcggaagttcctcttcatcccactgctgtcctggagtcttcctcaggacccactgctcctaactgtatctttgtagatcattttctatgtgtttatttatttatattttaaaacctagtttgtgtataagcaatcttttttaatccacaaatgtggaatcttattctagactttgaataagattttctgtattagtcagtattgttttttgctacttcttttcctttcctttccttttttggaaatagggtcttactcctctgtcacccaggctggagtgcagtggtgcgatcagagctcactgcagcctgatcaggctcaagcaatcctctccctgctcagcctcctgagtagctggaactataggcttgcactgccatgcccagcttttttctattttttgtagagacagggttttgctgtgttgcccaggatggtcttgaactcctggactcaagtgatcctcccacctcggcctcccaaaatgctgggaatacaagcatgagccatggcatgtggccgccacttgccttttttcattaagagtctataattggagatcttacagggaactgggctttctgctcagccatactcgagctcatttgacccccggccactgccccttgaaatcggacatcatttccaccgttgagtttaattactctggagatcttcttgcaacaggagacaagggcggcagagttgttatttttcagcgtgaacaagaggtactggcccagccccgccgtcctgccctgccatgaagtgtgagcagctttctcagcacttcctgcagagaagtctggcaggggtgtgaattctctcttcccttcagggagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacggatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatcca

SEQ ID NO: 663789 - DNA, 1788 bp, Homo sapiens
  misc_feature (6)..(6): n is a, c, g, or t
  misc_feature (14)..(14): n is a, c, g, or t
  misc_feature (70)..(70): n is a, c, g, or t
caggangagggganccgcaggccttcggtgcctgggccagtttgttacccctgccagctgaatcttctcnttccagcgaggaaaccatgtccgacctccggtaaatggaaagcaaaggggaagacttggaatagacagtattccattttgtagcatattttcataactctgctaattggttatttgggggtattgcctgtacagaattattacttagccatgaatataaacttgtcctctttcgttatctactataagtgttctaattatgtgctgctgtgatctttgttttgaattcctatttccttccatttttaggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatcca

SEQ ID NO: 663790 - DNA, 4882 bp, Homo sapiens
  misc_feature (1946)..(1946): n is a, c, g, or t
agcggtatttcctcagtgattacgtacagagcgagtccctgcgggttaggggccccctctggagccatcctgatggctttgggggccttgcttccattttccattattatgtggactaccggagcgacagcgcagtccaagaccttgcaggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcttccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaagctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggnagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaagattaaaaaaaaaaaaagactatgaccaaaatggcttaagataaagtatttttaaggaagaaagattaaaaacaactgttatacatgagactatggttggacttccttttctttacacttaagcctagaatttctctttaggtatatcagcgcttaaatccaagactattttttattgctgaagattcttgcaaaccatgaagagatgttctcacagaacagaaccccacagctggataaggcccgtatatatatatttgtaagccttgcaatgtgacaggtagcatcactatatatgcaatagttgttatgtagactgtcaaagaatttttttttccctggatacatttgaagctttgagtgttcaaggttttccttaatgatttcacgcagccaaattcttgaatcagttgaactaacctgtatgttactgttattaatgtttactctgcagtctgaacctggagattactggaattgttttccaagaggaaataaattcagtttaccattaaaaaaaaaa

SEQ ID NO: 663791 - DNA, 296 bp, Homo sapiens
  misc_feature (79)..(79): n is a, c, g, or t
  misc_feature (217)..(217): n is a, c, g, or t
  misc_feature (242)..(242): n is a, c, g, or t
cccccaataaattttttgtgaggggtcaaaaaaaagggggataaaatcccctacaatccccccccggggggtgggggtncaaacccccccggtcaaaaattttctcccccccaagaaggaaccccctcttcccgacggtgagaacaaccctttatccttagaagccccccccttaaaggaggacccccgccccggcgtagcgaagcggcgagtattnaaacaccacagagttttgtgcccanctcaccgaggtgcgaaaaaaccgagccctttattgtgacccccattgtgagcgc

SEQ ID NO: 663792 - DNA, 2158 bp, Homo sapiens
  misc_feature (38)..(38): n is a, c, g, or t
  misc_feature (92)..(92): n is a, c, g, or t
agcgggtgtccggccaagcggcgccctgaaggcgtgtncggccgcagcttaggctctccgggagtccccggagagtaggggcggccggcggngctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcgcgcccgtccgctgcccgtccgaggaggcggagggcgatgacgtcatcgagcggggcgacgggcattgggcgccattttgaacaaggggaaaaaagatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccg

SEQ ID NO: 663793 - DNA, 4841 bp, Homo sapiens
  misc_feature (1905)..(1905): n is a, c, g, or t
agcggtatttcctcagtgattacgtacagagcgagtccctgcgggttaggggccccctctggagccatcctgatggctttgggggccttgcttccattttccattattatgtggactaccggagcgacagcgcagtccaagaccttgcagaccccaactgtaaacttgaagacaagactgaagatggagaggcactagattgtaagaagaggccggaagacggggaggagttggaagacgaagctgtgcacagctgtgacagctgcttccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaagctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggnagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaagattaaaaaaaaaaaaagactatgaccaaaatggcttaagataaagtatttttaaggaagaaagattaaaaacaactgttatacatgagactatggttggacttccttttctttacacttaagcctagaatttctctttaggtatatcagcgcttaaatccaagactattttttattgctgaagattcttgcaaaccatgaagagatgttctcacagaacagaaccccacagctggataaggcccgtatatatatatttgtaagccttgcaatgtgacaggtagcatcactatatatgcaatagttgttatgtagactgtcaaagaatttttttttccctggatacatttgaagctttgagtgttcaaggttttccttaatgatttcacgcagccaaattcttgaatcagttgaactaacctgtatgttactgttattaatgtttactctgcagtctgaacctggagattactggaattgttttccaagaggaaataaattcagtttaccattaaaaaaaaaa

SEQ ID NO: 663794 - DNA, 241 bp, Homo sapiens
tggactatgctttgagccctaaatgagatatattttcaattactgtacgatacatattgctagtgctgggaatactctacagtacactttatttgctaaatgcatttcacacaagctgcatctgaaatgctttctgagcaaatgctcaggtttccatttgttcctcttgcttgcgttttcgatctgctgcttctttctcatgttggcctttcagcatattccttctgtgttacgtctaggt

SEQ ID NO: 663795 - DNA, 150 bp, Homo sapiens
gcgggttcatatggtatatttaatagtctacaaatcaaagattcaaagcagagcctaaaaacattccagtatattctcataccaactcatctacattgaaatgaaaatctatgtatggttctcacaaaccgttactattagacccgcaag

SEQ ID NO: 663796 - DNA, 4319 bp, Homo sapiens
  misc_feature (1905)..(1905): n is a, c, g, or t
agcggtatttcctcagtgattacgtacagagcgagtccctgcgggttaggggccccctctggagccatcctgatggctttgggggccttgcttccattttccattattatgtggactaccggagcgacagcgcagtccaagaccttgcagaccccaactgtaaacttgaagacaagactgaagatggagaggcactagattgtaagaagaggccggaagacggggaggagttggaagacgaagctgtgcacagctgtgacagctgcttccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaagctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggnagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaag

SEQ ID NO: 663797 - DNA, 87 bp, Homo sapiens
cgacccacgcgtcgcggacgcgtgggtcgacccacgcgtccggtgttatattaccatggaacgcctaataaagcaaaatgtggttgt

SEQ ID NO: 663798 - DNA, 870 bp, Homo sapiens
gtaaaatatataaatttagaatatcgatactattcttataacctaatattctaacaagacccaacttgcacgcagagcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaagattaaaaaaaaaaaaagactatgaccaaaatggcttaagataaagtatttttaaggaagaaagattaaaaacaactgttatacatgagactatggttggacttccttttctttacacttaagcctagaatttctctttaggtatatcagcgcttaaatccaagactattttttattgctgaagattcttgcaaaccatgaagagatgttctcacagaacagaaccccacagctggataaggcccgtatatatatatttgtaagccttgcaatgtgacaggtagcatcactatatatgcaatagttgttatgtagactgtcaaagaatttttttttccctggatacatttgaagctttgagtgttcaaggttttccttaatgatttcacgcagccaaattcttgaatcagttgaactaacctgtatgttactgttattaatgtttactctgcagtctgaacctggagattactggaattgttttccaagaggaaataaattcagtttaccattaaaaaaaaaa

SEQ ID NO: 663799 - DNA, 81 bp, Homo sapiens
ggcggctactatttaactgactattcttgatgtaaaatcttgtcatgtgtataaaaataaaaaagatcccaaaaaaaaaaa

SEQ ID NO: 663800 - DNA, 181 bp, Homo sapiens
acgaatgacagcgggattgaatctgagctcagcatcactactcagctccaaggtggatttagtgtgactatgtgcctgctattattttctacttatatagtcttaaatacatacttcccatggtacatttgtttatgacctattctcagtgttatatagtaatataagggggtacgagctc

SEQ ID NO: 663801 - DNA, 379 bp, Homo sapiens
gatgccagcctcaaggactccggatgtagatgtcaacatcgcagggcctgtgatgctgcactcaaagtcgacgtgaaatcgcccaaaaccaagacaacgctgtttggacaactgtacttcccagatgtcagcgtttgcaccattaaatccactacatttaaagctgagtgccctctccctcagccccaacactggagggtgacactcccggcacctgatctggcaactttcttcgccagcgcattcacgtcgaaggtcttgaaatccaggcgcaggtccccaaggtcacgcatgccgcatgtggcaccatctcagtgccacacaatatcgggtgaccttgaaaggccccaaagtgcaggcaaacttgggtgcacctgaa

SEQ ID NO: 663802 - DNA, 175 bp, Homo sapiens
ttttaggctgggcacaatgcctcatgcctgtaatcccaacactttgggaggtagaggctggaagattgcttgagtccaggagttcaagactgcctgtgtaatataatgggaaccctgtgtctaaaaaaaaaaataagtaaaaataaaattctggtaatttttaattcttaggaaa

SEQ ID NO: 663803 - DNA, 701 bp, Homo sapiens
agaaaaataggctaggtagaggctgggttttaattggccgaggctcgggctcacactgagtcggccccgtcgggggcagcagtgagcagcaggtgcccatcctggagaagttttgcttcactccccatcactgtgaggaggggtgcctagtctgattctgcgctgccctgcaggaggagctgcaactgtgcaaggtggctggtgcagtgcaactgctaggacctaatggtgacccagcaggtgctgaagatggtgtgtgccctggactggattggggcccagatccccctggtacccctcacagcaggaactgccccggttgttgtcggctgcctgcaggcttcagctcaacgggaaccttgcagctggagctggcgcaggtgctggcccaggagaggcccaagctgccagaggacccctctgctcaggcggctcctggactccccggcactcaagggcctgcctggacacttgccgtggagaacatgcccagccttgaaggatgacggtggtggaaggtgctggctggccacggtcacctgtattccctgcatcccaggactgtcagccccccatcgcctgcttgaagctgagctaaacggccacgaccggcaccccaggcctgtaggctgccagtgcgagctgaagaagcacgacgttgccaggcagtgagatccggagacctgcccagtgcctgggag

SEQ ID NO: 663804 - DNA, 118 bp, Homo sapiens
agatcatagaggatttccctccgtgtcagcatttaaatcagcacaagagaatcggctgcctgtgggcccctttcaagaaatttggctctaccaggaaaacagttacacattttaagag

SEQ ID NO: 663805 - DNA, 720 bp, Homo sapiens
cgcgtggcaaagatgaactatcatagccgagcatattatatcatggactaaccggtacaccttctgactaatggagtacctcgaaataactctgcctggtgagccaatgctaagacccgggaagccagacgagctacctaacaacagataaaagagcacactcgcctatgttgctcaacatagtgaagatttatctgtcgagaggactaacctaccgagcctgaggatagctggattgacaagatagaatcttagttcaactttaaagttgtccactagcaccctctaaatacccttgaccatataactgttagtacaagagaggagcagctatttgtagcactaggaaacaacctcgtcgtgagagaaacataattatcacccttcgctagcctaaaagcacccgccaattgagaaagcgttcaggctcacactcactacctacaaagaccagacatataattcgaactccttacacacacatggaccaatgtatcaccctatagaagaacgtagtgtatgagtaagtatcatgcatgctactgcggataaggctgcgtcacgatttattaccctcaatgtgaacccaacacagcgctgctcatagcgaatggctttattcatagaaagaggctcgaggtgcggacactgtacccaaatccacatatgacgagtcgtagtacgtcactgtgcgtcgatataccacagctgtgagtgatt

SEQ ID NO: 663806 - DNA, 183 bp, Homo sapiens
aattcccccatacagagctgatatacctgttaactgcatgaagggcttatgattcttgtccctaataataatttccctattctaggtatttcttttaacccccgtttaaaatttttaaaaaacccttttttttcttttaaaaaagccgtccccccaccccagtaattttgggaactcttcccc

SEQ ID NO: 663807 - DNA, 207 bp, Homo sapiens
cccttgggggaaaaaaaaaaaatttcgaaaaaaaaaatttagggggggggccccaaattccaagggggaaaatttttttgggggggggccccccccttaaagggggggcccccggggttttggcggcaaaaatccgaacccccccggggggcccgtttcccgggggtttccaggaacccatttaaattgtcaggctgctcccgcctc

SEQ ID NO: 663808 - DNA, 873 bp, Homo sapiens
ggctctgaaccagcggttggtgaagccagggaagagcgctctatacggatgcttcaatgaggtgatgatgacctttatgactcggatgaccagctgcgggcagagagtgcttccgggacccaggtgtcggcacatggctcaactcttctactaccttggcctgtggaagctattagctacatcctgtcgaagaaacgcatgggtgctgcaagggactccatccccgaagacaccgtgaccttccgtcagatccatcgtgtgaatgtgccagaactcactctatgccaccttcctccccaaagtggactcgccccggtgctgcctttctgaagcggatacctggatggttggatcttgccatctttttccttgtgggaagaaagctgatggatgagaaagcttcgagagatatggaggcccaacctgcaggcagcaggcccagatggcatccaggtgtctgctaccttgcattcttaagtgccaggggaccaccctcaagtcctcgggaggccatgggcaagcctgctgaagcttggtcatgggctggaagtgggcccgacgtcccaaccacgcgtgactttgggcctggtaccaccttctcaaaaggaccctggagattcaaggagggccttgggctgaaggaaatgtgttgggtgtgctgccagccgggaagtgcccagccaaaaggattttgcccacatgccggtgctcaaaggctgtgttaagggcacctgggttctaccctgttggcccacaaatcccgtataaaagaaggagggagggtcctttcccacaaaccacttggcgcgccatttggttcgggcgccagcttcttttctgactcctccccgtgtgtagcaagtgttccctcta

SEQ ID NO: 663809 - DNA, 517 bp, Homo sapiens
ttgacacttgtagtcactagggcagggcggtgcctctaatactggtgatgctagatgtgatgtttttggtaaatcaggcggcggtgagatttgccgagttccttttacttttttgtaaccgtttccttatgagcatgcctgtgttgggttgacagtgagggttataatgacttgttggttgattgtatgatcttgggctgttacttggtcaggttcagtgttttaatctgacgcaggcttatgcggaggagaatagctgatagagcacacccgtctatgttgcataatagtgggaatatttataggtagaggcgactaacctaccgtgcctggtgatagctggttgttcaaatatagaatcttagttcaacttttaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaa

SEQ ID NO: 663810 - DNA, 154 bp, Homo sapiens
acccagtgcgtggcatgtcttggaggcgagcctgtcccgctagcctgtgtgttcacacaccaaggagaagggtaggcgaggggttcggagtgtatatacaggttggaatgtgaaggtcctggctaccatgtgacttgtaagtgtaccttgtaaa

SEQ ID NO: 663811 - DNA, 203 bp, Homo sapiens
ctacaagaacacacactggcacaggactccctccccagctcggatcattcagtgccatcagtggacagctgcagtcctaccgcgctgcctgtgcagtgctgtctgtcgtagaagtcactcaggggtatctgagcacagctggtggggatccaaacatgcaactgcctgtgtatactcaagacatcctgcacatgggtgataca

SEQ ID NO: 663812 - DNA, 588 bp, Homo sapiens
gcgccatctatctgcccggcctcctctatctctcactcacgatctcactcacgatgaagcgccatctgcccggcctcctctatctctcactcacgatctcactcacgatgaagtgccatctatctgcctggcctcctctatctctcactcacgatctcactcacgatgaagcgccatctgcccggcctcctctatctctcactcacgatctcactcacgatgaagcgccatctgcccggcctcctctaactctcactcacgatctcactcacgatgaagtgccatctatctgcctggcctcctctatctctcactcacgatctcactcacgatgaagcgccatctatctgcccggcctcctctaactctcactcacgatctcactcacgatgaagcgccatctatctgcccggcctcctctaactctcactcacgatctcactcacgatgaagtgccatctgcccggcctcctctatctctcactcacgatctcactcacgatgaagtgccatctatctgcccggcctcctctaactctcactcacgatctcactcacgaagaagcgccatctatctgcccgggctct

SEQ ID NO: 663813 - DNA, 657 bp, Homo sapiens
agctgcctggctccctctggtccctgcttcagaggaggcctgggcctgtggccagctgaccttgtgagttggtctagagcccggagctcgccttgtgtgctgggcaccagtgggcccctgccaggcctgtcctctcctttttgagctgtcctcagccccatctcccttagagtgctttgtgggagctgcagtgtggggctggggtgggctatcatgcccagtcctgctgccgtcttggcactgcagtgggcagtgtctggtcaccacttccccctcttgctccatgtccttgtggatgtgaacgtgcacgacacttggacgtcgcatcctgcaggagccgcttgacgcatggcccgctcatggccatccacgatgtcctctgacagtgtgatcgatgtactggccctgggccacaggacatgggttcagcacgcgtggtcagcccacagcacgactgcacctcttgcattcccacaacacctgtctcccctgtcctgcctccctaccttgtagtcagttgattgacgatcgacgcgtcactgcacatctgcgacactgcacatccttccctctctctgcatgcctgcgtcgactcccccaccacacatcttcaccctgcttgcgctacccacccacagcgctccagcgactaccccc

SEQ ID NO: 663814 - DNA, 175 bp, Homo sapiens
  misc_feature (44)..(44): n is a, c, g, or t
  misc_feature (93)..(93): n is a, c, g, or t
  misc_feature (154)..(154): n is a, c, g, or t
agaggtgggcctggaggggccaccaaagatgcaggagctgggcnctggagagtgctgcaaagaagcatgagctggtgcctgtgtgagtgtcanacttgagaaaagttcagaggcctgtgagagaagtgctgggagtgcaggagctgtggtctanaagagtgccattttgtaacga

SEQ ID NO: 663815 - DNA, 260 bp, Homo sapiens
tataattgcaggtatgtaatctctcttggctctcaaacattacctaattgtatgaagatacgtgagcttcaaaaatacctacctttaagtaatttttaaaaaccttagcatcaggctgctgaagcgcttgacaaaactcctggggggtggggaaaagagggagaaaaagaacaaatgtatttgtattaaatccattgtaattcgtatccagtttttttttttaattttttttttttttttagaggatgtttttaaaagta

SEQ ID NO: 663816 - DNA, 281 bp, Homo sapiens
  misc_feature (281)..(281): n is a, c, g, or t
ttcacagttctggatgtcttatcagcagcatgaaaacgaactaatacgtatgtatagtatgactcccattattttatttatttacttactattttctgagacaagagtcttgctctgttgcccagcctagggggacaaagcagtgagacttccatctcaaacaaaataacataaagcaaaaaataaacaacatcacctttcctagaacatatacctttacttgcatagttaaacaacaggtagttaatagttaaccatttatcacaaggcataccgtggtn

SEQ ID NO: 663817 - DNA, 891 bp, Homo sapiens
gcagacaccaggagatgtgacgctctggtgccccgaaccctcctcctgctactctcgggggccctggccctgacccagacctagggcgggctcccactccatgacggtatttctccacatccgtgtcccggcccggcagatggagagccccggttcatctgcagtgtggctacgtggactgacacgcagttcgtgcggttcgacagcgacgccgcgagccagaggatggagcctgcgggcgccgtggtatagagcaggagaggcctgagtattgggaccaggagacacggagtgtgaaggcccagtcacatgactgacccgagtggacctggggaccctgctgcggtctactacaaccagagcgacggccggatatctcagacgcatccagatactgtatggcatgctgacgtggggtcggacgggcgcttcctccgcgggtatgaacagcacgcctacgacggcaaggattacatcgccctgaacgaggacctgcgctcttggaccgcggcggacatggcggctcagatcaccagtgcaagtgtggaggcggccgttgggcggagcagttgagagcctactggagggcacgtgcgtgggagtggctccgagataccttggagaacgggaaggagacgctgcagcgcactggacccccccaagacacatatgaccacaagcccaattctgaccatgaggcaacctgaggtgctgggccctggggctaactcccctggggagatcacactggaccttgccacgcgatggggaggacccgaccaggacgctgggtcgtgcagaccagctcgccggatgcacctcccgatggcgtcagtggcttgggaaggtcaaacccacgttcaattatgttgcaagccaccaaaggacttg

SEQ ID NO: 663818 - DNA, 197 bp, Homo sapiens
  misc_feature (22)..(22): n is a, c, g, or t
  misc_feature (185)..(185): n is a, c, g, or t
tgcataagcagggattacctgngttatgtaaaacgaaccatgacattataaatatagcaattatatttgtcagctttgggtgtataacaaagcaccccaaaacttactggtttaaagcaaccactaggttgagctctgctggacggctgcgtcattcctttgatctgggaaggtgcgtcatgctnctgccggcactt

SEQ ID NO: 663819 - DNA, 456 bp, Homo sapiens
atcccatgtctagaaaaccctatcgtctcgtccccaaagcttcttaagccaagaagcaactacagcaaagtctcaggatacaaaattaatgtgcaaaaatcataagcattcctatatacagagattcctatatctctgtgtctgtactgcacacctgaacaacaatagacaaccagagagccaaacatgattaactcccattcacaattgctacaaagagaataaaatacctaggaatacagctaacaagggaggtgaagggcctcttcaaggagaactacaaaccactgctcaaggaaatcagagaggacacaaacaaatggagaaacattccatgcttatggataggaagaattaatatcatgaaaatggccatactgcccaaagtaatttatagattcagtgttattcccattaaactaccattgacattcttcacagaattagaaaaaaaaa

SEQ ID NO: 663820 - DNA, 149 bp, Homo sapiens
cacgaggggttcctgtgtccgctggccatgtgtctgagtgtgtaccctctcatcatctaaacgaaatttggctgcattggggaggcctggtcccacgtgaagttttgggagcgcagcagcaggtgagttcatacgacccatcacctgcc

SEQ ID NO: 663821 - DNA, 175 bp, Homo sapiens
  misc_feature (1)..(1): n is a, c, g, or t
nttgagttacagcagaaaaagctcattccgctatcatatggtgaagaatgtctctggaagatcaggtggagatgctgcgtgacagatgaaggatggaagctgagaagccagagagagaggccaaatgagcagcaccacgaagctgtgggcaagagcagctggcgttctgccaagg

SEQ ID NO: 663822 - DNA, 439 bp, Homo sapiens
tctagagtatcctggtattcgctatactagattgcgaacgttatcctatatactctcacctcctcatgcctcacctgtataccctcacgtcctcaccacctgcttctctgtttgatcaccaataaatagggcgggttcccagtagctcggggcctttgcagcctccaatctagcgctggccctctggacacaccttatgaactcttaacttgtcttttctcattcctttgaccccgccagactttgtagccctcagggcctggtgttgggcccgatcacctcaacatcccattgtgattttaatttgcatttcccaaaaggctaataatgttgaacatcttttcatatgcttacttgctacctttataggtttttcttttagcccattttcttttctttcttcttctttttggtttttcaagtgacaaagtcttgctct

SEQ ID NO: 663823 - DNA, 247 bp, Homo sapiens
  misc_feature (164)..(164): n is a, c, g, or t
ccactaaatacaatgatattcctacgagcagggaggacagcaacacaggcaggagaaagaggtggcggtgaaacgctgtccgaatgagagggcggccacatgcttaaggtgccagtgaaaaaaccgacagccagaattctacagccaggaaagatgtcctccangaaatgaagtaaagtaatgccaacaagaaaccacactcgcagagcataccaagaacacacaaagcaggaaattactcccatgc

SEQ ID NO: 663824 - DNA, 160 bp, Homo sapiens
gtgaggggcacacaggattcggatgtgatgcgtgagttaacatacccgtgtcgattttgcaggagcaggctcacctccaaactcaaccagttgtccgcattcaggtatgtgaaggcttctgtctatcaatcagacctcaataaagtggttcaaacacaga

SEQ ID NO: 663825 - DNA, 491 bp, Homo sapiens
atgaggatacaccaggagatatcagctgtgatggcttggagaaacagtgtaaactggcagtgtaaacacgagcgagggcatgtatgagtagttgagaacgctgaataagagtatgactagacagaagatagtagggatgacaggcctgaattctgagaagcgaaagtggtaaaagtattgtccagtcctttttgagttggtggctgagcttcgtgaggtgtgtttttaatagaccattagtctgtcactggatactaagagcctgaaaaactgcttggctgatttgactaataaaggctcatctgttatcagactgtatagaggtgggaaggctaaactgaggaattatgtctgacagaggggaagaaatgactgcggtggccttctcagaccctgtaggaaaggcctttacttattcagtgaaagtgtctatttagactaagaggtattttagtttcctgacttgggacatgtagagtaaagctaatttg

SEQ ID NO: 663826 - DNA, 134 bp, Homo sapiens
aacgggtgatgcggttgcagaaatcagggtcaggcgcacatacacgcacgcacgcacacacacacacacacacacacacacacacacacacacacacacagatacagcagtatttttggaacattgtgaagtga

SEQ ID NO: 663827 - DNA, 464 bp, Homo sapiens
  misc_feature (329)..(329): n is a, c, g, or t
  misc_feature (411)..(412): n is a, c, g, or t
  misc_feature (448)..(449): n is a, c, g, or t
acccaaacagagctggacatagaggtgtataagtaacttttgtcaggagactcttagggaggaccttcagaaggccaagtgagatgacttccctagaaattctctcagggcatggggaccctggatggactccttggagcctgcatgcccctgtgtgtgcccaatggccccacgaatacacctgtgccaggtgctgttcacagtgcgtggtggggctgagatgcccagggcaggtgcccgtcagaagctggtgtagacacgtggaggaggtggggtattggacccaaagtgtgtatctgcacatagcacaggccgtgaggcaggctggntacggatggcaagtgtggtgcatgtgccctgggggttgcagggagggccccagtgaggccagcttctgaacccactggcgtnngctgcgtctgggacacaggtgtggctttgggtactnnacgctttggcagggt

SEQ ID NO: 663828 - DNA, 1153 bp, Homo sapiens
gcgggtttgccgccagaacacaggtgtcgtgaaaactacccctaaaagccaaaatcggtgaaaggaacacacgactcatatcaacattgtcgtcattgtgacacgtccattcggtgcaagtccaccactactggccatctgcatctataaaattgctggtcggccatcgacattagagtaaccattgacaaacatttgacgaaggaggctgctgtagatcgggaacagggctcctctcaaagtcatcgccatggagtcgttaggacataaactagaaagacggagcagtgcaacggtaggtatctgccgattcgatcatcgtaccttgtcggcacatttgtgagcacctagcatagctactactgatgactagtcaattgaatgctcccacggagcaacagaggacctgttatcagaataacagtgactatactaggtgacactcgtcacgcgctgacctggtgcatgtcactgacttgattgcgatgctggatgatccggtgacagttgcgaagctgggtgatctccgagagaatggagcaggacccagagagcatgcccgttctcggcttacacaactgaggtgtgaatacatgctaaatagtcggtgttagacaaaatggaattccacgtgagccagaccttacagaacagacgagatatgaggaaattgttcacggcagtcaagctacttacaattatgaagacattggatacatacccgaacacaagtaacatgtgtgccaaactcaggttggaactggtgacaaacatggtcgaaccaagtgctaacatgccttggatccaaggaatgacaaggtcacccgaaaaggattggaaatgcccatgaaaacaccctgatgaagctctggctgcatcaacacagtgtccaatgacaagaccttagcaatgcacacagaggagctacaacaggaggcaatgggaaaggcaccgaggggccaagaaaagcggaccaaaacggaagtgggaaccgggcacaaaaaaaaaagaagaaacacggcgagaacaacgacaacgagacacctggaaaaggacacagaaaaagtcataagaaccgaagaagagcggaaaaaatacagaagcaacaagtatacacaaaagaacgaagataaaaaacgacacagagacgaaa

SEQ ID NO: 663829 - DNA, 407 bp, Homo sapiens
tttttttatggcatattgggtctgcctctgtcacccaggctggagtgcagtgttgagatctcagttgactgcaacctctgcctcctgggctcaagtgattctttcacctcagcctcctgagtagggggtactacaggagcatacaaccatgcccagctaatttttttttttttcagagactgggtcttgctatgttgcccagtctggtttcgaactcctgagctcaagcaatctgtcagcctcgggctcccaaagtgctgggattacaagcacgagtgactgcaccctggccccatattttatttttagatgcaactgatgggaaacacaccatcaactcgataacagcctttcaaggggagaacaaaatccagagaaatagaaaccttacgatatcaatgttatat

SEQ ID NO: 663830 - DNA, 1327 bp, Homo sapiens
aacaacttcagggtgaagggaaaataattgatagaagacccagaaaggcgaccacctcgtgcaacgacagattccgcaaaagccacttgcacagacaacagggtgcaaggcaggcgaattttcagttgatagcaccgattatttgacctgacctattcgaggtcgtggtcggtctctgtgcaagcagggtctgcagggtggcctgtggcacgttggcacatcgtggcctgcaggcagcaaggcatttagcattctctgtaggcaaacgtgcacatttagcataggccatcagtggcaagtcgcatagatcttactttttccaccattcaccagtgagacctgaaagccagaaggcccaacacgtggcaggtcagcggaatctacacaactggcggacactgtcaaacagcaccgaatccaaccagcagtcccccaaacatacattccagcaaaaccacaatcatccttcatacatacaccagttgcactctgggcatccaatccaacatggtcgactgaaggcaaaaacaccttgcacacggcgaccagcaacatccaccccagtgcgccaaacacttgaacaacataagcgcaggaccctagcaacggttaggcaccggacggccacccaacacaagcgacagcggccaacaaccaacgacagaacacaccaaccaagcgcaccaaacacgcacgaaaagcgaaaacaaaacccaaaaccacaacagacacgcgagaacagacacaccaccacacacaacaccacaccacaaacacccacacacagcaccagacgacacaaaagggagaccagcgcgacccaaagaggaccgaaagacaccgcaacaacaaacacacacacaacagacaacacacaacgccaacagccagacaacaccacaccacacacacaggaccacaacaacacccagagagcacggccgcaccaaacaagagagcaaaacacgcaccacaagaacaagcacacaccaaacacaaccgtcggccgcagcaaaggggcgcgacaagcagcacaggcacgcgcaggaggaagagagaccctaggacacaagcagggcggcgggaagagagacgaacagaacggagagagaggaggggagcgaagccagaccggaacggagcgcgagaaaacggacgaggaagacgggagcaccgggccgagcgccgcgcacccaacaggggacccagcgaacggtgagcgaaagagacgaggagagaggcagagcagcgaacgggcaagagagagcagagcgggggacagacgcgcggcagggaaggaaaagaaaagaaaagaagaagacgggaa

SEQ ID NO: 663831 - DNA, 525 bp, Homo sapiens
  misc_feature (415)..(415): n is a, c, g, or t
tgagacagggtttcactgtgctgcccaggctggagtgcagcggcgcgatcatggcacactgcagtctcaagcgctcaggctcaggtaattctgagcctcccgagtagctgggattataggcgcacaccaccacacatggctaatttttgtattttttgtattgacggggtttgccatgttgaccaggctggtcgtgaactcccagactcaagttatctgcttgtctcagcctcccaaacaaagtgttggaattacaggcatgagccaccacgcccggcctggagcatttttaacatttgacttggtttgatttatttgtgaagtatgcattattatccccacttgcctctcatgtgagggaggcagaaaagttaaatgacatgagtgacagcatccagtggctgataagcagtanagccggtcttctcatgcagaatctgttgttcccaccatgtgaaagaaattatactataagattttgggttttttacttagatcacttttttaaagtattcattattcttg

SEQ ID NO: 663832 - DNA, 232 bp, Homo sapiens
atctgtgatgcaagagggtatagaagtatgctgataaatatccaggcaggtgcagtggctcacgctgtaatcctagtaactcccagtgggtggctcccacttatgggaggcccaggcagctggatcatgaggtccagaaatcaagaccatcctggccaacatggtgaatccccatactctactaaaaacacaataattagctgggtgcggtggtcgcgtgcctgtagtccca

SEQ ID NO: 663833 - DNA, 103 bp, Homo sapiens
caagcctctctggtatgggaaccagaatgatggccctcagcaggaccatcccgaacaatggagtggcagcagcaacaatggtccaccacctcctcagggaaag

SEQ ID NO: 663834 - DNA, 124 bp, Homo sapiens
agcaaacagcctggaacagtcgctctctgtattatacgatggggctactggttagaggcggcactagattagaatttttaaaacgcagggtggggtgaggcgcagaattttacaaacgaataca

SEQ ID NO: 663835 - DNA, 527 bp, Homo sapiens
  misc_feature (4)..(4): n is a, c, g, or t
  misc_feature (19)..(19): n is a, c, g, or t
  misc_feature (35)..(35): n is a, c, g, or t
  misc_feature (53)..(53): n is a, c, g, or t
  misc_feature (167)..(167): n is a, c, g, or t
  misc_feature (240)..(240): n is a, c, g, or t
  misc_feature (255)..(255): n is a, c, g, or t
actngccctatgttgtgcnaaccctgatccccccnaactccatacccctgaanagaaaccctcccccactttggccccctgcaaacgggccataagcccacctatgcccccagcccctttaatttttaagaaccttttgtaccaaccatatataatccttttgtaanatgtgccccatacctgtatacacacttttaaaaaaaatgttttaccacaatgcccccaggtgtagtggctcanaccctgtaatcccanacctgtaatccccagcactttgggaggtcaaggtgggtggatcacctgaggtcaggagttcgagaccagcctggccaagatggtgaaaccctgtctctaccaaaaaaatacaaacattagccaggcgcagtggtgtatgcctgtagtcccagctactcgggaggcttaggtgggagaatcacttgaacctgggaggtggaggttgcaatgagccgagatagcaccactgcacttcacctggtggagagcaagaccatgtctgagaaaaaaaa

SEQ ID NO: 663836 - DNA, 662 bp, Homo sapiens
cagcttattgtatatgagggagccaggccccgagggtgagcgagatggagaaggggaaggaaggggctttgggatctggaaaccagcaggccaggcagcatccacagtgttagtccaaagggtcggaccgtgtcgtcagcctagcgtttggtcagtgacggcctggacgggccaaggagactccgggcttgaacccaggcctcccgcacggctcagctgctgaatttttccttgaggctgtttggtgtgtgacccagcaagggccctgtgtaggacagcaggagggaggcgtcgggggccttagcagaaggggaacaatgagggcatttcatgaaccatctcaggcacttctgcatcacggaagacctggccctcccagccgtcctggggatgctcagggtgcaggcagaggctcgggaggccggactcaggggtcagaagcagggactggggcaggcgagcccggacagggaagaggggctccgatcaaagccggccgtgctgctgccgggggcccaggtgggtacaagctcctttgtgctttgcacaaacctgaatcccccaccagagaggatgtgtgtgaggagccagaaacgctgaatccaattaagagagaaaaataataataacaataaatgatcttggacaagaaaaaaaaaaaa

SEQ ID NO: 663837 - DNA, 855 bp, Homo sapiens
  misc_feature (9)..(9): n is a, c, g, or t
  misc_feature (122)..(122): n is a, c, g, or t
  misc_feature (175)..(175): n is a, c, g, or t
  misc_feature (184)..(184): n is a, c, g, or t
  misc_feature (186)..(186): n is a, c, g, or t
  misc_feature (190)..(190): n is a, c, g, or t
  misc_feature (204)..(204): n is a, c, g, or t
  misc_feature (206)..(207): n is a, c, g, or t
  misc_feature (211)..(211): n is a, c, g, or t
  misc_feature (213)..(213): n is a, c, g, or t
  misc_feature (215)..(215): n is a, c, g, or t
  misc_feature (224)..(226): n is a, c, g, or t
  misc_feature (258)..(258): n is a, c, g, or t
  misc_feature (261)..(261): n is a, c, g, or t
  misc_feature (268)..(268): n is a, c, g, or t
  misc_feature (270)..(270): n is a, c, g, or t
  misc_feature (272)..(273): n is a, c, g, or t
  misc_feature (277)..(277): n is a, c, g, or t
  misc_feature (288)..(288): n is a, c, g, or t
  misc_feature (295)..(295): n is a, c, g, or t
  misc_feature (297)..(297): n is a, c, g, or t
  misc_feature (345)..(345): n is a, c, g, or t
  misc_feature (348)..(348): n is a, c, g, or t
  misc_feature (353)..(354): n is a, c, g, or t
  misc_feature (357)..(357): n is a, c, g, or t
  misc_feature (364)..(364): n is a, c, g, or t
  misc_feature (366)..(366): n is a, c, g, or t
  misc_feature (371)..(372): n is a, c, g, or t
  misc_feature (390)..(390): n is a, c, g, or t
  misc_feature (399)..(399): n is a, c, g, or t
  misc_feature (402)..(402): n is a, c, g, or t
  misc_feature (411)..(411): n is a, c, g, or t
  misc_feature (415)..(415): n is a, c, g, or t
  misc_feature (424)..(424): n is a, c, g, or t
  misc_feature (440)..(440): n is a, c, g, or t
  misc_feature (442)..(442): n is a, c, g, or t
  misc_feature (445)..(445): n is a, c, g, or t
  misc_feature (454)..(454): n is a, c, g, or t
  misc_feature (457)..(457): n is a, c, g, or t
  misc_feature (475)..(475): n is a, c, g, or t
  misc_feature (483)..(483): n is a, c, g, or t
  misc_feature (494)..(494): n is a, c, g, or t
  misc_feature (502)..(502): n is a, c, g, or t
  misc_feature (505)..(505): n is a, c, g, or t
  misc_feature (772)..(772): n is a, c, g, or t
  misc_feature (809)..(809): n is a, c, g, or t
gtataaaangggtattttcttgaaaaaccacaagaaaaatacaactgctttttcattgcccaggtcagttactcgctacagtcagactgcatttaaattagactggcatctaatacttttgngtatttacaaacataattaaaactatactcctagaccaccagctttcaaaaangttggatcngnttgngttgcaataaatangnnccananangaataattnnnggggggcttatggggggggtttagaaattacnaanatttatnangnngttngggggtgaggnatattgngngtgctttgctttatacaaattcacttacttttttcagaattcctttgnggnagggnnggnacttttngnaatgnnattttacatgtgaaaagngaggttggnagngcctcagtnaccngcccagggncacacagctagaaggngngcnagcacttgngcnacatttctctttccagcnagattctnagcactcagcngtgctgcnggnggtcacagctggctgactggaccaggaagaaccttttagtgtcaggcgtgtgaatcacagcacttgggacaggttaccaagaaccatgatcacttaatttttatatttatacatgtacatttgtatatacatagagaaagtgcaggcaaaaccattatacagttactctaatagccatttgctactgccagcagtctcaggactgatccctgtctaagctggcaagtttacattctccttgtatcactacaggatttgctctggganaggagctgtaactcctcaacaaatcctgctttcagtntactactgcacagcttgaattgttcagtaggccagctttttgtgaa

SEQ ID NO: 663838 - DNA, 933 bp, Homo sapiens
ggactcagcatatggggacgctctcagctctcggcgcatggcccagctacctatcaaaatgtctagtgttcacgaaatcctgtgcaagctcagctggcagggtgatcactctacatccccaagtgcatatgggtctgtcaaagccttatactaccttcgcatgctgagccggcatgcttcggaccatggaacacagccatcaagaccaaatgttgtgcaatgacggtcatccattggtcaaccactttctgactccgatcctgcaatcacatggcaccagagcccacgccactacttgcgcctttcgctctttatccgtgtcagcctgtgccccctctccacgggtcacttgtggctttcaaggcctccttggctcgtccatgcccttttcttcttgcgtccctcccttgcccgccatcggtgctgcccttctctggctgtctctatttcgcccgtacctcctcctggccttccacgttctctgctctcccgtctccttggtagccttactccaccgcctcttcccctgtttgtcacatgtgcgcgcctttgggcccacctctcccgtggtcgttgacgtggctatctctttctctcctttctcatttctgtggtgctatttctgactttgcccttgggcttcttcaccatgctcacatcgcctctccacactccccgagcgtctgcgctgcgccttccggtcgcctctcgtcgccacatcgccttgttcacagctctcccactcgctcacggctcttctctttacacgcgctcgctcgcggccgtctcacctcctcctgtctggtcttacacgcgcactatgcgtggcgcactccgcttgcgtcccgctctcccccttgggtgcggctcgctgcaccttctggttcgcatgctcttctcttctctatctcttgtcgctcccccggcttctcc

SEQ ID NO: 663839 - DNA, 335 bp, Homo sapiens
catctgtgagggctcgagcgctgctgcctcgacgtatctccctagactaagtccacccgtccaggacacagccaggcactgctctgtgctgacttccactgcagccaaggctcacaaatgaagcatctgctggaggccaggactcctcggcatcggacacagtcaggggaaaagccagcctgactctgcaggacagaggtgtctagtggtcatttggcaggagaagactggtgtgccaagggaagcgagcatgatttctggagtggactaccatgcatggtctggagttcagtaaactggaaagtatcacccccaagtcacaagaaattagagct

SEQ ID NO: 663840 - DNA, 418 bp, Homo sapiens
aagtgattctcctacctcagcctcctgagtagctgggattacaggaatctaatgaccattgaactgtggccatgacttcaattacaagtatttttttcactaatgtcagactgtgggcctttgtatatacactttttacaaactttttggaagagcaaaacatatttcagcaacttttcaaaggtgaatcacagggttgggaaacccttttaaaccccatttaaacccaatttttttctccccattaaggacataagtcagctgaagtgaggataacatgaatagcacaaatacattatgattgctgcctggccaacagtaattataagaaactgtcagttttgagatgtgtcttgatttcagagatgttaaaaaagtttgtaagttaccattgataaaatatgagtttgcttcccca

SEQ ID NO: 663841 - DNA, 364 bp, Homo sapiens
tgaggtctgtcacctgttccctcgacgggacggttcactatcggtctcttggaagtatttagccttacgggatgggccccgcagattcacacaggatttctcgtgtcccgcgctactcaggtggtagctctgtctataaacatgtttcaaatacggaactatcaccccctatggtcgacctatccatgtcgttcttctacacgtgtatagtacattagtgctactcctacaaccccgtagatgccgaaacatctgcggtttgggctactccccgttcgctcgccactactaagggaatcacttttgttttcttttcctgagggtactgagaatagtttatgcctttttccttctaaagaactgg

SEQ ID NO: 663842 - DNA, 421 bp, Homo sapiens
gaccctagcaaggctcctccatcaggtgagagctgcttccactcaataacacttcgcactgattctccaagcccaggtgtgatccgattcttttggtacacccaggcaagaacccaggatacagacagccctctgtccttttgataactagagggtctcattgacctggttaacacaagctgcctacagacggcaaaactaaaagagcaccctggaacacacgcccactggggcttcagctgtaaacattcacccctagacacggctatggggttggagcctgcctgtctgtatgctcccctagaggtttgggcagcagggcactgaagaatcaagccacacccccatcgcacaccctgcgagggggacaagggaacctttctcttttcagttggtcttaataaacactgagtaaatgaaa

SEQ ID NO: 663843 - DNA, 177 bp, Homo sapiens
cccccttcctccagagtcactttgatccggaccgtggcgggtacgtgggctgtggagctcccaggcgatcctgaacctccgcctcaatatcctgtaccaccatgtgtaaccaccctctgcccctgatccctagctcgacccttattgattgtggctgcgctcgtcacgggggatcct

SEQ ID NO: 663844 - DNA, 1802 bp, Homo sapiens
  misc_feature (242)..(242): n is a, c, g, or t
  misc_feature (478)..(478): n is a, c, g, or t
  misc_feature (1057)..(1057): n is a, c, g, or t
  misc_feature (1084)..(1084): n is a, c, g, or t
ttgggctctaaagggggtaaagggggtcctataggttaaatatcggggccctatattttcaaaaattttttaggggagaatttaattctctataggacagagtggcgcattaaaaactgtggtggtttgtgctctccaacagaattttcaagagcatttgcaccggtagttattaccccgcggtgctcggtgttaggcggtgtaacaagtgttgtttgtggtttataaacgtctcgcggaanaatgtgtgacatctctgtgtgtctttataagccctataatgtgtgtggcgagaacagtctctctatgtagagtgtcgacaaagacgtgtcttttgtgtgctgatgtgtatacatctatatctatatatacacgacatatgtggggagagtgctctacttacaacatactggcggggagatgatatatctatacctgctgccgacatgtgttggtgctacaaagcgtgctacacganggcgagatgattctgcgcaacaagagttgatgcgccccgcggtgttgttgtctacctaatgagagacaacatattacgatgctgggcgggcgataacacgatgttatgttgttgttgaggagacgaagtttttgtgacaacgagaacaatattatgaagctcctgcgccgcagcgacgaatgaataaaaatctgccggagggattgattataaactgctgccgacataatgaagggggtatactacgaacgatgatttcaaccacaccactgtgggtggtggctctgggggccccccaccaacaatgattggttggaccaatcttcattgctgacgaatggttgctcgcttcatcaagacggcggggaagaagccgagggataatccttccggctgttgatgaagacaccacccttcttgccggacgatgcacgttgggcacatcacactaacggttgcctcctcacacacggaggagggatatagattggctgcccgatatattaacgaaggaggcgactactgttctgcttcacgaacgaacggaagagagcgcgcaccataaatcatatgagcaancggcgagcaccccctatcatacatganaggaaattggtctgatcaaatgctctgggctgagcgccgggctggtcgcgcactcacggagggacaaatcattcactgctgttttcctaccagacgataagagccggcgagtacttactatctaccacataaatatttcgtcaccccgcccgcattgagaaagacggccgagtatttcctctgtgagcacgaaacatgtttggtgcttcccacggggcactacaaattatataagcgacggtaatcagaaggactcactatacgcgagcgctacacttgtacactagcacgcacgcagtttgcctctaaacgaggcgagaacacaaacacacacgcggggggcggcgcgcatatattctaaccaaaccggcggcgacaacactcctttaatggcatggacaaagacggcccgaatcataattattaaagaggcggggcaaacaaccaaacattagcgttggacatgactatatctactatctaagagaagaggggggccgcggccattgtgaccaatcactactgttggaaaacaccgacgattggtgtctgccgacccaccaagtaaactggagttcttgctacatgagagcaaaactatcgccggaagaaaaaagaaccgatcggcgcagccccgcgacatcttttatacgacagaaaaggaggtattattctcccccctctatccgagaaagaggcgggggcgcgccccccaaaa

SEQ ID NO: 663845 - DNA, 294 bp, Homo sapiens
cagctcggaccgacataccacctcatctgcttttgaatatcacacattgcaatttagcatgacaaatgaatgcatgaactagcactgtgaaggagtcacaggctggggcttacgtttgaatctaatcctttttttttttcaccaagggcgtgaagtttggctatgtggcccaaatgggccttaaaccccggggctgaagtgatctcccgtgtctcagttctgcagattagggtggtggtgctcgggaactcccttagaagttcgaccgtgcaggcttgccaaagcttggcacgg

SEQ ID NO: 663846 - DNA, 539 bp, Homo sapiens
tgtgtgcctgtagtcccagctactcaggagactgaggtgggagaatcacttgagcctgggaggttgaggctgcagtgagctgtgtttataccactgcactccagcctgctgggtaacagagcaagactccatctcaaaaagaaaagaaaaaatgcctttgctacacttaatgaggccaggcaaaaaaaaaaaaaggtctccgtgtggaattctcattattagacaaccatttggcaaagctggctacgtgccattggttcccagtggttaacccttgtgtttctaccctttgcttcttttaactgatttttatattgacacgcatttttatattggttacccattttcgaaaaacttcgtgataagttgctagtggcttcccttataaacttacgatttatcattagtggctcccggtgttttatttgggagcaactgagtgtgggcacccagaggagttgttaaacaacccaggggtgccttcgtggtttattgtttttaaacattaaggtatttattacaggtttataacaacaaac

SEQ ID NO: 663847 - DNA, 376 bp, Homo sapiens
agggccccagtggaggatttttgcatgagaatcccaaatttttttcaaaaaaatttaaatatgctctggtttggggtctctctgtgaacccatccctcaaaaagtgggtaaagcccatacgttggaggatgaggatgtcattcaaattgtgaaaaagtgaaacctttcccttttcccatttgccgggcgaaccccaacagcgttccccatgatcaagccccccaccccagttctttttggttttggcagtccctggatcaggatccaggggagggaaatggaggccccccaactggaacttcttttgttttcccttggtgtccccttgtatgtcgaactgcataaaagatttggtaggctggtcagctccctccca

SEQ ID NO: 663848 - DNA, 562 bp, Homo sapiens
agctggaccacaacgttggctcgaccaaagtaagacacacgaaagtttggctttccatgtggacacgagtgtcgatctgcatagcttttgcaaagaaagagaaatctcccgatcttcactattgcacatagcatgggctttagttttgtctcgatggatgggaatcgatcgaccatgcttcggctacctttcctctggccgggacatggacgttggtggcctggacaatatggtggcacccctggtcaatcttctaatcggctgtgtcgatgtcagcactggacttaccgatgcattggcggagatacgcaattacagcattgacaacttgcgattccaacatacgtcgctcgcagaaatcgaaaatcgtctcggcctccgtggccagcacctcttcaacaccgtgctgtcagtccatgatcgtggacctcacagtcttgcgtccgatggtctccaggtcagaaacacgagtgaagatgatcctcacgaggtaagtattgcttatatcaatcaaacttcagtgtctaacaggaagcttagttcgatatgacatgcagccagg

SEQ ID NO: 663849 - DNA, 957 bp, Homo sapiens
  misc_feature (353)..(353): n is a, c, g, or t
  misc_feature (374)..(374): n is a, c, g, or t
  misc_feature (429)..(429): n is a, c, g, or t
  misc_feature (460)..(460): n is a, c, g, or t
  misc_feature (464)..(464): n is a, c, g, or t
  misc_feature (522)..(522): n is a, c, g, or t
  misc_feature (528)..(528): n is a, c, g, or t
  misc_feature (551)..(551): n is a, c, g, or t
  misc_feature (570)..(570): n is a, c, g, or t
  misc_feature (622)..(622): n is a, c, g, or t
  misc_feature (803)..(803): n is a, c, g, or t
ctgtcgggcttgtttccttctttactgccgtgtctacttctgaagtctgggaagtgccaagccacgcggctcaagggagctggctggtgttgagctgtggcagaagcacctggggctccaggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatcctttttttttttttttggaaacggagntttggcctttgtcgcccaggntgggattgcaagggcgtgactcctcggcttcaccgaaacctccgcctcccggatntcaagcaattctccggtgcctcagcctcccngagntagctggggattacagggcacgcacctccacgtccgggcataattgtggatatttaanggggangagggggttcctccagtgtcggntcaggcgggtctcgaactncccgacctcgaggtgatctggcccacctcgggcctcccaaagtgcggggatnacgggcatgagccaccgcgtttggccagaggcgtccttttaagcgaacatttagggcctggagtttggccacgtaggagtctcaagccaaagagaggtcctgaccatggggttccataacgagccttgtggtggctctcaaggagaaagcccaaagaccgggacattcatgaggtcgtggncaggtatgatgtcgagaaggggcccttggcaagaaccgggtgacgctggttgcccaaatgggttgacactgaaaagcgcccctaaaaaggagtcccccacgtggttgcccactatattagtccagagccggaaagccggaaaacacagcggggg

SEQ ID NO: 663850 - DNA, 274 bp, Homo sapiens
accgagatcgcgccagtctgggtgacagagtgagactctgtctcataaaaaaaaaaaagaaaaaaatttttcattcttaatatagggaaggcccggctagctttctgtcacttgcaaccaaaattccgggcttttacaaaaaacaaaaacaaaaagatttttaggtgttaaaacatctgctgtttggcacatttaccaagacagggagagcctctgcttggtttatccacggttaacttatgtcccctatgattttttatgtaacccacaggaa

SEQ ID NO: 663851 - DNA, 867 bp, Homo sapiens
  misc_feature (867)..(867): n is a, c, g, or t
cgtggcggattgtaagctgctggtttgcggctgggaagagcggcgagaagggttcggcatttcgtcgggatccccgcaaggatgagtgccgccagtagagtctcacccgcatggggtgaacgcgtcagcctccccagacgacgatgctgggatctagcacttgggaggcagcgagacttgggtaatgaagagagagaaccaaatagttcttgagacttatgtggtgcaggaaagcaagagaacatactgtcgtcttgtataggagatcacaaatcatgatctcacttccgaagcggggaagaagacacagaaatattaatgaagaatcgtggagtctcaatatcagataatagtatggtacagtatattatcaggacgatatcggggacattgtggacttgggttcagtgaggtagaagaccgtgatggtgacggtgatgtgcctggtagaggtgatgatgatgacgatgatgatttcactgatcctgaaagtccaggatgattctgagagcgattcagagtcaggagaaagaagaatctgctggagaactccaagctgtgagcacctgatgaaagtggaggatccacataataaagatgcacgagcatattgatgatgttgggttaatcagggctactagtccaaagcttagtttgattacaggtaggttttggtaactgccaggggggggaaagccgactgggttattgtacaggccttaaaatgagagaggagggcacgcacgggacctgtgggacacaccatttggggagcggcgaaaaaaagcacttctaaataactaaagggagatgggaacattattataaagagatggatttgataacaattcgtcaaattttttttgn

SEQ ID NO: 663852 - DNA, 112 bp, Homo sapiens
agtctcctagttacatcaggcactggatatgttagggtagtacggtagaactgctattcttcatcctatgtgggtattaaggagtatgctcagattttgcgtcgctaggttt

SEQ ID NO: 663853 - DNA, 1480 bp, Homo sapiens
  misc_feature (247)..(247): n is a, c, g, or t
  misc_feature (273)..(273): n is a, c, g, or t
  misc_feature (295)..(295): n is a, c, g, or t
gatcatgtattacacgatcgaagtcatagaggcctatcgtgatggcgaggagaccattattagacgatattaccaaaggcctttgcatcgagatgaatggcatcatatgaactctagacaaaaacacaataggtgatataaaacttacttaatcaaactcttgcatccatatcttacacctttgtagcacatccagggcacccaagttcatcccatacgtgcgcatatacatacgatgcgcatctcntgatacgtaagataggccataatctnaactagttgcgcgcgaggtccntgaccactacgaagtgttgggctctccgggtaggatttcccagagagtgcttgcaacggctgattcactgaatacacgcgatttcctgatctatgattttcaacaccagcattgtgtacaaggttccaccttaggccgttagcaatacttggtagaggtgtcctagatatccctgtggaaggtcataattcgctaaggcgtttgcaagggcatctagcgttagttcgtcaccatagctatacatgtacccttctccaaaataggaaatggaagaaaaagtggtcagtgcgaggaaatgaatgagcgcaccatgccattaagcgcgtggggccccaatagactcatggcgaagttatccgcgcgacgtgtcagtggatacctaatggtgagcgtgggccctacatttcacagtgcgcaaaattctgttggtttttattcacccgtaggagattgcccaaacggtgagttcccagtgttgctaccaggggaaattttcgccaaggcaaaggtcagcgggcaaccatagtagcgttttaagcaattcgcgcgcccaatgttctgaggggtataggtgagcgaattggaaaccttgtgcaccgaggagtttgagcccgtccccaacgggtggaaaggggctatacccttaaagaatgaaaagtcgttttcaatcttaacacaaaggggcttcgtgaaggcgaacattgccttggtaaaaaattggaacgtgccgatacgggtgcttggacagcacgggaggctgttgaaacaccaaagggccaattgtccgggaccattcccacggtttggggcaggcataaagtccatgccccagtggggcgttcccttatatacagcgaaatctaggacgcccgtttaaccccaataaaagcccttctcttagtaaacagcagaccacctgtggggaaaagcggcggcgtataaagcccctttccccagagtaaattcctcctttaagcccaaggcagggccaaccgaggcagagccccaaaagtgcaacaggtgatttcccttgtggcacacgagacaacaccttggggcgtgacattatatatatatcatggaggcgggcaattatggcgagggagaaacgctgggcgtcacttacaaaaaatcacatttctcgaacacaagctttgtagacaaagtgagctcttgcccccaagg

SEQ ID NO: 663854 - DNA, 599 bp, Homo sapiens
gactcaggaattcaccacccagcagctctcagtgctgcgctgccgtgtgtagtcgccagttcttttctactctaataaacttgctgtgtcacttactaaaagcaacagcagcatgaactgtgacacaaaactggccggcgtcttacacatctttaaaagtgaaaactatgcaaccttatcaccatacaccttatgtataatatttagcatagactatcacatttttaacaacatgaaaacagttctgctatatcttgacaactatagctaaggaataagaacatgcatcaggctaaaacagacttgaggcaaatttcccaacctgctttgctgtaagggagtaacagtgatgtgagatgacctttttttccttctgtttaaccaatgttctttacaacggtaatgatttatttttttgagacagggtcttactatgttgcccaggctggtctcaaattcctgagcttaagagatcttcatgcctcagcctcctaaagtgctgggattacaggcacaagttcgagatcagcatggggtaacacagtgagaccccattcttatataaatttcttttcttaacttatctattatacgacaga

SEQ ID NO: 663855 - DNA, 126 bp, Homo sapiens
gacttgtctctatgaaaatgatatggaaacttctaaaatggaattggtgcatatgtactgctgaataaagaccgatgaagaggtttgttgtagacttacaaactcaagttaagtggtttgaacacc

SEQ ID NO: 663856 - DNA, 196 bp, Homo sapiens
gcagatgcagagatttaatgttggagaagattgtccagtgtttgatcggactctttgagttttgtcagctctcaactggcggttcagtagctggagctgtgaagttaaaccgacaacagagctgatatggctgttaattgggctggaggattacaacatgctaaggaatcaggagcatcaggttctgtgacgtgga

SEQ ID NO: 663857 - DNA, 134 bp, Homo sapiens
tccaccttactacagacaccttgccaaccatttacccaataagtatagcgatagaaattgaacctggcgcaatagatatagtaccgcaagggaaggatgaaaaatataccacgcataatatagcaaggctaacc

SEQ ID NO: 663858 - DNA, 333 bp, Homo sapiens
ggttgatgtgagctgcagagcacgccacttcagtccagcctgggagagagagtgagactctgtaataacaaacaagacaaaacacaaaacaaaacagaaacctagctctcaccatactataaaattcagatccagaatagattaaagatgaaagacataaatgtaaaagctgacagtatgacactactagaagaaaacattggggatatgcttcaggacactggtctgggcaaagattttttgggtaagatctcaaaagcaaaggcaacaaaagctaaaatagataagtgggattatatcactctaaaaacctgcacagccattgcactccgg

SEQ ID NO: 663859 - DNA, 308 bp, Homo sapiens
cccgccgccacgctgtctgttagaatattattggtttgtttatgcaacaatcagcagctctgcctggcagatggaaaattccttatttcctcttctacgcttagagtatgatcctcagtcgttctcagtttggaatttctctcttccgcacttacctgctgtgtgactttgtacaggctaatttatctcccctaggcctcatttcctacatctattaaatggtggctaataattttatatacataagagactgatctgcttcctatagttctatactgtctagagtttggccatattctcataccgcc

SEQ ID NO: 663860 - DNA, 464 bp, Homo sapiens
ctctatatgatcctcgtacccaggcgcatttctggtaatctatcctaaggaaataatcataagagtagaatggacaataaaagggcttcctgagaatagatattgtcatgaatcattatttacaagggttacattactgactatggttacagtgaagggccagattaagcaaactctggaacttctgctcaatggaatactataggctttacaaggaatctattatcattgctgaagctactgagcaagcgtggagcaatatgggggctaatagtataatgcctatggaagaaaactggatacccaattcttgttcgccaattatgtaaatttcccaaatgcatattgcttcagatcaaaagaaagggtacacaacgtgaaagtcttgactgggataggcatagcgatgacaggagaagggattatgttgaattattttcctacctccccctcatcttctagaa

SEQ ID NO: 663861 - DNA, 389 bp, Homo sapiens
gcgtcgacgcgttccacctggaacacttccaggtaaccactgttgcagatcagcaacttgccctggcgatcacgcacatagatcgggtgcggcgtgcgttgatcaagactcgcatgaactcaacctgatcgctcaacgcctgctcggcctgcttgcgcttgcagtcaacatccgcaggtaggcgatccagcccagggcagtcaccagcaacacggcggcaatcccaaagccctggataattgcgctgcggttgcgcaccagtagctgtcgcctaccaccacttcgctgcgccacggattggtcaactcgtccatttcctcgggggcgatgctgagcagcgcattgtccaggatcgagaacaattccagcgagccgcggccgtggcaaag

SEQ ID NO: 663862 - DNA, 1064 bp, Homo sapiens
tggaaaaagtcagggaggcaagggggtgggtttgaaaccagtttgggggggtttgcgattcctttcctttttgtgggtctatagaattaagtgtatattaggggtttcttcgaagtggtggtggataggggtggggggcattccaatattagttcactcacagggttaagtgggagggttcttctctactatatatctgggcacttttcgcgcgcttcgaaagcgcgagagggctttctctcaaatctcacgtgaaaaatttattataccatattctccgtggcgtggtatagaagacaccagtgcaagtggagccctatagcgagaacgtgcaatgcggcagtgtcttcacagatggtggcgtggtacgtgccccttgcgcggctgcatcagtctcgcggcagattaacgcgtcctgcgcggagcacaaatcgcgcgggcgatatgagcgcgcgcgcagacacacagcgctgtgagcgcgcgggcaccacaaacaacacacgcctccaacacaattataccacaccgccgccgcgcgagacagcaacatactatcgtagagaaatgaacgaagtcgcaacaacaaacgtgagagccaaaactcacgacaggcgcgcgcagccatatcgacgcacctcatggaggcgcaccctcaagccgggccgcgacggcgccacccaccccccgcccgccccaacaactacacacacacggcgcgcgcagacaaccaccactccacagacccaggaacaacacctagacagacgcgcgccccccagcaccacgcgacactaagacacgaccacgacagcgcgtcgacagcgccacaccactcacagcaagcaggcccacacgcccacacgcacacaaacacgcgcgcaaccgacaaaggcaggacaaacacgccctaccgagccggcagcaaccaccagcgagtcagcacacgcacagccagcacacccaccgacgccgcacgccaaggacccacgcatgccgccgagcactcacgacggacgtcacaccagcccgacaacgcagcaaggccgaccgcaccaccccccggg

SEQ ID NO: 663863 - DNA, 391 bp, Homo sapiens
  misc_feature (2)..(2): n is a, c, g, or t
  misc_feature (26)..(26): n is a, c, g, or t
  misc_feature (256)..(256): n is a, c, g, or t
gntagccataatagccgggatatagnatttccataaatttaccctttatcaaacttgtttgcctcaatttttgtttatacattcataagttactaacccaagaaaatagaattttggctgggtgtggtgactcacacctataatacccaggattttgggaggccaagacagcaggatcgcttcagcccagcagttcaagaccagccctgggaaacaaaggagaccccgtatctacaaaaaaaatcaagttagcctnggttgccagtgcacacctgtgtcccagctacttgggaggctgaagcaggaggattgcttgagcctgggaggttgaggctacaatgaactataattgtgtcactgcattcaagcctgagtgacagagtgaaaccct

SEQ ID NO: 663864 - DNA, 425 bp, Homo sapiens
tccccactccaatgacaaaatccagtatatttaacacaacatatctcaattaggactcgccaggatttcaagtgctcaacagttacaggtggctagcgcctactgaattggacactgcagtttcagtgcattgaatttctatcccacttagcgctaattaaaacttcaccctctcacctgataattatgctaagatctcagaaagtaacccactacaggcagtttcacgccttaatttacctctaattactcttacagcaatgcaatgaatcatgatttaaaatttaaaaaaaaaattgctgttaaattattagtcaagcgcccagggcaatggacagtagagacataatgtaggccaagggccgagatgacaaaacggtccttttatttaaagctataacaataatatgaagccagccctgtaa

SEQ ID NO: 663865 - DNA, 95 bp, Homo sapiens
atgaacagaataagaacattagttgacaatgcttacagctgtgatccaaggataaaaaagttcaaggaagaagaaaaagccaagaaagaagcaga

SEQ ID NO: 663866 - DNA, 190 bp, Homo sapiens
  misc_feature (6)..(6): n is a, c, g, or t
gccggnccccacatgtggtaggtccacaaaagttggcgaagtcatcgtggtcacacagaagcaacaaacaacgaactgaacctacttggcgggatcaacatctctgcggatgattacaacccagagcgcgtcatctttgatatcgacaacgagtcgtatgtaacaaagtcaggtgactatttcacagaag

SEQ ID NO: 663867 - DNA, 242 bp, Homo sapiens
agtatcttaattgtgtgtattacatgtatgcaatatacatgcagtactgtcatatttgtaatagtttctaactaggtgggacacactggttcttttcttttttgtgtgtggggcatggagttttgctcttgttgcccagcctggagtgcaatggcacgatctcagctcactggaacctccacctcccaggttcaagtgattcttctgcctcagcctcccaagtagctgggattacaggcacc

SEQ ID NO: 663868 - DNA, 533 bp, Homo sapiens
  misc_feature (13)..(13): n is a, c, g, or t
  misc_feature (117)..(117): n is a, c, g, or t
  misc_feature (354)..(354): n is a, c, g, or t
  misc_feature (414)..(414): n is a, c, g, or t
  misc_feature (434)..(434): n is a, c, g, or t
  misc_feature (441)..(441): n is a, c, g, or t
  misc_feature (448)..(448): n is a, c, g, or t
  misc_feature (510)..(510): n is a, c, g, or t
tttcgctcccagnttatatgatcggggtgacaccccttgccggaggtggcccatgtcaagcacctgtctgccagccagaaggcactgaaggaaaaggagaagcctctggagcagctntccatgatgagaaagtcgagttgttcgcattaagttcaaggagaagcttttcttagatgaacaggggctcgaacgagtggaaaacggttgtgggcggtgccatgtttttcatcggtttcaccgcgctcgttatcatgtggcaaaagcactatgtgtacggccccctcccgcaaagctttgacaaagagtgggtggccaagcagaccaaaaggatgctggacatgaaggtgaaccccntccaggggttagcctccaagtgggacttcgaaaagaacgagtggaaaaagtgaaaaatgntggcctgggcctgcacctgngcctggntttgtcnccgccatgcaactccatgcctatttactggaaacctgttatgccaaacagttgtacccctgntaataaatggcccgttttcctga

SEQ ID NO: 663869 - DNA, 921 bp, Homo sapiens
  misc_feature (160)..(160): n is a, c, g, or t
  misc_feature (398)..(398): n is a, c, g, or t
  misc_feature (406)..(406): n is a, c, g, or t
  misc_feature (461)..(461): n is a, c, g, or t
  misc_feature (475)..(475): n is a, c, g, or t
  misc_feature (479)..(480): n is a, c, g, or t
  misc_feature (510)..(510): n is a, c, g, or t
  misc_feature (518)..(518): n is a, c, g, or t
  misc_feature (536)..(536): n is a, c, g, or t
  misc_feature (548)..(548): n is a, c, g, or t
  misc_feature (553)..(553): n is a, c, g, or t
  misc_feature (560)..(560): n is a, c, g, or t
  misc_feature (588)..(588): n is a, c, g, or t
  misc_feature (591)..(591): n is a, c, g, or t
  misc_feature (607)..(607): n is a, c, g, or t
  misc_feature (609)..(609): n is a, c, g, or t
  misc_feature (615)..(615): n is a, c, g, or t
  misc_feature (617)..(617): n is a, c, g, or t
  misc_feature (628)..(628): n is a, c, g, or t
  misc_feature (633)..(633): n is a, c, g, or t
  misc_feature (635)..(635): n is a, c, g, or t
  misc_feature (645)..(645): n is a, c, g, or t
  misc_feature (652)..(652): n is a, c, g, or t
  misc_feature (655)..(655): n is a, c, g, or t
  misc_feature (661)..(661): n is a, c, g, or t
  misc_feature (742)..(742): n is a, c, g, or t
  misc_feature (802)..(802): n is a, c, g, or t
  misc_feature (822)..(822): n is a, c, g, or t
  misc_feature (829)..(829): n is a, c, g, or t
  misc_feature (836)..(836): n is a, c, g, or t
  misc_feature (898)..(898): n is a, c, g, or t
ttgttgggtggtgaaataccctaactactttgtacagcacaccacgttttcagtagcaatttatgtgctcaccagtcacttagcaaaagatgacttcgtgaaggttcgagcaaggataaggggactcattcatttaatgactgtctcgactgttgtgagnactgcatctcaacagccagcatctggggtcccgacctgatagtttgtgtgtgggcattgccgggttgctcgctcgtggtaatgactcttccccgaggttctttctgtccaggcagaacaggcatttttccattctgaataggtatattctcgtacttttggtttgaatgtggatgtgggttaataacgacccgaatctatttgatcttccaggtcaccttgggctctgtttgtcagancctgttanccatagcctttagagaggaccttctgcttttagcttattttgttgctaacttttnacaaacaaagggcnaatnntaaaatgtcagtgttgtcagtggtcagaanccgtgtgnttgagcgggtgttgagtngcaggtggctcngctgncctggtngctggtgtgtcgggaggatttaacctcnctnacgcgcactctccccnanaaacancntgttgagatantcttncnccataacctntctcacnccntagtcnacggccccctcccgcaaagctttgacaaagagtgggtggccaagcagaccaaaaggatgctggacatgaaggtgaaccccntccaggggttagcctccaagtgggacttcgaaaagaacgagtggaaaaagtgaaaaatgntggcctgggcctgcacctgngcctggntttgtcnccgccatgcaactccatgcctatttactggaaacctgttatgccaaacagttgtacccctgntaataaatggcccgttttcctga

SEQ ID NO: 663870 - DNA, 265 bp, Homo sapiens
tcgatcgagctcggacgaaacctaattacggaggaatggcagctactcgactgtgatcagagaacctgttattgggatgtgatgttggagaactttagaaacctcatctcggtgggtaaggacagtgtctggtaacttgtcagtatctctcagaatgttttaatagtgcctttaagacttgtgaaagctgtgaacattcagaagcattaataagtttggtctggaattttagtggttacggtttcttaatccccttgaggatcag

SEQ ID NO: 663871 - DNA, 547 bp, Homo sapiens
  misc_feature (106)..(106): n is a, c, g, or t
  misc_feature (159)..(159): n is a, c, g, or t
ggggccggacgcaccttccccaggaccattcccctgatccaacagttgttaaacgccacggagctcacgcaggacccggccgcctactcccagttggtggccgtgntggtctacacccccgagcgggccaagttcgccaccggggtagagcggcaggantggatggagctgttcattcacacctttaagctggtgcacagggacattgtgggggaccccgagaccgcgttggccctttgttaaagcccgggcacccgcccagccgggttggggcctccttgccacaatagtttcccagggctgcccccgacaggttggctttcagtggaggccaaagatctggaatcggggtcagcggggctacagtccttccaggggttttggggcagctcccagcctcttcccatgttggtggccaccgtgtcccttgctgggggtgcattttccagtttttcctccgttttccaggggccgctctctttataagaaccctggtcattgaatttaaggccccccccaagtccagaatgccctcgcaagaccctta

SEQ ID NO: 663872 - DNA, 490 bp, Homo sapiens
  misc_feature (311)..(311): n is a, c, g, or t
  misc_feature (371)..(371): n is a, c, g, or t
  misc_feature (391)..(391): n is a, c, g, or t
  misc_feature (398)..(398): n is a, c, g, or t
  misc_feature (405)..(405): n is a, c, g, or t
  misc_feature (467)..(467): n is a, c, g, or t
ggatgcacatgatgctaccgtccagaaggctctgaagagagagatggagaggctcctggaaacccatctccactggatcacaaactctaacttgtatctcatttagcgtccgaggatacgcttagatgagatgaacaggggctcgaacgagtggaaaacggttgtgggcggtgccatgtttttcatcggtttcaccgcgctcgttatcatgtggcaaaagcactatgtgtacggccccctcccgcaaagctttgacaaagagtgggtggccaagcagaccaaaaggatgctggacatgaaggtgaaccccntccaggggttagcctccaagtgggacttcgaaaagaacgagtggaaaaagtgaaaaatgntggcctgggcctgcacctgngcctggntttgtcnccgccatgcaactccatgcctatttactggaaacctgttatgccaaacagttgtacccctgntaataaatggcccgttttcctga

SEQ ID NO: 663873 - DNA, 138 bp, Homo sapiens
  misc_feature (6)..(6): n is a, c, g, or t
  misc_feature (57)..(57): n is a, c, g, or t
tgtgcnttttggtgcacatacataaacatctcaatgcattaaagagcagtatggcancagcatgtctcatttccagccctaaggcagttttcctgctgactctctccccactattaccctatggccccgggccgaatg

SEQ ID NO: 663874 - DNA, 121 bp, Homo sapiens
  misc_feature (61)..(61): n is a, c, g, or t
  misc_feature (63)..(63): n is a, c, g, or t
  misc_feature (72)..(72): n is a, c, g, or t
  misc_feature (75)..(75): n is a, c, g, or t
  misc_feature (78)..(79): n is a, c, g, or t
  misc_feature (81)..(81): n is a, c, g, or t
  misc_feature (84)..(84): n is a, c, g, or t
  misc_feature (95)..(95): n is a, c, g, or t
ggtaagcgctgcctggctcaggcctctcctctgcccacttctgtctctatgaggatagcangnccgggcatnganacnntnctnctgcagggttnctccctcctgcagaccccaagccagg

SEQ ID NO: 663875 - DNA, 759 bp, Homo sapiens
atattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccccggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaacc

SEQ ID NO: 663876 - DNA, 396 bp, Homo sapiens
  misc_feature (1)..(1): n is a, c, g, or t
  misc_feature (47)..(47): n is a, c, g, or t
  misc_feature (78)..(78): n is a, c, g, or t
  misc_feature (184)..(184): n is a, c, g, or t
  misc_feature (314)..(314): n is a, c, g, or t
natgatgtccctctgaaccttaaagtccctttatttcctgtatgttnctcaaaatggcagatcccattcaaaaaattnctggagcccaattatttaaagttcccagataacaaggccgggcactgtggctcatacctataatcccagcactttgagaggctgaggcagatggatcgcttgagtnccaggaattcaaggccagctttgacaaaatagtgagaccccatctttacaaaaacaaacaaattagctgggatgatggtgcacacctctagtggctactcaggaggctgaggcaggaagattgcttgagnccaggagttggaggctgcagtgagctatgatgataccaccacactccaccctgggtgacaaagcaagaccccatatctttta

SEQ ID NO: 663877 - DNA, 208 bp, Homo sapiens
  misc_feature (145)..(145): n is a, c, g, or t
gaggctaaagtgaatctccattaactagcatatagttgcatctttaaaaaaatcatgcctgggctcgttggctcacgcctgtaatcccagtactttgggaggccaagtcaggcggatcacctgaggtcaggggttcgagactacnctggccaacatggtgaatactgtctctactaaaaacacaaaaagtagccaggcgtcgtggtgc

SEQ ID NO: 663878 - DNA, 164 bp, Homo sapiens
tgcggaagacgcgccccgctctcggggcagagcggaaaggcccatagggatgctggagaggcccagccacccctgcactcacacttgtgcagcattagctcataggtgtacttgcgttgttctgcgcaagcagtatcgcctgctgcttcaggcactcgcatgct

SEQ ID NO: 663879 - DNA, 205 bp, Homo sapiens
  misc_feature (4)..(4): n is a, c, g, or t
  misc_feature (10)..(10): n is a, c, g, or t
tatnctgganacaggcaggtaatggccatgataataatgatgacgtttatggcagtgataagcatcatcatccaaaatgaggcagaggccaggcacagggctcatgcctataattccactgctttgggaggcggaggttggaggattgcttgaggccaggcatttgagaccagcctgggcgatgtagcaagaccctgtctataga

SEQ ID NO: 663880 - DNA, 360 bp, Homo sapiens
atagtttaactgccagcagcgagattaaggctagagttaaatgatgatgagaggaaagagagcaaaattcacccatttatatctctcgcatcattcctggaggggtggctgaaagacacggaggcctcgaacgaggcgaccagctgctatcagtgaacggagtgagtgtggaaggagaacaccatgagaaagctgtgaacctactcaaggctgctaaagtacagcgtcacgctagtggtgcgatacaccccaaaagtcctgacccacatggaggctcgctttgaaaagctaggaagagccaggcgttcggaagcagcagcatttgctccttcagcagcatgcaaccgctgcagacagcgt

SEQ ID NO: 663881 - DNA, 161 bp, Homo sapiens
  misc_feature (71)..(71): n is a, c, g, or t
  misc_feature (132)..(132): n is a, c, g, or t
  misc_feature (141)..(141): n is a, c, g, or t
ggggctggagctggggctggttacttgttgacgtgcagagctgctcccgggggctgcagctcaaattgggnggagctggactcagatgcccccgtaggtgcaaaagcaacatccacatctcactcctcccgngtgcttttngcggtattcctgcagcgcta

SEQ ID NO: 663882 - DNA, 358 bp, Homo sapiens
  misc_feature (126)..(127): n is a, c, g, or t
gtgaccagcgcgattcaccgctctaatcgctccggttttccaaggccttgctcagtcatcctgccggacaagccctgaggctggaaggcacaggggaaatttgtttagggtggaggctccataacnnccagtaaaaaaaataagtttttgttttttggcgccatcggttaaggcgttcggctgttaactgaaaggtctcacaaaacttcttatgaagagctccaaattaataaaggatgcctttcataatgagctgatgggagatgaaaatatcaaaaactatgcctataaactggagatgtcgcttactggaaacaacatcaaataaaatactccctccaagtccactggagggcac

SEQ ID NO: 663883 - DNA, 160 bp, Homo sapiens
gcatgctagcatagaattctttaatttttgtgactctgcaaatgccataatttcccttttgtttagtgaaggatagttttgctagatacagaatttagcagttggcattctttttactttagacagtttgaaaatatttcccattgttggtccgagcgga

SEQ ID NO: 663884 - DNA, 474 bp, Homo sapiens
aggagaggcttaaaaccggcacgccgcgttcacttttctctcatcaccactcccagccacagtctgcggcgggtccatgagttacaacattgggaatgcctccagtcctacagacactgacgggagcattaaggccgtgattggtgtgttacaaaagaatgctggaataccgacctagttggcttgacaaatagccagatggaccctgttgacctagaccgcatgatgaagaaacggaacaccaccagtgatggctagcttgatttccaagaacccattaatacagttgaggtgctacctatagattgccatgactccttcctcaaggctttgccttcccagaagcggccactgggacccctttgccttggtcgttaaacccacccgcttttaattccagcctttttggcattatctgcccaagacaaccattccttgagcacattaagcacctgatggagccccccacctggc

SEQ ID NO: 663885 - DNA, 724 bp, Homo sapiens
attccctcaaggagtacctctggcgatgcattcaccctactgagccccgtggcagctaggttcccaggcaggtatgcgctcaaactcaggcaagcttatcgactcagcagcccatggagccgagtcgacgagactctggcctgcaggcaggtgcgacttcagcctttcttcgagcctgcgctacagactagcacgagttgtgtgagcttcggagccagtagcccccagtccttcactggtgccaatcgggggcactgactggagcaatgttgcaccgtggctgattggactccggagcattcagacagcaatgaccattgcgaagaatgcccagcccactgacacttttccgtgcctcctgctctcagatgacgcccgttagcagagaatctaagccatgacctggaccgaaggggtactgtcccaggtcaggggagaagtctctcagtccgccacatgctaccaatcatgaacatggcagccccaaagctgagcataggccataagtacagggttttccaacccccagcctcttgactggtgaccacctaccccttctttgtcactagtctcccacccaccccatgctttgctgggattcccatcaactctcagaactgtgtggggtttcgctggggccttgtggaagccatgacttcacaaagaccctacctgtcagttcttgtttctggggaggaggaatccacctgcactgagaatgagg

SEQ ID NO: 663886 - DNA, 148 bp, Homo sapiens
tagtaattccactcataccactctgaacatctacttaccccagtatccctcgattcctggacggcgatcgatcctgaagccccttcagtgccccctcatctgagacaccaccaatcccacctgtcacaccccccgtggctccctggac

SEQ ID NO: 663887 - DNA, 937 bp, Homo sapiens
  misc_feature (687)..(687): n is a, c, g, or t
tataataaatttcaccaagtatgggctcttctggtgatggtgtttttttctccgttggggaatttctaatcccaggcactcctcagtctcatggtttcattacctatgaggtttcatttacttcttggtaaatgtactggactttgggagttacttaagaaaccacagttcctaaaacatttatattggggagctcaacttcgtggcttcctactttaccaagaaggcagtaagttataacctcgtggccttgggtctttacatttttcaacttctcgtggatcccttaaaccttctgtggctcccaagtttacatacgcgtgtgccttattttccacttaaccacttcaacttaggctcacacaagtgtgatgtggcctcgtggcttgtgaccccagtgtgaatgtgagaaaggtgctccatagaagtgttttttattatttgtgttgtttctctttatcgcgcaacaatctttctcatgtggcgccacagagtgtggcccgcgtgtgtatacacactatctctatctctttcacagcgcgcctctctcccctttatagagagggagagggggcgagcccctatatagacgtgtaacacgcctatcaccagagggagtgcgagggtgtttcacgcagcactcctctctatctcacgcatataacacccgctagtctcgcctagaanaaggacatcctctcctcctgcaacacccccgagggggggcaacacattttctgacggccccgctgatctctccctctgccaccgagacgcgcgggagcaacacctcctcgtcggcgggtccttcctccaaccacgccgctgcgtggcccggatgcttctcagacacccgcccccggaagatagacgggcgtcgccctcatcgtccagcgaccagcacatttcctaccaacgcgggcgcaccctatgttct

SEQ ID NO: 663888 - DNA, 123 bp, Homo sapiens
agacactacagctggatttcttgatgccaatcttgccagattaccaccacctgcaagaagactatgacagggaagctcaactccagtaaagaactaagacaagtgtataccatgaaggtacca

SEQ ID NO: 663889 - DNA, 489 bp, Homo sapiens
  misc_feature (3)..(3): n is a, c, g, or t
  misc_feature (28)..(28): n is a, c, g, or t
  misc_feature (468)..(469): n is a, c, g, or t
aanaaggtgtcacgtcagaggaaatgcnaacgacttcatcacccagcgaatagccgcatttcgcgcggaatgttcaaattcggaacgcgctaccaccgtatcgtaggaaatatcagacacaccgcttaagccgcgcacgacttccagcatacgttgccgtggtgcgcttaatcgcccttgcaacatatcgcagaccaccagcgcaccggcattaatgaacggattacgcggtataccctgctccatttccagttgcactaaggaattgaacggtgatccagacggatctttgccgacgcgttgccagatttcctcttcggagtaatgacgcatggcgacaacgagactcagcactttggaaatagactgaatggaaaaacgttcttgcgcgtctccggcctgaaaaagctgtccgtcaacggtacagatagcaatccccaatcgggaaccgtctactgtagccagcanntggaatataatccgcgactt

SEQ ID NO: 663890 - DNA, 301 bp, Homo sapiens
  misc_feature (119)..(119): n is a, c, g, or t
aaagttcttaagaagttgaagcacctggttaataaattaaaataaaggtaaatgaacacaaaatgcatcaaggtaacctgccctaaattaatatcgccccgtagcactcacatcattanattctaaggtattaacatggtccacacagttgtggaaaaggcatgacagtgcactacgagtgtctacttagagagcggtgtcaacaccaggctggcacacggacctggggtcattcatgtaaaggtccttcggtgtcccggcgtttgaggatagaaccagcggatgggaagccggtcgacgc

SEQ ID NO: 663891 - DNA, 144 bp, Homo sapiens
gtgcgacacctttctgggcctgctggacagtcacctcattagggggccggtgacgccgagagccgggtctcctacctgaagatgaatggtgactactaccgctacctggccgaggtggccaccggtgacgacttgaagcgcatc

SEQ ID NO: 663892 - DNA, 887 bp, Homo sapiens
gggagggtgcaggcatggagaggaaacaggcagcacgtgcgcatgtggcggatgaagagggagcatgtgcttcatgccagtcctccgacgtgatacccgttctcccgaggtggtaccatcaagagtgtcattcttccatttcctccagatgtgtgaaggattatctactcgaggatggaactcgtgggtgttccaggagggtgatgatccaccaaacatattctcagccagacgtgtgatgatgacgcagacgaattcacaggtggtctgatgatgagaacacagccacgcttaagggacccaaagaatttccttgagtttgccagctaaatgtccaggacagctatcaattccttcgggggacagtgtcttccataggcttagtgtggagtgccccaaggggatgcgtatggatagcaattgagtagttctctgaaatgtaaaaccctcagcgaatcttcctgctttacaagaggtccgattcatcactcgtgactacactcagccgtgattcatgggtactgatgattctccagatcatgtatagaattatgagtcgtctccgaaatggtgtgaatgatcccgtgggctggagttcgaaggttggtccaaggaaaaaacaaggctgtatgggattctcaaaggaaatacgccaatattatggtccttttttcttaacaaagagagaaatttggagattttcaagacctttccagaaaacattcggcaaatttagaggagaccgggttggaataacgacactagggaaggggggtgccttggtaacacatgtgggaccgaatcagtggttcccggagaacgtctgttaaatacgggtttatggcaagagaccaccttgtaagatggtgtaccctattggtcaattt

SEQ ID NO: 663893 - DNA, 1246 bp, Homo sapiens
  misc_feature (780)..(780): n is a, c, g, or t
ggctctggctggactgccgcggaggaggcgagaaggaatccgacgctggggggcttgctcggtgctggcagcgactgctgctgcggatgggagggggccggctcggctgcgcccatggagcgccacggcagggctttccgcacctccgtctcgtcggcttggggagcaggcggccgggggacccccgaaagggccgggcggcaaggagcccaactggcggcggccgggcgagcaaggcgcggttcggttgcccgcgggtcggggcctcgggcttgaggggccaacacgaaggccggagaatcaggactggggggctccttaacaggcggggcccaaccttcgggtcctccccggccaaggcgcggttcaaaaagcccttggagggaaaaaaagccggcgcggctttttcttcccagtgcgttatggggcacttgcgactattccggttgcgacaaccatcctggggtccaacggcctgggtcattaattttttgggagcgccgataaatgaaccatttcaccttggtttgaacagaacggaaacgacgcggaagacagtctgcgacaacggtcctttcaacacaaagcccatttccgggacaggtctacccgtttgaagcctgccccaaattggttgccctttcaattgggcgtcctaaccaggggcacatatgcggggggacactcgtgtgccaaacgctttaaggcttggaaaggagaacctttgagactccctgggtggtgtgggaccggcaaaagggcgcccaatccttgccaacnctttaaatatcacggccgtcttccccccaccttcaaagtgtgaaagcattggctccttgggctttttaaacatcccaacatttgtggggcacgcaagcaattagaaagaccgttgcctccgaaagttccttccaaacaacgttggctacatttatgggtgcccgcaatggggaaagcggttccgaacagccgtaacaacaatctttggagcgcccagggaatttgcccttccaccaaattaagggctgaatctcttttccacggcgctttgtcgccaacacctgggcgattgcaaaccctaagcgcactttggcgtcgttggacattcacacaaggcgaaacttctcttagtaacacattttgggacctctcaacggtcccggagcattattccacatatggcggcgcggcgtccaaccacaggcggccctacactaatacgcttgtttggaaagaaaagcccgcc

SEQ ID NO: 663894 - DNA, 942 bp, Homo sapiens
gaggtgggacctttaagaggtgattaggtcatgagggttctgccctcataaatggattaatgccttcatctcgagcgtgggttggttatcacgagagtgggctcctgttaccatgaggcaagaagaccctcactagatgttgacaccatgcttttggactttctagcctccagaaccgtgagccaaataagtctcttttctttataaattacccagaccgtggctattctgttgcagcaacagaaagcaaagacaaagccagtttttgaattggttaaaagcctctccattgtacttttaacgttcactgatttcttaactttctcatttcctttacttcgtaactttcacttgaggttttactcattgctatagtgttcggctaacggtaacttaagctcaactaaagttccactttagatttccgagcaggcccacgccacccagggacacacgagggtctaccacgtcgatataggccccagcgcctgggagatggcaagggagaacaaaccaaagggcttcacttgacaagcctcaaacactttcgtccagatatgaccaggttgaatccctacacgagacatcaagacacgtccagggaattaagcactagtggagaacccttacagaggaataggacatttgtgcccaaaccagatggccccagagtacgtaaaaaggtctagaggatagtatacctatggatcagaaagaaacgggaggggataatcatagggacgacgagcactacacaccccaaagaggctcggggagacagaagcagagaaacgcgccgcgaagggacaccgcaagggggaaggaaggcgcagacccaaagccgtaggagagatagacaccacaaacgaaagatgctacaggggcaagagcacgaagggccaggagaacacccatgtatcggcaacccacgaggcagcagaa

SEQ ID NO: 663895 - DNA, 554 bp, Homo sapiens
cggggcaggccggcaagcagcctccggttgagtcccgggacagcgctggtaggggagtcagaagggagcccagtcggaagtgccaacaaccgtaaggagaccctcgcggggccggaccacagaggggaagcaaaaaaacaaaggggtgctggccaaaggaacccggtgtaaaagcgaacaacaaatcttccagggaaagggaaaacccaaagggggcagaacccaaaaaaattgagaaggaggacgaggagggcatctcgcagggagtcctcggaggaggagcagtgacccatgctgtgccgcttgtcctcactggaggagcagtttccttctgggactggacagcttttgctccgttccaaggccccggacctttcccccaggtcacaaccattaaaccgaccgagcctattgggcgcgcatactccgcaatacttcccaccgtagtgcccatcaaccgaggaacaggttacaacaggcaacactgatgccctgctgcaggaggctcccaagtcgacccttgatcttgtgcgatgcagtgtatccacgttgcc

SEQ ID NO: 663896 - DNA, 1405 bp, Homo sapiens
gctatgtgcgtgcggcgcggtgaagtgacaggagcagagcggccagaatgtgtttcctggctcagaccgtaacccttctggacatctatacacactggcaacaaacctccagcagcttggtcgtgcaagcggcaagtgcagcaggacagattgcggcactgccaagctcaagcaaaaaccgtgtgtccagcaccccatccagcgacctcggcagagctcggcaagaggcaggcaagcacagccagacagcctgcacacaccgccacaagccaaccccaacagcactcagcatctaccaaactcctcaagtccatgggggcggcactatgcccatccacagcatgaccagaaacaagccacaggccagcagcacagagcacagctggcaagcactgggacattcccatgcgcacaaccctgaccactagggaaggcacgtgtgcgcacaacctatctttacttggagaagtctccacagtgaagtcagccagagccctcagccagatactcacgttggtctccagcaaactagcaggcagagcagggccagcgtcccaggcactcaggcaggctagaagccaaagacatgggcatcagggagtcacaagccgggcccagggcacgaaagcatacaagcgcaaggaccaacctcccagctccacagagcatgcagaaccacacgctggcaggcgtcacaacatgccaactcgcaacacaacaatactacacaaggatccaaccagacgatgaccatcaggcacccaagacaccaacgggcacacccctcgacggaccacgacggctcaccccccagacacacccaccaggcgacaactgccagcgcgagcagcaacgacagtaccaacaccacaaggcgccgggtgcaaaggacacgagaggcacgaacagacagagcgaaactcgagaaagcgcgagcagcgggccacaactagacagacgaccgactgcaagaccgccgcgcacagcacaggaagacgcaacgacggggcaaccgacgccacgacgaacagcccgcaccgcacagcagcagcaaacggcccgggcagcgacgcacgcagccgaacacgagatgacccaacagcccccacggcacagaaccgcgcacggggagcagagacgtgcagagcgaacacctacgcacggccgaacacaggacaggagaaagaggcgacagcagcggacggcgaacacaccagaacagcacgagggacccgcagacgcgcgcgacgccggcacgcacacgccgccgccgcgcgacaagacaagcgcgcaaggccagagacggacggcgcaaggacgggggcgcagcgcacaacgcgcacgacagcgagaccgagaaccacgacctcaagacgaccgaacgcaggaagcgcgcgcgccgagt

SEQ ID NO: 663897 - DNA, 140 bp, Homo sapiens
ccctataatgaggctctgtagagtaagtcgcctctagtcataaatcttcccactatttagctacatagacgggtgtgctcttttagctagttcttagagtagctcgtctggtttcgggggtcttagctattagagctctc

SEQ ID NO: 663898 - DNA, 998 bp, Homo sapiens
ccgtgtatgatagagtcctccatctagttgtcgtgtgatccgcattcaccttgtgccgcgcaggtactgttgtgccgtgccgcgaccactcgtggtttgtggtgcccccccgccttctagtgctctgtcgcccaacttttcaagtagccccgttgcagctgcgtttcaacacagcagttgttccccggggggggaccccgcgcttgtgactgcgaccgtggaaccagaggggtgttgcagttcgggcacccctaattgctcgtccgttcagtcctcccttgtcactctccccaccggggtgtctcctgttacagccacaccgcaaggccacgacggggccatggggttcacccgcggaagaatcctggcgtgggtgacgttcctcgccggttctcccgccacctcctagcacagcacggtgcccacacgcgacacacggctttacaggggggcggcttccattcaggcctccctagagccaatgttccacctatcccccgtaacccggcgtgagcccaagggccccgaagatgggtcgcccacgggcccttacgttcaactgggtcgcacatttatttagcaccctccccgcccccccggggcagaaatcagactcccgcgcaaaatggggtgagggtgtgccccagttcgccacgcctataaggcgtgggcctatcaacatcggggaccacagatacacggtaggagctgtctcgcagcatcggaggaccgtggggcccaaccacccccccccagtagggaataagacccccacagagatgacgggacccccccaacgaaggggcgagggtccactcacaccccccgccccaatccgcagggcccaacaaaatcttcggcggaggaacaagcgaacacggacggagaaggggcgagtgcggggaagcgcgagtccacatacggggaggtgaaagggacatcgctcgcgttcggcatgtacctggaaaaaaaagcactattttgcaggccccataaca

SEQ ID NO: 663899 - DNA, 371 bp, Homo sapiens
  misc_feature (7)..(7): n is a, c, g, or t
cagcaantcatgacgactgaactcttccacaggcaagccctatatctacctacctgcatcagtcgtcacggatgccactgtggattcactgcgccgagtgagtccttgatcagcctgatagccatagaggtcatcgttggagtccttcgctgggccttggactgagtacttccgaacggaggagaggattaaagggctgatgcatggcacagatcttccttccttgtgaggccgtcgtcgtggggtgagccttgacataggcgggaagtctcatcctcttccagcctggaggagatctttaactggaagcgatcatacacaatgagaaggaacgtgctgcaagcctgcactcacttcatcctcagcagaac

SEQ ID NO: 663900 - DNA, 137 bp, Homo sapiens
acgaagaaagaaagaatagaaagaaagaaagaaagggaaacaaagaagacataaaggaaaagaaagaaaagaaaatctaatgccccgttccaatggtccagtggaaaaattgtcttccatggcaacccggtctctca

SEQ ID NO: 663901 - DNA, 1165 bp, Homo sapiens
  misc_feature (321)..(321): n is a, c, g, or t
  misc_feature (327)..(327): n is a, c, g, or t
  misc_feature (767)..(767): n is a, c, g, or t
tccccgggggcccggggggctttttttttggaccaaaaaaccccgggggttttccccgggggccccccgcggaaataaccaggagggctccactatggatcttctaaaacctcggggtgggacatgtgtggaggcggagaaaaaaacattggcttggggcgccatttcacccagatgtggcaagtctaagatggctgcgccaaacaggggtcccccgggggactctggcgttctctgtgtaagaatgtccataggagaacgcggtacagacccccccagggggggggggggcggccttacacttgagccgggggggcaccncctgtngcgaggtgtgttgtggctcggcggggccttcgagagcgtgccctgtagacctgtgcaccccagagggggggagggcgttctgtgtttgttcccccaagagggggtggcaccgaagagtggtctttgtcctgttgcccacaagtttttactgtgggagcccccagggggggttctccgaagaaaagttactcctgtggcgcggacacaactattatagcgcctcttgagtgggccccgagtctcccttttcaaaaattctctgtggaaggcagcgtgtggtgttggctcctttgggccccagcaggcccaatcagaatatcggagagaggggcgcaccccgagtttttggaatttgtcccccagtttgcaaaacgcccccccaaaaccggggttccagcagatgtgaggggggtattttagaggatctctcccccacgaanatagattagagagaccccccatgtgagcgcccccaaatacaatgtgtggctctggtgggccaacagttttgcagcgccctttagaaaagaaatctcggcaaacaggagaggccaatcttcggtggttcagacttttagaacacgcggggaagcgcagttgcgccaggaagacttatcctcggtaacagggggccttgggggacaagacccccctctctagaggggggttggggccacatctggggagaagaaacattccccccccaaataagcgggtaggaattcacctgagacaatgggcagtttgagacacatcttctcttcgacaaagcttcccccccaaggattcttccctgggtgccagaagaggggagatcactcctgcaataagaacaccg

SEQ ID NO: 663902 - DNA, 261 bp, Homo sapiens
tggaggatctctaagagtcgagcagtgctccagtcgttacgaaatttggaggtcagcacggtgctcacgtgtcgacggaactaatgtacagtgtaggcatgcaccgcagtggtgaatacacgtcgaccaggctccatgtatgcgttcttgtggaggtcagcacggtgctcacgtgtctgaaggaacttgtctagggaggcatgcaccgcagtggtgaatacacgtcgagctggaggcatgcatgcatgctcgggtactgga

SEQ ID NO: 663903 - DNA, 147 bp, Homo sapiens
tgagattgtaccattgcactccagccttggtgacagagcgagaccctgtcttgaaaaaaaaagaagtcagaggcaaaaataaaaaagaatgcaaaggaaccaagactaacctacaagactacaagatacagaaaattggctcaaaag

SEQ ID NO: 663904 - DNA, 714 bp, Homo sapiens
gcagcaggcggcgacatatggcggagaacagcggtcgcgccggcaagagcagcgggagcggcgcggggaagttggggctggtgtcctgcagagcaggtgattgctggcttcaaccgccttcggcaggaacagcgaggcctggcaatccaaagcagctgagttggagatggcagttgaatgagacacagccctagtgatcgatacacttgacagggagggtccgatgaaactcgtaagttgctaccgcattggttggcagcgacgttgctggtggcagcgaacctgtcaaagcaggtgctgcacccgctttggagaacaaccacaggagcacgactaccacgcacagatcatttgagacaactgacacagacagacttcagggcaaagggcaacacatgaacctagattgacattccgtggacacatgcacaaccattcggtcttcaatgggacgaacgcatgacgaagcccaaggacgagccacaggcaaaaacttcagacacgtgggcctgggtgctaaggcccagctccagcttggacgatgctatgggtcgttcgcttaagggaacccaaatggcgccttttggcgttattatcgttcataaccccttgacactccccagagttcttacatttgacttccatcataatatggtacactctaatccaatctcatttgtccctcattgcgtatagggataattaatctgacat

SEQ ID NO: 663905 - DNA, 102 bp, Homo sapiens
tccgtttcagcggacacattgaagccagctcagtcacaagccgtcaggtgtcgcgggatctataacaaggctcagtatctggagcagcgtacgacaatgatg

SEQ ID NO: 663906 - DNA, 366 bp, Homo sapiens
gtctcctgttgctgtattggtgagctcagctgttgtgagtatccacttaaaaagctgtggggggctaattacctttgaaagagcagtttgtctcttcagcgatgcgtatctcagtaaaaagttctctctcatggttctgccttatttttcatcatgtttactgcaatatcataaaccttgaataataccatgggacccatacaaagtgccaccggtgatggtgctaggaagtgcttcaacgaagcagagaagagtcatgacattacaagaaaaagctgaattgcttgagatataccatggattgaggtctgctgctgcacttgcccaccatttcaaaataaatgaatccagggtagggatcattgt

SEQ ID NO: 663907 - DNA, 111 bp, Homo sapiens
tccacttggttgaggcaggggcgtatggggaggatgcggatctgagctctcccagtgactggtgggcgcagccgggggtctgcagactgtgagtgggcctcctgttgtgtg

SEQ ID NO: 663908 - DNA, 373 bp, Homo sapiens
  misc_feature (46)..(46): n is a, c, g, or t
  misc_feature (64)..(64): n is a, c, g, or t
  misc_feature (103)..(103): n is a, c, g, or t
gcgtgatcatagctcactgcagcttccactcctgggcacaagtttnctctcacctcagccttanaagtagctgggactatatgcatgggccaccacgccaggntatttgttttattattgagtagagaagggggtttccctgttttgcccaggctgtgttaaactcctggcctcaagcatcctcgcaccttgcccttccaaagtgctgggattacaggccaccctgccctgcctcttcagttcctgactgttcccactggccagccccgaaagcccagcaacgagggagcaaggttggggcaggaaaaaaaaagcagcatcctcttgcgcccactttattagggggcaggggtgggaggacctaggcctgctg

SEQ ID NO: 663909 - DNA, 140 bp, Homo sapiens
ttcagcagccatagcatgagcaataaatagaaattaccctgtaaacaatatatatttctataactattgttgccctcctccctttcagtaatgtaaaaaattatcacagtatcttcttgtatcctaatatggggatcctc

SEQ ID NO: 663910 - DNA, 315 bp, Homo sapiens
  misc_feature (232)..(232): n is a, c, g, or t
  misc_feature (311)..(311): n is a, c, g, or t
tcttgctacactttaatgctaatatactttatcacagagtatcttattttactcaatggcaataaaaaaaataacagaacccttaaagggcatccacattgatttctcagtgtgtgattcattttgcattacgtgatataacatatactataagaatatacagcttctatatacagaaagcaaaacttacaaatagaagcagaaggactattacattccaacaagatatttnagggtgccagatgaaacaagcgaagataccattctgcttgagaggtgctcactgagcatagaggagaaacaaacatgtnaact

SEQ ID NO: 663911 - DNA, 165 bp, Homo sapiens
  misc_feature (86)..(86): n is a, c, g, or t
gtaagtcaattgctctatcagaaaagtctagaccagagtctctgttagttgtaactgacacactgacagaagctctagcatctgangcaatggattaggtcacatggactgcagttacactaaaatacaggaaatagtctatccatgggctggcaacatcctgtg

SEQ ID NO: 663912 - DNA, 242 bp, Homo sapiens
  misc_feature (107)..(107): n is a, c, g, or t
  misc_feature (129)..(129): n is a, c, g, or t
  misc_feature (175)..(175): n is a, c, g, or t
  misc_feature (190)..(190): n is a, c, g, or t
aagatcatgcacagagatgtcaagccctccaacatcctagtcaactcccgtggggagattcaagctctgtgactttggggtcagcgggcagctcatcgaactccatngccaactccttcgtgggcacanggtcctacatgtcgccagaaagactccaggggactcattactctgngcagtcagacatctngagcatggggactgtctctggtagagatggcggttgggaggtatcccatccc

SEQ ID NO: 663913 - DNA, 145 bp, Homo sapiens
caatttgccatctcccagaactgttaacaaaccccgacgaggtcgccccctatatcttcttacaatctcttccccttccccgaggctgctgtcctaccactccagatcattcctttagttaagagctgggcagtgaagtggatat

SEQ ID NO: 663914 - DNA, 229 bp, Homo sapiens
ctcccccccttttccccctttgggccgggggtgggggaaggggggggggtgttcctttcccccctcctgggggcctttttttgggccccccccccggccattttaagtccccccccccccttcctgggggggggtgggccccttcccctgggttttttacccctggggttgggggcctaaaaattttaacccattttttttttttttaaaactttttgccaaaggccca

SEQ ID NO: 663915 - DNA, 248 bp, Homo sapiens
ggtgaggcaggcagtggctcacagccttccatccatggggcaaagccagggcacagcagtgtgcaatctttcattccactccccagcctgtcctgtggcctgtcccactgtgtagcacttgttgttttccctgtccacatccatgctgtccagaccaccacattaacgcattttcatagtgccccccccccccaaacccacacacccaaacacacacccaccacgcaccacaaccaccacaaccagac

SEQ ID NO: 663916 - DNA, 471 bp, Homo sapiens
  misc_feature (463)..(463): n is a, c, g, or t
gtcggtcacctatttgtgtcggggttgagtgagcccagatcacgcctgcactccagcctggtgacagagcaaaacttcatctcaagaaaaaaaaaaaaaaaagagtgagctttttgaacctaccctcatgctcatagatagggcaacattgggtcaacagaaatattatttcatggctatggcttgggacaaagcaattaaaagaattttaaaattgtgttaagcagaaatttcagtgcattgttaaaaaaatctccaatttccccgtgagaaagagaaagagctggagtctcctttaaaaatttacctgccgtgtttttctgtggcctagttgagcctttatctctccttcttttcccaggactttgtaaattacccgtgttttctctagcttgtgcagcttgcaaggttaccttagacagattaaacttcaagttcgataaaacattgattttccctttgnaaaagtta

SEQ ID NO: 663917 - DNA, 358 bp, Homo sapiens
  misc_feature (29)..(29): n is a, c, g, or t
  misc_feature (31)..(32): n is a, c, g, or t
ctgctcccaggcaaaaaatctctacctgnanncctcgtccccttcatggggccactggccaccttctagcactgccttcagggtcaccagcacctccaggcgcaaacccaatggttgactcaggccctgcgggactctcatcagaagctcaccagaatctgtgatgatcgattcacagaggagctggcacctctgagtctagtacacaggaatgcagataagcttcagctgctgatcctccaacagcatcctgctaaattcttgtcacctctaataatttgtgggaatgtgttgggattttatatacacaattttattaagtgaagaccaaaaacctttggtttcttccattctttgt

SEQ ID NO: 663918 - DNA, 105 bp, Homo sapiens
ctcaccgcgtctcttccctctccccaaagcctggatcagcgcccagcgtcaggcgatggggcgacgtctcgaggtaaaacggaggaggtgcgggacgcggagact

SEQ ID NO: 663919 - DNA, 122 bp, Homo sapiens
  misc_feature (70)..(70): n is a, c, g, or t
  misc_feature (102)..(102): n is a, c, g, or t
tccaaattcaagaagaaaagaaaacagattacctgaatttcatgggaaaaggtggatcacctcccccttnttttcccacctttcaagcctttcctgtcaccngatagccagctgaaccaccg

SEQ ID NO: 663920 - DNA, 472 bp, Homo sapiens
catctgtcaccctctggattatccagtcatcatgaacccatgtttctgtggcttcctagttttgttgtctttttttctcagtcttttagactcccagctgcacaattggattgccttacaaattacctgcttcaaggatgtggaaattcccaatttcttctgtgacccttctcaacaccccacccttgcctgttgtgacaccttcaccaatgacatagtcatgtatttccttgctgccatatttggttttcttcccatttcggggaccttttcatcttactataaaattgtttcctccattctgagggtttcatcatcaagtgggaagtataaagccttctccacctgtggctctcacctgtcagttgtttgcttattttatggaacaggctttggaggggacctcagttcagacatgtcctcttatcccagaaaaggtgcagtggcctcagtgatgtacacggtggttact

SEQ ID NO: 663921 - DNA, 1145 bp, Homo sapiens
  misc_feature (1)..(1): n is a, c, g, or t
  misc_feature (3)..(3): n is a, c, g, or t
  misc_feature (159)..(159): n is a, c, g, or t
  misc_feature (254)..(254): n is a, c, g, or t
  misc_feature (345)..(345): n is a, c, g, or t
  misc_feature (356)..(356): n is a, c, g, or t
  misc_feature (375)..(376): n is a, c, g, or t
  misc_feature (482)..(482): n is a, c, g, or t
  misc_feature (488)..(488): n is a, c, g, or t
  misc_feature (491)..(491): n is a, c, g, or t
  misc_feature (580)..(580): n is a, c, g, or t
  misc_feature (789)..(789): n is a, c, g, or t
ncnaagttaacatcatagctagtaaacagaagtatgtagctacatcaccatcgtaaattggctttaatttagtaatgtgtgtgtcttgttgtgtgtgcatttactactcttaccagcagagagatagcggatataattgtaagcgtaacaccttgcccnatttgggaccgactgcccccttctcgggcttaccctccccccgattttttttaaccacactctactatggcggcgttcttccgctcactcgttcntgccgggcctgccataattctatttgttgtaagagtactctgctccgcccataacctcctttgctgtagcacaccactcttataacagagngtttctccctncctgctctcgggctctccnngacataaatttcctcgccgctgggactgttctgcctctcttttcttcgtcccggcggggggatttcctccgcgcgccgctggatcttggttttgcacgcgttctanccagcncanatggtggcccttaggatgcttcctattatcagggcctttgcctcttcacacgagagggttacccaccaagtcgcctgtcttggcgcatnaaaagagtagtaacctcacctcgcccctctcctcgtgtaagagcggtatacatagctgaaaccacactatcaactagagttaccgcccttctgtggccaagcagcttcccagaagtctgtttacttctattgcgagatggtaaaatgtctccaccggtcgtggtccaaagactccccgccgggttttctaccaccaaggcgctcagcgnccaagcggcttctttgcactaagcggtgctgcacaacgacacgcttctggtcccaccccataccgcgtggggaacacgccgcacagatcctcccaacgggcggttctatcattatatgacataccaccaccacctcagttagttccaaccacctcctcctcggacatttcaattttatgtgtttttccacccacgaaaccgcctctatgcatcagagatccaccataaattctactatgacttagcccacaataaattcatactaacccattggctttttttaagcgagacccccccgaatcccctttttcgggccccattttacaaaaaaatttcattaagcgggccacaaaaca

SEQ ID NO: 663922 - DNA, 172 bp, Homo sapiens
tacagtatgatagtctttaagaactcagctccttacattggctttggtagggggacgtggggcaacacccgaagagtataaatcggggtgggggtgttcggtccttgcagggcttcacgagatcgattcctgactactttgctgtgaattgcacaactcacacagtaatgta

SEQ ID NO: 663923 - DNA, 123 bp, Homo sapiens
accggcacgcttcaccgccaggccgatcgcagcgcgcggctgcgctgcacggtcacggcggaggcatcggtgaagccggccaggatgtcggcacgatcacgtcgccatcttcgccacgcgggt

SEQ ID NO: 663924 - DNA, 742 bp, Homo sapiens
ggagggacaggcttgccatgcttcctcctcctcggcctcaccattccatgaaccaaaattgaaaaaatggttgacctcactccaggtacgtggactgagtgaaggttctttcactggcttgatgcaatcctatgcaaccaattagttcttgcagaaaacatgatgcttatgagtccgggcacagctgcacttctatagatggacaagacaggtctgtctgccaatccagacgactgtgtagcactttggcaaaggagagaatgccacaagaagtactcttcgaacagatgacgtgcagtagaacgtgtactgcagagcccagtctggaatgatccttgaaaatattaccttccatgttgcttggaagtaggcgtccgtgtatttgccttgagttggtcccagacccacgtctacgagtcggatccgtgcacttcagactatccgtgggagcgcgggatctacccacaacattgcatatttgacacccccttccccccatcgccagacatcaggacgctgttgagtattttcgcgcgttgcgactattggacgttgcttcatttccaatggcgttcacacggataggctgtaacgtcaacttgtacccatggtacggaaaactcatacaactcagcatccagtaggcttacaacgcaatcatgtcctcccaacctctcctgatgctgcctaaatacacgcaggcgggcccactgactactgactgccctaaccctgtggatat

SEQ ID NO: 663925 - DNA, 880 bp, Homo sapiens
tcagggtttcatcttttaaataagctctgtgaaagacatcctaagcactgtatgagacacaacagaatattttttcttccagtattaaaaaaaaagacatttgcaaacatttaaaagccaactcttctatataatcagttgtgatgatctgaattagaaaataccccgtggataatcatgtcctgtaatacacattttccttttttttggaaagtggagatctcgcgtggtggcccaggcgtggagttacaggtggcgcgaatctttagcctcacgtgcaaccttccggcctcccgggtttcaagcgaaattctccgtggcctcaggcctccacaagttcacgtgggaattacagggcgttaacaccacaccagtgtccaggctctaaatttttataagtgtgttaagttacccagaagtggggggttttacacccaggtggtggggcaccagggcgtggcctgtgaaatgcacaaatattcttatatataggtataccattgtggggaaaacagtgtgccctctcctataaaccccagccaataataaaaaccacgtgtgggataccaagggttattattaacaaatgtggtccccgtgagagcaataatcacgcgattataaagtgtttattgcgaaaaggactccaagacttcgtgggccgcaaaaaacctttgtggccacaagagaaaacccaaatttatatttggggcaataagagctcttcccaaatgataaaacaccctttaaaggaaagagccctcaagagagctttaaagacaaaaaaccggtgggcattaaacagaggagcaagacaagatttaattcttccagggatgtctgcataccgacaacacggggtcccccatataaactcggg

SEQ ID NO: 663926 - DNA, 229 bp, Homo sapiens
ttatacggggtggattacagcggatactcgcgcatgcactgtggctcctacacttgtgacatgcagattgtctggagttgttacttgaacacaggccgttttcgtacctggaaaggataccccttacactacctattgcacttgttgcacgtgatataataaccaacgacagcaacacagcagatagctactgggcagctctgggtgctccagacttgtgaacacgccg

SEQ ID NO: 663927 - DNA, 201 bp, Homo sapiens
ttctactgcaactaaatgctggacaggatgtggggcacaggaattcttaatcactgctggcaggaacgcataatggtatagccactttggaagacagcttggtgacttcttacaaaatcaaacatactcttaagacatgatccagcaatcctgttccccctcagcatcctgatttaattttcctgttgcagtgtgcttccg

SEQ ID NO: 663928 - DNA, 204 bp, Homo sapiens
tactgagactccgtctatcttacacttctgtgatctgtatattcaaataaaattagtaaacaaacaaataatcaataaacaacatggcactgagatagtaaactcgtaaccctttttgttatggttaaattattggtcatattcaggaaaattgttaaaaacttggcaatagggcaaatgaatagctgcatattcgcacgttga

SEQ ID NO: 663929 - DNA, 170 bp, Homo sapiens
accgcataccggtacctttgcacggtcagaataccgcggcgttaaactggtgtcactgggcaggcatgcctctaatactagtaatgctagaggtgatgtttttggtagccaggcgggttttgtgttcgccgatttcctttcacttcttatagtctagccttggggcaggc

SEQ ID NO: 663930 - DNA, 145 bp, Homo sapiens
  misc_feature (82)..(83): n is a, c, g, or t
  misc_feature (105)..(105): n is a, c, g, or t
  misc_feature (145)..(145): n is a, c, g, or t
gaatgatagaacagcagaagcgtaagggcccagagttgccgctggttacagacaagcgcacgacatgagttgctgtttggcnnggggtcttcgcccatgaggccnggtcagcaacaggcgcacggcagggaggcctttcttcaan

SEQ ID NO: 663931 - DNA, 849 bp, Homo sapiens
ggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggccaggagaatcacttgaacccgggaggcggaggttgcagtgagccgagattgcaccattgcactccagtctgggcaacagagtgagattccgtctcaaaaaaaaaaggaaacggcaaaaaaaattagcattatacctcttccttgttcaaccgccatgaaaaattctgaacactccaaattcagtgtgaataatccaaaacaaaatttataagtttcaaataatttcattcttataagtaatagtatacctttaaaaagcctcagggtatattatcttctaaacagtacaattcagtgcagtaacttaaccaatatgttctctaagtagaagaacaactaggctattcactgtgtgtggcctcagggctaaaatgggtgccacattaatatttccggtgcaattaacttgattgtaaacaccattcgtttggttacccatggccaaaatttcaaaggacgtattagtaattcctggaattatattattggaatcccagcatgcggcggggggacagacactggttcattataactcaataggtggggttcacacacctcctttaagtattttcaacatggttccaggttctttgctcacagcaatgtcccatggtttcaccattgaattggtgggggaggaaatgggggggcgacacacaagactacag

SEQ ID NO: 663932 - DNA, 520 bp, Homo sapiens
tttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttaggtaacctcggctacagcagtaagccttcctggttgggcatcaagagtaaagcaggtagcacccgttcctgatcacggcgcgccaatgtcttgttctctcaatatacataccggtaccgtcacttggtcccccctctcaaggtgctcagacatagaatgtgcatggcgtaccgcacccagacggacttcagcccgttacctatgttgtccctttttctcttatcaattatgttaggtgttcactttgactatgtcctctctgcgaaaatgtacaataaagggtctgtgctttacaaaaa

SEQ ID NO: 663933 - DNA, 399 bp, Homo sapiens
gaaagagaatgtgcactgcgggtgggtctctaaactggcccacctgggggcgtggttgtctcttatggtagagtctgcagagatgaaataaactccagtctcctataaactcccaggcttattaggaagaggaaattcccacctaataaattttggtcagaccggttgatccctgtcttctgataagatgttatcaatgacattggtgcccgaaacttcattagcaattttaatttcgcctcagtcctgtggtcctgtgatctcgccctgcctccactggccttgtgatattctattaccctgttaagtacttgatgtctgtcacccacacctattcacacactcagggatccttccaatgtgctgcccccctcttaatactcaccaataaattctact

SEQ ID NO: 663934 - DNA, 133 bp, Homo sapiens
gactaaggacccgcgtggttcttgcagaacttctgaaagagtctcaggacccccttaagggtcctgaaccacactttgagaatcgcttgaatctgggaggaggaggttgcagtgagccgagactgcaccattg

SEQ ID NO: 663935 - DNA, 576 bp, Homo sapiens
  misc_feature (32)..(32): n is a, c, g, or t
  misc_feature (127)..(127): n is a, c, g, or t
  misc_feature (144)..(144): n is a, c, g, or t
  misc_feature (165)..(165): n is a, c, g, or t
  misc_feature (180)..(180): n is a, c, g, or t
  misc_feature (182)..(182): n is a, c, g, or t
  misc_feature (269)..(269): n is a, c, g, or t
  misc_feature (282)..(282): n is a, c, g, or t
  misc_feature (302)..(302): n is a, c, g, or t
  misc_feature (343)..(343): n is a, c, g, or t
  misc_feature (348)..(348): n is a, c, g, or t
  misc_feature (360)..(360): n is a, c, g, or t
  misc_feature (385)..(385): n is a, c, g, or t
  misc_feature (387)..(387): n is a, c, g, or t
  misc_feature (390)..(390): n is a, c, g, or t
  misc_feature (395)..(396): n is a, c, g, or t
  misc_feature (411)..(411): n is a, c, g, or t
  misc_feature (431)..(431): n is a, c, g, or t
  misc_feature (444)..(444): n is a, c, g, or t
  misc_feature (449)..(449): n is a, c, g, or t
  misc_feature (470)..(471): n is a, c, g, or t
  misc_feature (486)..(487): n is a, c, g, or t
  misc_feature (495)..(495): n is a, c, g, or t
  misc_feature (506)..(506): n is a, c, g, or t
  misc_feature (510)..(510): n is a, c, g, or t
  misc_feature (573)..(573): n is a, c, g, or t
gagactcaaaaaaggggctgggggaagggtgnagcaacgatttctcacctaaatcattacacagtggcagcaaaggggtgagaaggggctgagggaggtaatagccaggtaacttgagatctgcagnggtgagccaagcatcanaaaacaggatgatgctgaagntgcgatgaccagtcntnattttcttaagagaacattcaaggatttgtcatggtggctgggctttcactgggtgttatgtctacaaacagcactcttcaattganactgtcaattatngttcttaagatttatggaantggtggagcttggaaagttatgagattacaaaattcctganagtcnatttgaaaaacntcaggatggtagagtggatgggtcncnggnggggnntcagaggtccctgcngtttcttgggtcagataccnggggggtccagcnttgcnggggagcatgattttctttcnnaggctgagggtttgnngggggggngggtggggatngtgnagtccaatggctctccccttccccacctcagttttaggtagggtttttaatttaactcttagncat

SEQ ID NO: 663936 - DNA, 260 bp, Homo sapiens
tagacgtacggaggctcgtacgggcgcccagaaacagtgttgatgagctaggactgggagcagcgacaagcagcagtcgtggtgagataggaaagagtcaggagcagtgcgattggtgaggaagctaggagaggaaggagcgctacgattggtggtgagctaggaaaagggatcaggaagagcgagtgcaattggtgatgaaggtgcaggcggcttgcttggcaaccacacggaggaggcgagccaggcgctgttacgga

SEQ ID NO: 663937 - DNA, 1158 bp, Homo sapiens
gctatatatcagtatactagcttgctgtcggcaccgactgcgttacccggaaccgccgggccgaacagcatgacgtccgcttatggagaactacatcaaccgaactgtagaccgataattacatcagatggcagaatgattgtgggaacactgaaaggttttgaccagaccattacttagatataggatgaaagccatgaacgagtatacagctcttcacagggaggtagaacaagtggtactaggattatacatagtacgcaggtgacaacgtagcaagtcattggacgaacatcgatgaagaaacagaattctgcgcttgattaggacggaatatacgagcagaacctttaaaattctgtagcacacacatgaggcacaacaactaccatactttggacatctgctaacatccttagatacagaaaactggattattactgcaggaatgataatatggagatatttatgacctgtgtcacatggatacatgacctccctttactggagtccagtcgctacactaatgtagcatttaagaaataaatcctacaatttcgaattgcacaccaacaacacacccttcaagaataacagcactcaacattataacgttagggacagcctgggacaacatataaaaaattacacacacaaatgtgaaaaccaaaccactgggcaaaaacagggagacaagtactcacaacaaacacagaataacaacatataaggaacacgaaacgaacaaaagagaacacacacaggcaccaacagacaaacatactgacccaacactacatcacgagaatacacacataacacaacaccacgcacaacgaggaacacagacacgacagcaacgcaacacacaaagaccagaaccaacatacacgagcagacaaaaataacataaaacataatcaagaccaaaaggagagaacagtaggcaacagcgacaaaaacatgcccacaaactaagaggcgtgaccctgcaaagaaggatagagaaaacacaacaagcaacaacaagcaagaccacaaaacgggctacaaacaaagtcacaacaaagagcagtaaactcgaaaatgacagcagaccaggtgaacaacagaacaaaagctacgaccaatccgacacatgctccgcgttcgcgtaca

SEQ ID NO: 663938 - DNA, 949 bp, Homo sapiens
  misc_feature (8)..(8): n is a, c, g, or t
  misc_feature (87)..(87): n is a, c, g, or t
  misc_feature (93)..(94): n is a, c, g, or t
  misc_feature (102)..(102): n is a, c, g, or t
  misc_feature (110)..(110): n is a, c, g, or t
  misc_feature (164)..(164): n is a, c, g, or t
  misc_feature (169)..(169): n is a, c, g, or t
  misc_feature (173)..(174): n is a, c, g, or t
  misc_feature (191)..(191): n is a, c, g, or t
  misc_feature (194)..(194): n is a, c, g, or t
  misc_feature (213)..(215): n is a, c, g, or t
  misc_feature (218)..(219): n is a, c, g, or t
  misc_feature (223)..(223): n is a, c, g, or t
  misc_feature (233)..(233): n is a, c, g, or t
  misc_feature (239)..(239): n is a, c, g, or t
  misc_feature (242)..(242): n is a, c, g, or t
  misc_feature (245)..(245): n is a, c, g, or t
  misc_feature (251)..(251): n is a, c, g, or t
  misc_feature (265)..(265): n is a, c, g, or t
  misc_feature (276)..(276): n is a, c, g, or t
  misc_feature (283)..(283): n is a, c, g, or t
  misc_feature (286)..(286): n is a, c, g, or t
  misc_feature (295)..(295): n is a, c, g, or t
  misc_feature (302)..(302): n is a, c, g, or t
  misc_feature (306)..(306): n is a, c, g, or t
  misc_feature (308)..(309): n is a, c, g, or t
  misc_feature (343)..(344): n is a, c, g, or t
  misc_feature (346)..(346): n is a, c, g, or t
  misc_feature (348)..(349): n is a, c, g, or t
  misc_feature (379)..(379): n is a, c, g, or t
  misc_feature (384)..(384): n is a, c, g, or t
  misc_feature (435)..(435): n is a, c, g, or t
  misc_feature (441)..(441): n is a, c, g, or t
  misc_feature (454)..(454): n is a, c, g, or t
  misc_feature (459)..(459): n is a, c, g, or t
  misc_feature (473)..(473): n is a, c, g, or t
  misc_feature (488)..(488): n is a, c, g, or t
  misc_feature (490)..(490): n is a, c, g, or t
  misc_feature (496)..(496): n is a, c, g, or t
  misc_feature (505)..(505): n is a, c, g, or t
  misc_feature (538)..(538): n is a, c, g, or t
  misc_feature (559)..(559): n is a, c, g, or t
  misc_feature (564)..(564): n is a, c, g, or t
  misc_feature (578)..(578): n is a, c, g, or t
  misc_feature (581)..(581): n is a, c, g, or t
  misc_feature (894)..(894): n is a, c, g, or t
  misc_feature (948)..(948): n is a, c, g, or t
tgcaaagngagggattgttctcagccaacatttaccagtgattccgacacacgcaaaaacactcccaatcacggtgctttatacttncttttnntttctgcnctgaaaangaaaaggaaggtaaaaacaatgacagattagtttacagtgacttcatctttgtncttanattnncctttgctcttgagagntgntgtgggaaagacaggggannntcnntgcntgatggtgancggtgnccnggncacctnggtctggctaacangggttctaagngcttggncanggtgccgtnaacgcantagntnntaaacactgacaggcaacagttaagatacattannanannagggaagatacccacaattccattcttaanatcangcacaaaatctgacaatgaaacatatccaggggttgtgtgtccccatctgntctggnggtggcgctctgnaggcngccacaaggtgtgngtcacacactagggngncagacntctgttcancacagaattccggctttgctgaactgcaatgcntattccctcttctcactagtncaganatgttctgcaggcnggnacatgagccccccggctcattcacctgtacaacctcccctgacagatagtgagagccgcggcggggccaggggctctgtgtgctttggaggctactgcctctggaatgtttcgcattctcaaggtttggttgggctgtgggttttagttatgctccacacattgtttaggtgctcgctttatttttcatgtgcaactgttactgtctaaagctttcagaagaacgtgtacagacaccctgcagagacgagggtcatgactgggccctcctgcctcttgtggtggggtgggggcatgggggcgcgtcacagaantagagaaatgacatgttccgctgcagttaaactctagtccctgattcggtcctnc

SEQ ID NO: 663939 - DNA, 841 bp, Homo sapiens
ggttaatccgagaacggtggaggacgaccttgtgccggtggacacggtatcatgctggacacagtgcctctccctttcagtattggactccacaggttcttgaggagaaaaactggaacagcatctgtaacacaaagttacaattacacttgatgagaatgatgtctccaagacctttacagatataacacgatcctcctatagccagctactgattccaaataagtagaacgagccatgaagatcgaccacttatcaatagaaaaactcctgatggacagtgtccatgcaagagctcatcagaagctccaagaactgacggccattcttagaggcttcaatgccaatgaaaactcttccatagagactgcactacccagctacttgtgtacccatcttggagccctgtggtaattcagagtgtctgcacactctcgtcagatattacattctggcactgtcctcaatagatagctttatggactatgaccaggccactactggatgacatggagcaagtctgtgactgaatgctactgcacacgacatcataaccctaggattcagccacactctcaagttaaggataggacaaacagcgtagcaagacagatctataaaaacatctgacctacgatcagcaagtgaacacaatcgcacactaaaccaattactcacactcatactatatgagaaacccaacgaacagaactacaccggacataaaaataacccgactaccacaacacaaacatagatgaggagatgacggaggaacccaaaaacaccacaaaacggacgcacaaaaacacacaaagcaagaaatgatacgaacggaaca

SEQ ID NO: 663940 - DNA, 312 bp, Homo sapiens
tcattgattcattcatttatttgagacgaattctcgctctgtagcccaggctggagtgcagtggcatgatttcagctcactgcaaccttcacctcccagattcaaggaactctcctgcctcagccttccgagtagctgggattacaagtgtgtgccaccaggcctggctaatttttgtatttttagtagagacggggtttcaccatgttggccatgttttgttttctttttcacagtgttgcaggatctttgtgtacttaagtgtttttagaagatgaagttctagaagtggaattgctagtgcccaagagt

SEQ ID NO: 663941 - DNA, 251 bp, Homo sapiens
tggtggtcagtgaaggtgtgagacctggcctccctgctggaggaggaggattactactacctggtggtcagtgaaggtgtgagacctggcctccctgctggaggaggaggattactacctggtggtcagtgaaggtgtgagacctggcctccctgctggaggaggaggaggataactacctggtggtcagtgaaggtgtgagacatggcctccctgctggaggaggaggaggataactacctggtcgacgc

SEQ ID NO: 663942 - DNA, 883 bp, Homo sapiens
ggctcagcattgtggggacgctctcagttctcggccgcaaggccccagttccttcaaaatgtctaggtgtccggaaatcctgtgcaagctcagcttgcagcggttgatcactctacaccccacaggtgcatatgggtctgtcaacagcctatacttaactttgattgcctgaagggggcatgctttggacacatttgaacagcagccattcatgaccaacgggtgttgtggctgcacggtccacccattgtccaccatttggacccaacccgcagtgattgcacgagagaccgggattatggccttcgccctaacccagagaagggcccaaacaagggaactttgcattcaacgcccttgacggtcaagccctttatctggccactctgggagacgggtgacttatcgggccctaattggaagcaccaccctgcttcaagttagtgaacgggcttcctggagccaaaaaaggctttcccatgaagcgggtgctttggaaaccgggaggaggacctctcctcagtgggaggatccatcgtggtccccagaacgcaaagcaggaagctgcaggcaaatttaacatggagtctaacaagggaagtggtacaaagattggattctgggaagaagggaacaatatttgggacaacattctgtggatttcccgaaagctggatgggttgcctttgacaagggggtgcagaagagcagagggattgggtctggcattggttatgagctgtttgcgcaagatgggcgggagtcttataaaggctggagtgaagagggagggaattggtgtcccagtggttaggatattgtcgagttgatgtggccacttcagaaggagtggagggaagaagtagcttatgattgggaaatg

SEQ ID NO: 663943 - DNA, 912 bp, Homo sapiens
tgagaagatgtcttgagcctgggaggtagaggctgcagtgagctatggttgcaccattgtactccagcctttgtgacagagcaagatcctagaaagaaagaaagaaagaaagaaagaaagaaagaaagagagagagagagagagagagagagagagagagagaaagaaaagaaaagaaaagaaaagaaagaaaagaaaagaaaagaaaagaaaagaaaagaaaagaaaaaaagaaaagaaggaaagaaagaaagaaaagggtgttggactttgttcttgggatcagcttgaacctttcaagacctgtgctgaagcttatgtggggcaaatctagagtactcgctactccagggctagttcatccctactataaggtgtgatcttctgtcatctggttgaatgccatggaggtctcttcactctggctggtcagaagctggacctcttctggccttctgtgagccctgaccattgttcagcttggagcccccagtcatatttgatcagtcttgtggaatgtccccatatatgtgtttagcttagtgttcagccatggattcaaggaggacctgggccgatttctggagccctttctctacataactctctcttctctggcactctgcactctgaattgcagccacctcagcctccccaaactctactcgctgtgtcctcaactcagagacacatcatgctgtgctttggttcccctccctgctctgccgtcttggaagtttctccaggcagagggccaaggtgattggaagtctctcctggtttcttttccttctctctggaatcatggtcctgtgctgctcatctgaacactggtttttaagtagatgtgtagattgggatggagccgttttctttgattttgatagcagaacggcaagcacagttccaatt

SEQ ID NO: 663944 - DNA, 644 bp, Homo sapiens
  misc_feature (6)..(6): n is a, c, g, or t
  misc_feature (86)..(86): n is a, c, g, or t
  misc_feature (101)..(101): n is a, c, g, or t
  misc_feature (147)..(147): n is a, c, g, or t
  misc_feature (198)..(198): n is a, c, g, or t
  misc_feature (259)..(259): n is a, c, g, or t
  misc_feature (271)..(271): n is a, c, g, or t
  misc_feature (277)..(277): n is a, c, g, or t
  misc_feature (279)..(279): n is a, c, g, or t
  misc_feature (313)..(313): n is a, c, g, or t
  misc_feature (327)..(327): n is a, c, g, or t
  misc_feature (336)..(336): n is a, c, g, or t
  misc_feature (361)..(361): n is a, c, g, or t
  misc_feature (368)..(368): n is a, c, g, or t
  misc_feature (370)..(370): n is a, c, g, or t
  misc_feature (382)..(382): n is a, c, g, or t
  misc_feature (385)..(385): n is a, c, g, or t
  misc_feature (415)..(415): n is a, c, g, or t
  misc_feature (435)..(435): n is a, c, g, or t
  misc_feature (439)..(439): n is a, c, g, or t
  misc_feature (441)..(441): n is a, c, g, or t
  misc_feature (447)..(447): n is a, c, g, or t
  misc_feature (456)..(456): n is a, c, g, or t
  misc_feature (490)..(490): n is a, c, g, or t
  misc_feature (507)..(507): n is a, c, g, or t
  misc_feature (642)..(642): n is a, c, g, or t
ggggcngggggcttctgcccagggctcccctggaccaggacgccaggtagggcagggaacctcagttgttctccacccagccattntcagatatgaatgcnttaattacctccttcatagccaagttggggatgagctgttcctggnttttggggctccgggtcacggggtcaaaatgacccacacgctgcaggtgcncctcgatgttcttgcggtcgtaggtaaagccacttggcgtaaagaacggctcccgcatcancacaaagctgancttgcnanaaaggtagttggggatgtttcgcttcttcctctnctcaaccacctaanaaaaaagcncgtccatgtacgccaagaacttgtngtgcttngnctcaatgcaggnctncagggcccggacgtggcttttgtactcatnaccctcgtggtttcgctggnactntnccagcnccctctaangctccgcggcaataagcctggagaggaaggagtncagcacgctctactggnggatgcgccgctcctcaatgctgttccagcgcttcttcttcgcgatttgaagagcgctggggatgttgttcccgaagttcagccgctgctccttggccaggctgttagctcgctgcagaatggcgaaggcctcanca

SEQ ID NO: 663945 - DNA, 769 bp, Homo sapiens
cgatggtggcctccctgtagaaatttttacagtttctcgggggtgtggtgcccccggtggttcgctgccccccctctaaggttggggggggccgcccccaaattttttattctcgaggcgtcggtagtgctccctccgaggtatccctgctttgccccccagaggtgggccagaagtgagcatccataaagtagcccgcattctcccccctcggggaagtattttctccgcctcccccggggtatgcacacggggggggggagatgttaaatatcgccggcgttatccacttcttcttcctccctacatctcccgggcgttgtgtttcctcctcaccacacgagaagagaaatatattaaactctctccacgcaacatagatagagagagtggagccaacacaatggtcggggtgggagtagaggaacacacataaagaggctcttgttttttgcccctactgaccacaacaaattattagtactatttcccgactattatataccacacccacggggtgttttaataattttttataccaaaaaagatcttttctttttggtgaaaaaccacaccgttttttataaaaaaccctcgctgttttttaacaaaacccctctctataaaggttttttaatagtttttacaatatctgtcttccaaggggggttttttaaaattttttttttttttttaaaaaaaggagttcccccgatggtttttttccaaaaatccccccccccccccccccctttttaaaagggtttta

SEQ ID NO: 663946 - DNA, 218 bp, Homo sapiens
acctgtattggctgggactacaggcgcccaccagcacacccggctaatgtttgtactttttaatagagacagggttttactgtgttggccaggctggtcttgaactcctgacctcgtgatccacctgcctcggcttcccaaagtgctgggattacaggcctgagccaacacgcccggcctctaatttttttcatgcttttggttctttaacataagca

SEQ ID NO: 663947 - DNA, 451 bp, Homo sapiens
ggcgggcccggtggctcacgcctgtaatcccagctctcaggaaggctaaagaggcggagaggaatagctgtgagccccaggggaagtccgagacctgtgcctgtgggcaatatagcggaagaacccccgggtttcttcccgggaaaaaaagcgaaaccacaaacacacaccaagaataacaaactaaactccaaagacaagaccacacgcattgcgggttggtcgtcaggagacgggggcctatttgggggccccttctggggaaaacaagggtttactctagagaacccacatctccgggtagggagagaacacgaggggggggagacccaacgagagagagaacagagggagagaaaaaacacaggcgcggagacaaccaccagggggtgaggacagcacaaagaacatagacaggcgcggggagagacccacacccgagagagggaac

SEQ ID NO: 663948 - DNA, 1522 bp, Homo sapiens
  misc_feature (537)..(537): n is a, c, g, or t
  misc_feature (735)..(735): n is a, c, g, or t
gcttagccaaaccatttacccaaataaagtataggcgatagaaattggaaagcctggtcgcaactagatatagtaccgcaagggaatagatgaacaagattataacctaagtcataatatagcaaggacgtaaccccatataccgttctgacataatgagattagaactagacagagtaactttgcaaggagagcctgaaagcttaagcacccccgtaaatccagcacgaggctaccgtaagaacagtctatgaatgagtcatcaggccagtctatgataggcgaaatatagctggggaagcattgtatagtgtagcagggcgtagcaagatcctaccgaagactcgtgggtagattatggcgtaggattagtgccagatgactaggaaaatacgttaaggatgtcagagcatatgtcaaatatggtgactcccaccaaagataagccccttcattaaaatgcacccgtatgggtagagatatttgaaagcgtgggattggaagtacccagagagcagggggaacctatgccttctntcgtgcgaatcgaactcatgaggcaaaacatattacccttttgctaaaggcacgaaggaaggttaacacacagagtttgttagaggccactcaccaataaggtaagggcgctcaaagatatggccgaagctcaaacgctaagatctcagatggagaaaggcggtgatccagaggcctgcaaacgaacccccaacatancccgtaagaaaacataatccgcagaaacagtatttaaatgctttgaagactcccttcacaactccacatatttgggaacccaaagtactgattcacgcccttattaggaacagaaacttaaagtgtggttaaggtaataaacgctaaaccatttgaaaaaacattgcgtcctaccggcgattaaaagccgtgccgttcaagaatttaaaagacgactggaaacttgggcgaagttaaagcaggccccaagtattctacgcgaatcaaagacagacaaggtccatgtatatacgcctcagacttgtgcagacccaaagcaacaggggcgatggcgttcaattagagggaacggttcacaacagcacgttacaaggggaacgtctggggaaaatgtgtaacccccgacctggggttaccacagagaaagattcaagcctcctaaggagattcagccaacgatgatatagagaggaccgccggcgccgggcccacagtgcacagacaagggtttaacgcggccggagcgaacccctaaacacacgggcacaaggggtgcagatcaacgccactggtgcccctatagaaggggacccgccgtatgagtagtcggcccccccaagggggaaccgaggaccgatatgaagaacaacgggaaaaggtaggcgcccggaaagaagagggcgacacaaccggaggagaagcgggggttcgcgattaaagacaagaaaagcaacgacaccagcgagaatacacgaaaaagagaaggggggagacgaaccagacactg

SEQ ID NO: 663949 - DNA, 570 bp, Homo sapiens
caaggttactttgtatcgatatgacctccaaatgaaccacctgttccgactcagaagaggaagcccatccgagtgctgtctctctttgatggaatctctacagggctcctggtgctgaaggacttggggcttcaggtggaccgctacattgcctcggaggtgtgtgaggactccatcacggtgggcatggtgcggcaccaaggcaagatcatgtacgtcggggacgtccgcagcgtcacacagaatcatatccaggagtggggcccattcgatctggtgattgggggcagtccctgtaatgacctctccatcgtcaaccctgctcgcaagggcctctacgagggcacttggcggctcttcaaagagttctaccgcctccttgcttatgcgcggcccaaggagggagattatcgccccttcttctggctctttaaaaatgtggtggccatggacgttagtgaaaagagggacatcacgcgatttctcgagtccaaccctatgatgattgatgccaaagaagtgtcagctgcacacagggcccgctacttatagggtaaccttcccggtatg

SEQ ID NO: 663950 - DNA, 637 bp, Homo sapiens
  misc_feature (83)..(83): n is a, c, g, or t
  misc_feature (105)..(106): n is a, c, g, or t
agggtgccccccatcccccttcccgaatgcataattccccaacccagaacctgcctgtcccccactgtcctccacacaacgcncactccccacctcgtacctcanntccccggcttcagtcaatgactctcgaggtccacgcaccacagaaccgtcgacgaagagcatgatggaggtggaacggaagctggcccaccgcaagaccagcaagttccccgagaacccccgaggcttccctgaaccccagtgaccacaagctggatgagaagctgtgccagaggctcacacagcgctatgtgagcgtcatgaacaggctgcagagtctgggctacaacgggcgggtgcaccctgcgctgaccgagcagctggtgaacgcttatggcatcctgcgagagcgcccggagctggcggcgtctgagggcggcccctacaccgtggacttcctgcagcgtgtggtggtggagaccgtgcaccccggcatgctcgccgacgcgctgctgctgctctcctgcctcagccagctggcgcacgatgacggcaagcccatgttcatctggtgacgctggagctgggaggtccaggctcgctcagccccacagccctgtgcacggccattaaagcttcccacagacactga

SEQ ID NO: 663951 - DNA, 96 bp, Homo sapiens
gaaccgccatcttccagtaattcgccaaaatgacgaacacaaagcgaaagaggagaggacacccgatatatgttctctaggccttttaggaaacat

SEQ ID NO: 663952 - DNA, 354 bp, Homo sapiens
ctgtttagagtttctatatcttcctggtcaccaaaaacagcatgatactggtataaagaatagacacattagaccaatgaaacagaaatagagaaacctagaaataaagccaaatacttagagtcaactgattcttcaacaaagcaaacaaaaacataaagtgggtaaaggacaccttactcaacaaatggtgctggagtaattggcaagccacatgtagaagaattaaactagatcttcatctcccaccttatacaaaaatcaactcaagatggatcaaatacttaaatctaagagctgaaaccatgaaaattttagaagataacatcagaaaagcccttctgtcgtcttctc

SEQ ID NO: 663953 - DNA, 776 bp, Homo sapiens
  misc_feature (83)..(83): n is a, c, g, or t
  misc_feature (105)..(106): n is a, c, g, or t
agggtgccccccatcccccttcccgaatgcataattccccaacccagaacctgcctgtcccccactgtcctccacacaacgcncactccccacctcgtacctcanntccccggcttcagtcaatgactctcgaggtccacgcaccacagaaccgtcgacgaagagcatgatggaggtggaacggaagctggcccaccgcaagaccagcaagttccccgagaacccccgagagtcgaagcagctggcctgggagaggctggtgggtgagattgccttccagctggaccgcagatcctgtccagcatcttcccagagcgcgtacggctctacggcttcactgtctccaacatcccagagaagatcatccaggcttccctgaaccccagtgaccacaagctggatgagaagctgtgccagaggctcacacagcgctatgtgagcgtcatgaacaggctgcagagtctgggctacaacgggcgggtgcaccctgcgctgaccgagcagctggtgaacgcttatggcatcctgcgagagcgcccggagctggcggcgtctgagggcggcccctacaccgtggacttcctgcagcgtgtggtggtggagaccgtgcaccccggcatgctcgccgacgcgctgctgctgctctcctgcctcagccagctggcgcacgatgacggcaagcccatgttcatctggtgacgctggagctgggaggtccaggctcgctcagccccacagccctgtgcacggccattaaagcttcccacagacactga

SEQ ID NO: 663954 - DNA, 115 bp, Homo sapiens
actgtgagttgtatagtcgatggttgccttgtctcggtaatagctgtcgacccaatcctggcggctccgagcagaaagagccatggtcgtattggctttggatctgtgcataaac

SEQ ID NO: 663955 - DNA, 728 bp, Homo sapiens
atgagtgtttaggtgattgtgcatggcctttcagttctggctcataccgtgtgtcagcatcgcagtattcattactggggtgataccctatgaagtgtaacaaattgtgggaaagccgtttactgtatatggacaacttattggacatcacgagttgttcacactgggtgagatataccttttgaatgtataggtgatatgtgggtaaggcgcttgtagtatgcttgaattgcattgcgcttagtctgtaacactgcagtcggggtaacacatctggttgagtataacccggttagagatgctattaataatgtgggaagacctttagatacagttcagcccttaatagtgcatctgagaaaacatatgagtgttataccctaagagtctgcatggagtgtcgggaagtgccttcggtgtgtggctcaaacattgttgtaacatcggggtatttatgcatggtagtgacaactttcagaatgctgaagaataatcggcaggtctattctcatcttataatctcttattatataactcagaataacataagaaatattcctttgtcatttactaggatttgtaataccaatatttatactggtggaccattcagaaaaagtgggaaacattattacttaatggttacagcactgacagcatgaacttctatatgatgcattattctaatattacgcatgaacagtgataaacactggctcccccccctc

SEQ ID NO: 663956 - DNA, 187 bp, Homo sapiens
aaaaggcccccccccccaaaaaaacccctggtttttccccaccccctttccccaagggaaaaagggtttttttttattcccgggggggttttaatgggccccctttttttaaaaccccccctttaaattttgttttttttttaaaaaaagccccccttgaaatttttttttttaccgtccctgggga

SEQ ID NO: 663957 - DNA, 683 bp, Homo sapiens
cacactgtatgaattatagcacaaaaagtgactgtaggatcaggtgatagtcccggaatgtgcagtgtcttggtgcaccaagatgccttctaaaggctagacataccttggaaccctaatggggcagagagtatagccctagcccagtggtgacatgaccactcccttagggatggcctgaggtagaggggagtggtatgtgttttctcagtggaagcagcacatgagtgggtgacacggatgttacgatataaggctctagttacgggtgtcatagtcatattgagagactgacacacatcctagcagctggtaaacggggtgcctggaggccatggatggagctctagaaacattagcatgggctgatctgattacttcctggcataccgtcacatatttatgggaagtcttattagagggatgggacaggttagaccatatcctagctgtggaagctctggaaacactctctaaatatccctctattaaaaatcacttgacctaagtacacttcctacctttgcaggggactagaacatggaacatatctctgacatagttcttggtaatgagagccagacacaactgagattctgacgttgtcaggttctcggagctcatctacataatggagaccttcttaggtaaggaaaagagtaacctggatatgctggtatctg

SEQ ID NO: 663958 - DNA, 1050 bp, Homo sapiens
tatggatgacaccacacaatgattttacaaggcactcgacataatgaatccaataaacattatagcgaatattcgtctagtctgtgaaatagcctacgagtaagactgcgtgctgtagcaactatgatagctgaactgcctcaacatgacagtaccttgttgctcccgacatgttcgtgcatcatacatgtctatccgagactgactaataacaagacaacagtgtccgcgacactgattcataggagtgtagaacgaaaaggaagaagggattgctaaatgtgaagatatatgggacaccatcatccactagggatagacacatcgaaagtcttgaatatctgagatgggttcatcttgcccgagataaactcacatagacataggagtcacaagcatgaaactccacgggggcaggtctctcatagtgagagcatccctcctatgcaggataccgcaggatcgttgcgaaaaagcccagtactagatcatgttcaattctaacttctagctcgttgtacatagccagtgcgaagattgagcataagatctatttacaagagagtatcaactcatgttactcccacagagtacaatgagagaagtcaagggcatggcaatagaaagtacacatgtcacttgacagtaatgaaaaaaacagtcttaccacaaagaaatgcaaatcctggaggggcaacaaagcgtaaacatgctgaagaaccattgaaacaaggtgagaaaagcaaggacgtgacaaacatatacacatgattggagggatgcaaaataatgatgcgtgtgcttgatgtggtacaacgttagaatatgtgtatgctgagtaagaagaaataataagcaaaataagaataatggcattgaaaggggaagaaagcagagaaatgaatacgataaaaggtgcagaaatgaaaaatgaaatgacgaaaatataaataagatataaaaaagaaaaaaaatagatagaaatataaagaaagaaaagataaaaagaagagagaaaaaaaaaatgaatataaaagataataaattaat

SEQ ID NO: 663959 - DNA, 767 bp, Homo sapiens
  misc_feature (587)..(587): n is a, c, g, or t
attgcccggtggtcctccgtggccccgaggctcccgtggtccccgtgtgggtggcccatgtttcgaccaaattcggggaatagcttcccccctctttcccccggtttcgggtagtttgtttggtgcttgcgccagttttgcgcgggtagtatttgaggggggtacctgtcgtgggcccccttgtgcgcccccacttggctggtcgccgagccccaggtttccaccccccgcctccgggggtggtacacgcccgcccgtggaaggacgttttgcttcgtagcaacaccagtattgtacagaaggagtcttatcaccataagggcaggcgtagttttatgttcctctcttggtattgaattattcttgagagatatagaagaggttgcacccgccttcttattccggcaatatggaaaaggatttcaccccttgatcagcacaccattctggatgatgactcctcttattattgctggggcgccgcacctggggtaatcatccccgtctctctcgataaggtgggtgcgacctctttcgggccccccacgctgacactgtggaagtgttgtcgagcttttcgcccacangcacaccacgtggcggtcttcttccctgtagacacccacatggccctcaatttcccctacatctctgagaaagtataacacttaatacctcttattctaatatttcttccacaatttttttactactatttattgtataatttttttcacttaaataacccaccaaagtacaacaataca

SEQ ID NO: 663960 - DNA, 227 bp, Homo sapiens
cccgcagctcggggcttgcccgatgtccatcgtaagctcccacggcctctgacccatccttctcgtctctgccagccctggcttgttgcgcagccatctcctgtatgtcttgccaagatcgctgcaggtaacaacacatctatctacactcaggtctgttccaaccgctacgcgaaagctgtgcgcccagaggagacggtaatggtgtacagtatcctcccctgtgc

SEQ ID NO: 663961 - DNA, 151 bp, Homo sapiens
atgagagctcgctacctttggtgcttgtgatggcggctcctcactggcatgagaagatcaccatgcagaacctcaacgaccgcctggcttctacctggagaaggtgcgcgccctggaggatatcattccctctactcttaatctccccact

SEQ ID NO: 663962 - DNA, 805 bp, Homo sapiens
tgattcagccttctgcattttgccatgtatggtggcatctaatttcagtgtgattcattcctaaaatccaaacagatttctctgaagtacaaatgatgattgctgctgttgctgctgctgctggtggtggtggtgctaaatggtcagcaaaagcccctctctgtatcttcctacctcataattctaatggccagatttcaggaatgtgttttctatacctctgacggtacttctatcagaaaaattcagcaaatatgtatttactactgcaagcgttcttctcttttgactgtttgcttggtatagccataacttatacaaaatgttgctaagagaataattcataactccagttgacaacccagatataccttttagcaaatcaacaaaagtggcatggacatacaagtcacacatttcagctgtgtgacggaacatggatcaccatggtgctgtgttgcagcattgctctgactaagaggaggcagccaaagaaggccacatgtcatatggatgtggatataaaattccagaatatacagatctgagaacaatgtagatgagtacccaaggctataattgttttaagttaaaattactgctgattaatacagagtatctttggagtttgataaacttttctaaaattactttagtggtgtatctgtaacacattgagttcaatggttcaaagtgaactatgtagtgtgtgtgtatatacacacaacatatatatatatacatatatatatatatattctatctcaatgaagttaataaaattaatgatggtaaagccaaaaaa

SEQ ID NO: 663963 - DNA, 248 bp, Homo sapiens
  misc_feature (2)..(2): n is a, c, g, or t
  misc_feature (81)..(81): n is a, c, g, or t
  misc_feature (100)..(100): n is a, c, g, or t
  misc_feature (124)..(124): n is a, c, g, or t
  misc_feature (133)..(133): n is a, c, g, or t
  misc_feature (151)..(151): n is a, c, g, or t
  misc_feature (197)..(197): n is a, c, g, or t
cnacccccacctctactgtcgtgaaagtctggagagctgccatcttctgaccatgcagattctagggtctgttcatctgtnttccttatgtttgacttcntgagcgggtgtcatcaccatgagnatgaacttnccttgcaaccacgtcccngacaaataacaacatgccctaaaaaccccaaacacagtgtgcagcntaatcagctcacccgctcacagggtatctggtaccttaacctcctggccgg

SEQ ID NO: 663964 - DNA, 357 bp, Homo sapiens
  misc_feature (16)..(16): n is a, c, g, or t
  misc_feature (39)..(39): n is a, c, g, or t
aaggagggtgtttatntgcaggtcaagaagcaaacaganatcagggagctcatgcttaagacctgaactccacagtggcttacatgtaaggtgcagaggttacaggcaaaggcatcaatcaacacatggaagccatatattggtttggcctaaaaaggtgggatatcctgaagtaggggcttacaggttacaggtaaatccaaatattttctgatttgcacattgtttaaggaaggggatatttgtctaaagatgggatcagcaggccaggtgtggtggctcatgcttgtaacctcagcactttgaaaggctgaagaaggagggtaacttgaggccaggatttcaagaccagcctag

SEQ ID NO: 663965 - DNA, 1219 bp, Homo sapiens
  misc_feature (284)..(284): n is a, c, g, or t
tgaaacggacatcttgctgtactgtggcctaggctgaagtgcagcggttcaatctcggctcactggaaacctccgcctccgggtgttacaagcagatttctccatggcttcagcctcccaagtacgctgggagattaacagtgtgtgtgcaccaccatgcctgggctaattttcggtattattaagagaacacatatgggggtttacaccatgtgttgggccagggtctgggtttccagaactcctctggacctcgtagatccgcccactcttggctctcccanaagtggctgggagtattaacaggcgtagagctaaccagcgcccacaacccaattaaccctttttggaagcagttaaagattaacctcccttattgaaaaccgtgcaagaataacgggatcacaacgtgcctcgaggcacatattttcacagcattcacaagtgacattcaacgtttacatttaaggcggtaacctataggacaaaagggacacgtggggacaaaatgtggacaaacggtggtgcctctatcgggaacttcgttggggagaagcaaggggacgctttctcaaagggaaaacacaaagctccaatccccagaaaggcctccccgtagagaagtagacacgggggcacaagaaggactttccttctcaccacataagagatgggggagaatagacgagcgtgcttctgggagcaaccctctaaaacaggcacacatcccaaaagatctcacacttgaaagggtagaaagggcgcatgcagcactgacagcaaaaacgtgccttgtttgtaacacccgcaaaaaacagaaaagcgccgtactacacagctcttgaagcaaacaaagggggcagttcaccaatttcaaaaagagggcccaatgacaggcgactcacccacccatgtgataccccgccaacaattgttgccacaacaccacagcgatagcacaatctggtcgcacgcagtggaccccaagtggtaacccgatgccccagacggcacaccggaaacacaacaaagatatacaacacgggcaccaaaaggttctctacgagaaaagggaccaaaaacggaaaacaacaaaatccagagcaaatgaggactagtgaccagccacatcacaggagaacaggagtgcacacacaacacaggcgagccccgaaaaacgcaccgagaacccaacaaacaacatacggaagaaaaccga

SEQ ID NO: 663966 - DNA, 479 bp, Homo sapiens
gttgactctaagaggatcccgagctctctctgtggggactgagggtagtatggacctcagctggcaagctacttgcaagcccgttctgggcaggagctcccaaagggaaaggaggcaaggcagcagccttcagttggaatgaaggcgagatggtgtggaaggtgctcagaaggtctccggtctgcaagctctctttcatcagctcctgtgagtgggtcttcttggtatgccgggtgaggtgatgggtgcgcccaaatctctgggcacagaactggcacaggaagtccttgcatcctgtgtggaccaccaggtggcgtcgcacatccttccgggtgtagaagcatctttcacagtggtcgcactggtgcttcttttccttggttccgctagggggcttctcttccgcatgggctttgaggtggtccagtagcacctcggtgctccctagctccagggcacagaccccacagagagagcgt

SEQ ID NO: 663967 - DNA, 424 bp, Homo sapiens
ttcacgttgtgatcgctgcatcatgcgaatcatcgtcatgaccgcattgtgggctgtgtccctagacagctgccgaactgtaccaatatccacgggcattatgatcgcatgtagtgcatacctactggtcattatcatccagatactggacatgtagctcatacggcaatagtcctggatcacgatgtcttcggtgtccaggtggatacggcatcttcatacctcagctcggtgtagcagagtaaccaggactctcgggaatagagtgatctctggcttgagtctctgcacgagctcattcacaatggcaatgcaaagtcattatggagagtctaagtaggagcgcactctggccgaagtccttgtaattcctacacaagagtgctttcataagcttctgaagtccattgaaagtcaccttgat

SEQ ID NO: 663968 - DNA, 162 bp, Homo sapiens
ctcctcccaggagataaaacttgtgcctgaagggaatcaggcaaggaattgaacccagggaacagtgacaggtgaatggggttctgctgggttctgtcataggtcttccgtacgtccatctggggttccttgctggtttgcattaaacctccgcaggtagga

SEQ ID NO: 663969 - DNA, 1600 bp, Homo sapiens
cgggcgagcccccgaggcccgaggtgagagggaagagctgccgggccctgggtctgctggagtgctgtggctgccgcccggaacgacgaatgcgcggtgtgctacttgcgtgtgcagtgcgcgatgttcgctgcagcacctgccccctgtgcggtgaccgtgctggtctgcttcctgtgctgctgtggtgagtgatgaactgttggcctgccgttgcggggactgctcctgtggacccgttggccttgtgctgcggtctgcgggtggatgcccgtgtgccgttgccgctggtgtgatggtgtggctgttttccttacactgcatggtggccatgatggtcctaggatgccctgctggtgagcctctgctggacgtaatcttcgtagcttacctgttgggaaccaacacaaagtgtgccataggcgtattttcgctttgtgacttgagtttcccaatagatagttgacatgaaacgttttgcgattcgagactccttgtcgtttcaaaaacaggaatccactggtcaaagggtcttccgccttttgtgagttccagacccggttatacattatccggtacccgcgcgtggcccgtttggaatagaattcccccgagaacctcctggcgacttgctggtgttgacatgatcgtgagcctggaatgaggccctggatatatttatccgcccacccttattcaccattcctttcctggcaccccgtttgcctatggtggcacagtgcaactgcaattggcatgggcgaaaagccgtttttacccccctttggtctggacattagggcacagaaaggtgtgaaacctcctggatgtgcgccatgtgtggctgggtggattcagtgttatccaacatctagtaccaagccccgctatttgtcaccgttaggtaatgtacccctggacccgggtgcgaaaacgccataagctctcgtgagtggctcgcccttatcctcctggtacttgatcccgactgtttcaccttgcacgccttttaatctcttttggtcctaggtgtagcaggacagtgttgtgcgtcgcacgacacatggtgtgtcatctccactttcgtgaggccgctggtgttgggcctcgccgatgtttttgacgtgacgacgcgtgccactctgttctgcgttgggcccctgctgctcgcgttttcggccttgtagaagccccgccctcgctttggtgagggcatcatctgtgttacgtataatatgccagtgtgtgaagtgctatctgccaccgtttttgcgtttacgtctccatatttttctctctaggggtgtccgtgtcctccttagtgtaaaatggcacctcgggtattgcaacgtagaggtagtaacatgcggtagcgggtagatagagaagaagtggagccctacatgtggggtgcttgaggtctgtgagcaagtttccctcagtgttacgcacaacgttattgtgcagacaccaatattaagtcacgagagaagaggcagctatactaaacggtcagctgtgctcccactagcttttggagacgatttatatagcagtatacatagtagttattaatcagtaggttgagtagtatcacacg

SEQ ID NO: 663970 - DNA, 171 bp, Homo sapiens
agagacttggattccggactgggatgaaagagagttgattgaatcccggaatttggaaaccccagatcggagggcggacggtacaaccggagctgtccaggttgatttcccaaggcttctgcattggctgtacctgaaacttattgtggcctagactccccagtatccact

SEQ ID NO: 663971 - DNA, 158 bp, Homo sapiens
gatcacctttatctatacaacatacatacatatcagttgtaagatgtacactacatttctgtgacaaacatgctttatttttaataccaagaacattatagagtatcaatgcagagacctaaggataatctagtagacactaagttaaacttaagtct

SEQ ID NO: 663972 - DNA, 877 bp, Homo sapiens
acagcccgagatagaaagcttcttgctaatctacctccaccatgatgaaagtgtgttaaccaacgtgttctgctcacaaatgctttgtgctgaatccatggtatactatatctgagtcaaaattattataacctgggcttgtggatctgacaaatggactccaacagagtcaagcatttctcactatgtgcaatagacacttaggcagtgtgtggcacaaaccatatgcggactcaaacaaacggatcagatttccgcttttacctgcattattatgggaaagcgatcatctaatgaagtgttgaatgtgatacaagggaacacaacagtagatgatttcaatgatgagactcatggtctgcaactggagatcttcagagtcccacacaagcaggacgatataaaggacgaggattgaacgtgaagcccagagaacatggtcgaatgaagagagcacagatgagggctatacgcctatacaacttcgaggctgaccataagcgacacgagggaagcctcacgagagaggagatggcagaacagaacgggcgggcagcaagattcgccacacgaaacaagaccgacggaaacgtcgaggccactcacggctgtcctcaaggagcaaaagctcctgcgctcctgaagccaaacttgaatgaaaattgcttgagcctgtgaagcatgtactgcgagaatccatgacccccaagagggcgaggttcttgggaggcggtgtatcctggccacgcacaccagttcccacattgtcctccgaatatggatcctcccaaaggattatccatgggacttgactaacaggttactcgggcacatatcaatggaaaacgtatacaactggacccattcaatgatattg

SEQ ID NO: 663973 - DNA, 370 bp, Homo sapiens
gctcattaccgtcaggccgtcgttgaaggcatcgtacacccatcctcacagggagcactggtctcgctagacacaacactgacccctggccagctccacaagcgctggccttcagagaagaatctaccactttccagagctggccaagctcaagtgacacaacaccttcacctcccggcaccacagcagcccctgttgaagtatccacaacctaccacagccgaccgagctcaactccaacaacacactatttctgccagtaccacaacctatgggccgtagtgaggacatcaacaacagtccacagcagcccaggtgcaactgagaacagcactacttccctcacccgctactgcaacctccagttctt

SEQ ID NO: 663974 - DNA, 168 bp, Homo sapiens
atcacctcaggcttttcagttcccttagccgtcttactcaactgcccctttcctttccctcagaatttgtgtttgctgcctctatcttgttttttgtttttttttctggggggggtttagaacagtgcctggcacatagtaggcgctcaataaatacttgtttgttga

SEQ ID NO: 663975 - DNA, 394 bp, Homo sapiens
ttacaaatgtatagttatactaacattaaaagagagaatgggctgggcatggtggctcacgcctgtagtcccagctctttggggggctgagacaggaggatcacttgagcttgagaccagcctggccaacatggtgaaaccgtgtctctacaaaaaaatagaaaaaaaatccctgcatggtggtgagcacctgtagtcccagttactcaggaggctgaggcatgagaatcgcttaaacctccgaggcggaggctgctatgagctgagatggtgccactgcactccagcctgggtgacagagctgggtggtggctcatgaatatgtttgtaaacctgaagatttgagatcatataagccagatagaaacttaattggcattcttaacttttggtt

SEQ ID NO: 663976 - DNA, 781 bp, Homo sapiens
gcttgttttaggccattaaattgggggcattcgttacacagtaatcgcagctaatgctgctattgctttttattatattattattattaaagacagggttatgatctctcgcccaggctggagtgcaatggcacaatcatggctcactgtaacctcgaaactcctgggctcaagcgatcctcccagtcgcttaaccatccgcgagtggctgggactgcaggcacgtgccattgtgcctagctaatttatcattgttttgcagaacatgagatcttgccgttgttgcccatgctggtctcgaactcctgggactcaagtggtcctcctgccttgggctcccgaagtgctgggattattggtgtgagccatctgtgtctggcccgtagatgctcgtctgccctttgctcacttgaagctcgtcctcagtgttgtgacggctgttgagcagctcccttctctagccagtgctctcttcctctggcttccacgaatggtgctcctcttgagttctcttttattcctccctggctagtcttgtgcgacgttcctctttcacttagctccttctcttgcttgcttgcccctttcgcgacttagttgctccctgggtggttccacctgtggcctcacgccttgtggtccccagcacttccggggggcccaggcgatgtttgatgacgcagggcagcgagttccgcacgccgcctttgtacatatcgcaacctggtcggttagcacgatcatccccctttgcgcacctggcgcccatcggcccccatcc

SEQ ID NO: 663977 - DNA, 418 bp, Homo sapiens
gagtactgcctgagtcccagactctgcatcacctaactggtggcttgtccactctggaccccctgtcctccctctgtatgtaataaagatgaaggggcattgggccagataccgcttgtaatgaccccttctcacctctactgtgtgactgccaccattttcgctcgttgtgctgtgaagggcccttctgatgcgtgattccatgtgattgctagcagtgttcaaaagtattccccaatgtcttgtgtcctggcatcctgttggatcccgtccaggagaccactgcttgtgctgtatgtaccaagggtgatcctttcagaatgatcatgggctggccgctgccccttctggaagaaccttctctcaaccgcgacacatgtgacagacccctcgacaatcttgaactcgctggctagag

SEQ ID NO: 663978 - DNA, 158 bp, Homo sapiens
  misc_feature (73)..(73): n is a, c, g, or t
  misc_feature (132)..(132): n is a, c, g, or t
  misc_feature (140)..(140): n is a, c, g, or t
  misc_feature (152)..(152): n is a, c, g, or t
ggggggggggggggggggggccccggaacattcacccgaattttttttaaaataatgttggggggggggcggncgaggcgagaaaccggaaaagaggaggagagggggggagggaaagccaaaacgcaaggnggaggggngggggggccccntttttt

SEQ ID NO: 663979 - DNA, 743 bp, Homo sapiens
  misc_feature (378)..(378): n is a, c, g, or t
gagcctacgcaacaggagaatgatgcctctcgtagaaggatctccttgcatccctctgccataagaggagaagaggaaacacaagaagaaacggctggctgcagaggcgcccaatgtcctatttcaatggatgtgaatgtgcccaggtagtgctataaaatcgaccacggctcgtttagccagtggcacaagcggttaggttgtgtgtgtgggttgctctcactgtgccgtgctgtcagaccatacaggaggtagaatagcaagggttgacagaaggatgttccttcaggaggatgcagcactagaagcactctgagtcgaagtatgagtggggtaacacccatctgcaatgaagaacacgatttggggtatcctaancacatataaatacattatgaaaataaatggtgaaaatgaatgtgtgtgagagacagcgagtgttgtggcacttggcaaaaattttcatacaagacaataggacgtgtagggagagcgcgcgggggcgccacgaggtgaggtgaatagcgcgcaacctgggagcacatgtgtggtcccccacgggaaaatcgccgggcgcggcggcaccaaggggcggggggagttcccatcagcgcatataaaaaaggcgccgggggggaacagcccggggggtttggaacaaaccccagggatggagcggccaggaggaggacgcgccgggggtgtaacacggggggcgccaacgaggcccgataggaatcacc

SEQ ID NO: 663980 - DNA, 553 bp, Homo sapiens
catgatgatcttcttcagactcagccatatgcacccaaatgaataacatagccttgtagctcacacaaagcctgtaaaggtggatcttctatacggacatgcttgacacttggtgcaaaatctggacaagggactcccttcgtgaggacctggacccctgtcctggaccaatcattccagtgcacagagatcgacacgtgcgaacatcgggtccatccagaccatagacccaagacggcacatcttacaaccaatatatgaacaatcgggctactccttacgggctctcgttgtacagtgcacagacgtgaattgactgcgcagatatacgacatccaggaaagctcaccttgggcactcatacaatacgcatgtccctgcagcttttgcgccgatacaattccttaccagtgtagcaccggaattccacaagagctattattgaaagacaaccccatagggatgcacagcatgacaagaaaccatttgtctaacaaaagatatgataacgtcatagactgtagcatagcctcacattggaccgaaccccact

SEQ ID NO: 663981 - DNA, 940 bp, Homo sapiens
ccggtgtaccgccaggaaaagaggatgagaaatggacatagatcgtatatgggagaaggcacaaaagaataaagcaagtaacagagtgatataaaatgtagatggtataggacacagcaggcatagggatcatgagttgtccaaatgcggaagactctgtgcaagggtctaacgcgaattcacagagagggtgaagttgtgagaaagatatatacagaaaactgaagaacacaggccaagtctccatccaccaagcctaataagcgtcaattcaaggacagatgaagtcacgggatactagaagacggcactacatatgcaataccgtatcacctgaacaggaaatgcaaggaatggacacaaagggctttggtaacgggacggcattgctttgcaacttattcacaaagtaacattaatggtttgtggtaacacccagagagaatacatgccgtgatgtgttttccgtacacgttcaatagattagccacatttattcgcccgaacactaattagttgggcatagtttacaggaagtaacttacttatctgggagggattgaatgtactttaaagacataaggtttgtgtttgccccaagtgacttgtttacccatatctatattataactatggactgatctatcactggcgagaaccttcagaatgacactaaataggatacgtgaagaccgcagagattccggggcgtaaataatatggggggatgaggcttcaaagggaacgtacgtaagtgacaacggcatacaggttggcgagtaaaatcgaactaagtcatgtctgacaaactaagcacctgacagtgacaccggaagccgagcaacgaaagggagaggcatgatcaaagcgaaaagaaggcaagaaactgtgaggtggacacaaggagagaaacgcagaaaaacacgacattagacataga

SEQ ID NO: 663982 - DNA, 80 bp, Homo sapiens
tagagtagtcattattgtgacttttggcaccagagatttagctttgttttccttaacgatatcagcggacacacgccctt

SEQ ID NO: 663983 - DNA, 158 bp, Homo sapiens
  misc_feature (68)..(68): n is a, c, g, or t
agtgcatgctgcggtcgatctagaggtcccgagaagagacagaaggggagaaaatacccctttaattngtcctttagttgaatgttcagttcagaaaaacaaaaaaaatggtatttaaaaaaaactgctgggcacgggggctctcgcctgtaatccca

SEQ ID NO: 663984 - DNA, 372 bp, Homo sapiens
ttggggacacttccataggaaaggggcctggccctttgtgattgccacgtgtttcctgttaacccgcctgcccccagggcaaatttttgggttttgttttttcctgaacaaaaatgtaacccccccccggaaagccaatggttcggaaacccttttttgcccataagggtttttccaaagaacgtgtctccctaggaattaggaccctcatcggcccgagcccaactcctggataaaaggaataaggagaattgtgtttgtaacgagttacaggattgtttctttcctggattttaaacttttgttaaattgtgaaattatgggggggttttatagaaaaaaaaagtgaaataaagtcagatgggaaagcca

SEQ ID NO: 663985 - DNA, 272 bp, Homo sapiens
tttctgggactacgggcatgcaccactatagccggctacttttttttttttaaattttttggaaaaccggttttttgacatgttgcccaggctggtctcaaactcctgagttcaaggaatctgcccgccttggcctctcaaagggctggaattacagacataagctgccccccccggcctgtttagctgtttctagggaagtgactgggtttggaacaaaggctacattcctatccatcttgctcttaggccagctaagctctttttaatat

SEQ ID NO: 663986 - DNA, 396 bp, Homo sapiens
cggggagcgcctgccgtggtcataagtcaggaccgagtggcgctggaggacgggaagatgtttgtcaccccgggggcgggccgcttcgtccctcggaaaacattccctggggactttagttctacgaatgacggcatccaacagcgtcggcaagcgaggcttgtgctgtgacgatcgcacgtgtgtgccaccgtgtggctgtatgactgggccctgtccacgacggtgaatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacc

SEQ ID NO: 663987 - DNA, 277 bp, Homo sapiens
tggtaatctaaccagtgtgcatgctgcctgcttctctccccagaggctacgccctgtgggtccagctgtctcttccatgactatatccatgctgctcaatgtggggtcaccgcatgaagaacggcaaagtcactcacaactcggaaaggtttcacagtcatggaacgagggacaaggcgagggaatcccaaacttgttctaagacatcctattgaagactgaacgaccgtttgctcaggctgttgtaacatattccaactctgagaacatggtgtcc

SEQ ID NO: 663988 - DNA, 322 bp, Homo sapiens
agggtatgctgcggtgactcttgagatccccgctgtagcctctctcatagtacactatagataacttttagagaattatgctaagtgcaataagccaatcacaaaagtatcaataggagttcccatcgtggctcagtggttaaagaatccgaataggaaccatgaggttgcaggttcaatccctgaccttgctcagtagttaaggagccggcactgccatgagctgtggtgtaggtcacagatgcagcttggatcccgagttgctgtggctgtggcataggccggagctacagctccaattagaccccagagagggtccagg

SEQ ID NO: 663989 - DNA, 105 bp, Homo sapiens
  misc_feature (51)..(54): n is a, c, g, or t
  misc_feature (56)..(57): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (72)..(73): n is a, c, g, or t
  misc_feature (75)..(75): n is a, c, g, or t
  misc_feature (84)..(84): n is a, c, g, or t
  misc_feature (90)..(93): n is a, c, g, or t
cctgcagaactggaggattctggagtttatttctgtgccagcagccagtcnnnngnnggnacncagtanttnngnccaggcacncggctnnnngtgctcgaggac

SEQ ID NO: 663990 - DNA, 109 bp, Homo sapiens
catatagaatcgagctggtaccggcacgatcgacccggctgaagtggccaccatcgaagtgggggcaatcccgacaacgtcgtaacggtgccgcagtgcacccatctgg

SEQ ID NO: 663991 - DNA, 480 bp, Homo sapiens
ctttgacacagacattaaaatatattaactctagcaacacgtaaaagtgtcaagaacataatgctaaatggtggagaagaacatacaaaattgaatgtgccgtattattacaatatttaaaaaaaatgagagaaaacactgaatggcaattgactaagatcaacagagctgcgattatctgtattatacaattttttgctactacactgtattaataatgagctacccgtattttctatactgatgcacacacacacacacacacacacacacacacacacacacagacaacaggcgagaccgagcgtgaacttcggaagcatgtaacattgctagtgggcgctacactgaggatataatttcctggagagttaaaatacagcattatgtacttaagctgaaccaccaaacttttacaagtttaaaatgtggtttatagaagatatgaccatgtgttcttaagtcacatctagagagaca

SEQ ID NO: 663992 - DNA, 379 bp, Homo sapiens
  misc_feature (256)..(256): n is a, c, g, or t
gaaatttgccaggcatattgggggcctttcagaaaaagcttggaataagggttggggagactccccctgccaaacttttccctcttataaaagtggaatgtttaggggcctgggtgaacgccccaatggttcaaataaatgccaattcctatggggttttgccagctaaggatattgaagaaattattgatgggctcagggcgggcaaaatcccaaaaccagggccaaggaggggacgttttttttgtgagccagnggggggttttccctttttgattgacccccccaagggaccgggttttggggtccaagcggccctttaatttatattgacctgtaaatatgtccctagagaaataaaatagggccttccctttta

SEQ ID NO: 663993 - DNA, 414 bp, Homo sapiens
acgatatccatgcgcgttacgcgcgcagctacgtcgtcggtgttcaccctggccagcggctgacccttcgggatcttggcgacttgctcgacttgggacgccgtcacaaggcgagtgccgtgtacctcgatggtgttgacgcacaacaacgacgagctgcggacgatccacatcgccacaaggacgagcaccaccacagcggcgacaacacccgcaatgatccggttacgcttcctacggcgtcgacgtcgtagctccatcgcgacgctgatgtcggaaaccggcatcaagccttgccctccagtaggcccaccagaaccgggccaactaaagtgacatctcctgcgccaagggtgatgacgaggtccccaggacgtacctcttcagcgagggcctccggaaggtcctgcttat

SEQ ID NO: 663994 - DNA, 182 bp, Homo sapiens
ggcggggataccagacatgagccaccatgccgggccggttggttttagacgtgtgatatatgcagtaccaatccatttagtgggtctgaagtcgcaccggacatgatggcttcttcaatctcccaggcactggtcacttcactggtactcaggatatcaagccatggctatcctatacttaa

SEQ ID NO: 663995 - DNA, 170 bp, Homo sapiens
ctattttcggcaccctgctatgggatcgacaccaagatcgcggcacgcatgctctggcgcatcctcaacggccacagcctgacccgccgggagcgcaggcagtttctccggatctgcgctgacctcttccgcctggtgccgatgaatagcgaggtgccgatgaatagcga

SEQ ID NO: 663996 - DNA, 576 bp, Homo sapiens
caaggttctagcaccccgcccccaattgcagcccaccacccctccctcactccggactcgcaacctgtggacatgagctgcaaggacacctgagtgtctccttcctgcccgatggagtgcactgagtgagtgctggtggtccgaggtggggcggaggaggaggaggagtgaagaagaggaggaggagtgaaggaggaagatggaggacgtgagcatacatgcctgctaccaccactggccaccagcactgctgcagcctgccccaagcactgcccccagcggcggggtccacatggctggtgactcgtggggctggatgactgggccagcttaccctgtgtctcccagctgcccacgctgacccgcgcccatgccctggaaatctgccagctggatgttgactgcaccatcagcggcgtactggccttgagttgcacttctcttcaagatggaagaagccaacctggagagccgagcgaactgccacgagctgatcgaggccaccaaccaatgtcaccacagaagccacctcaagtcggggatgagcccactcctgagccacacttggtatgccga

SEQ ID NO: 663997 - DNA, 875 bp, Homo sapiens
  misc_feature (567)..(567): n is a, c, g, or t
ggggagaaccacccctcctgtggggtggtgtttcacccacaccaggcgggggggggtgttgtccttcgatgaggaggtggagagcaaacagaagggggggtgcttcctaacaagaaaaggcttcctctcggcgtgtgggcgcggtcggaagagtaggtgctggtggtgttttaggaggagagtaatatcattggtccgaagagaagatgatccctccacaatcatttcgcgttgtgttcgccccggtcttcgcctcctgtcaacaaggatgttgaccacattttctcccccctcattatggggggtttttcgcgaagagcacacaccgcgcggggacactatttttgagagctcttttggataatcctcgcgagagtgatgacacatctctcccacagaggtggagagacacatatagagaccttccacacacactctcactgtttgctggggtgccccactcgtagacactttgtgctggaggctctctgcgctatcacgggctttctcgagagatgagtaacgacaccgcgtatgtagagattctgtgataccacacaccctttnctcggccacagccttgtgctcttcctcgcctgaagtgtttcctccacagggtgttaacacaaggccctttgttatatggagaacctttgtccaccctttgctccgctgggcacgttgggcacagcttctatctggcgccgaagcacagtgggtaaacggggctgttggccctcaagcacactttggccctgtaatgtcaccccttgtcaaatgtgcatctcctaggattggtgtttcagacattgatgtaccttttccccgcctctgctccagggtttagtgaagtaaacagtactttgggaagttta

SEQ ID NO: 663998 - DNA, 268 bp, Homo sapiens
atacctgaggctgacagtgtctaggtttcgaacactgcagagtattcaaaatgctagcattcatgtttgggttgatgcaggacccacagctctctatggagcaatcgcagatgtttcaggtggtccagacacataggaggttattcctgagagaacatccagcctggtggactggacaaaagccacactaaggtctgtttaccctgagaagggggactgttcctctccccttataaatgccaagtagaatacccctgatgaagcagct

SEQ ID NO: 663999 - DNA, 107 bp, Homo sapiens
ccttcccttttttttttccccgcccccggcacattgggggtttcggcccccgggttgtgggttctttgggggggggccctcaataaatttgaattgttgttgccgca

SEQ ID NO: 664000 - DNA, 211 bp, Homo sapiens
ggagaaagctctttactgggggtacagcgaggaggagcaaggccatctccccctacctgcccccaccccctcctagggtcctggggtgagggggggtcttccctcctccggaccaccactgttttcgtaacagtatatagaaaagatggggttgaggggcccactgttctaatccttaatcggaaaggctcggacgcgaccctaaccttgt

SEQ ID NO: 664001 - DNA, 724 bp, Homo sapiens
tggggttacacgcggtgttcaagatgcgtatcgaaaagtgcttatattctgtaacggggacccatctatcctggacacggcatgatgttcagtccgtcaatgcagtggcaaggttgttcggtatttggccaaactcgtatcatgtcattagacagagacttttattcagaagaagcgcaactcactcgcaaagttgaggtgggaccacaagctaattccagggagaagcgaggctggctatcagagtcttgacagggggcattaagttccattctgcagatttgcatgaaacgctgagacagatggaggactctatcaaaagtatccagctgcagtagctgatggaaatgaaaactattgaatgtgcgcatgtaaagagcagattcgaatagaatgtcacacagcggaaaagcggccaagttcttaatactttataaatggaatcaagattggaagcatacataatagaaggaggctgacgagcaggagttgcagtggtatccaagagtagagtgcaaggctagaatatccatcttgattctcgagcccctacttggcacgagcaaacacggggaagacatgtctggtaacgtaggacataatggctacaggcagtgtacacagaggcatggttggaccatggcgtagattgctcctgtgaataacactactctggtaacccattttactgttcatggtacaattttgtaacaatgaccctttg

SEQ ID NO: 664002 - DNA, 878 bp, Homo sapiens
gcatttgtgaagcggcgaaggaggtggtggctgcgtgggagctccggggaagccgttcgggctgcgtgctggtcggcccgcggggcggaggcgactcgcggcggggggatggccctagtgcgtgacctctgtgttcagctgtccatttcctgtgaccagtctcattgaccaggacttcggctccaagtctgacccagtctgctgtccttttaccaggattggtgggatggggcacgttgtgatgagcttggcgggcctgaacgggtgcggaactgtcaacgccctgagttctctcaagagctctactagctttgaggtaccgtgttggagacagtccacgaagactagcgctctggaagtcctattgtacatagacatagcaaagaggccagaatgctgaaggcgatgattgatcttcctagggggtgcttgaggtgtcccctaggaccagacttgtgtccagcctcaggttgctgagtctccccttgatgttgaagcctggaaaaagctggtcgtgggcgggggggaacaattcagcggacctccagcttcaggaattccccgggactgattcgttgtaattaacctattggcaggtatgagggcccagaaaccctagagtaaggactgacttttccttgcgacaacttcagatccaggtttcgtgggcggttcttcccggcacgttgggttgtggacactgggccccttggttgtgccggtctgcgggccttccagaacagcttgggaccttacattggagggcgttcttagagtcccccgtcacggattttctgtgttggcggacccgagccccccctgcccttgtggagcgccccgttttgccctggcggcgccttgctctcttggggcctcca

SEQ ID NO: 664003 - DNA, 895 bp, Homo sapiens
gcaggaaaaatgaatgcttggtattcattacttcatgtatatcaagcacagcagtaaaacaaaaacccatgtatttaacttttttttaggattttgctttgtgattttttttttttttttttggaaactggcctaacttgcttgtggctggtaaaaatagttaacggggaaataactggagatggatgggctagcttggttaaatggtgcttatgaatattttcatggaacaatccaagctaatattggttaaagaacacggtgttttaaatccatggtaaggggaataaaagttttatgaatgggactttccaactactttctctacagctttccatggtaaataagtctgggttcttgaaacttctctaaaggagaattgggtacattttgggaaatttatcccttatcccctctgggaagctatggggcgctcttaccaaggtttaacacacaaattttttcataccaaaattcctactaatatacctacgtggtgccatggtccatggatcccctcttttctccccaccctgaaaaaaattggtccctattttctgggaagacgggggggttcgtccgacaaaacattgggggtgttccacttcagaacttggggcatttgcgcattgttctttaacgtttagagaagccccaatggtctttggccatctcatgcctttggtagcctacgcggtagttggggctccaaaacctggggttaaaaattcttgagacctatgcgggctaagttagcctatccccatgcgcgggcgaatactccggttcgttgttgttcacactttggcgttggaaagacgactttgcgccagttgccgcttggctcaaacacattgacctgagagcgccacaggtggggcgcctcggagaacgg

SEQ ID NO: 664004 - DNA, 877 bp, Homo sapiens
agcggaggggtgcggtggatgtggagaaaatggcggtgtctaggagctgtgatcgacttcgtcggtgatgcttgactctgtcaatgtcacagcctattgtctcctgttgctccaggggtgacatcattcagacagcttctacagaggtgatcatggccaacagattcccaaaaaggacatggattgaaatcccctttgcctccatggctaggagatgagattgattgagatccatagaaatcacaattagagcccggcgtgctctatagagagcagaaaagaggggaatgttgggaaagtctgtattcttctgagatcttatgatggcctaaaggaacatcgtagcagcacgatgagacgaaagagcacgggtgaaacgtctagtgacctggctgagttaaccgagcctgtagtaatgaggtggcgatatttacgtactgggggcgacagaagcataaagcctatgccccgagacacactatttgagcaatgaaagtcatggtcctgctgagagagcttgtggtaaaaacaacaaagaatcagagagacgtcaggagatctgcgtgtccccaagagtctatgaggtaacctcttttgaattagccactgttggagtctgtgctctgactgagtcctggtcatggggggtatacacgtctgtcgcgataggttaggactacttaattgaatggaacggtataagggcctttgctatgcaccgggctttactttaggattgcccaaagcttggcccataactcccaaggaaacaactggatcacttgccctcaaacgttggattggaaccatgagatcgcctcttccctaagagaacgaataacagtggttaagaagtgccacaaaatggtgggagtca

SEQ ID NO: 664005 - DNA, 1316 bp, Homo sapiens
  misc_feature (364)..(364): n is a, c, g, or t
  misc_feature (1313)..(1313): n is a, c, g, or t
  misc_feature (1316)..(1316): n is a, c, g, or t
ttctgctgtcagaacttgatgtagatagcatattgggatctaatgaagatgtcatagattcatgctatggttataataaggtgtttgtagagtaacgtgtggtcgtcttggtggtggattttcgttgttggattgctcttgtgttagcgacgacaaggagactgtataaaaaagcgatatacatattatggcaataactctttggacaatttaattcagtgcatgacaagggaagaggctgcgcaaagaatgcgtgacgggttacctcatgtatcgcggtctgaacggaaacggtacagaagtaataaataactgatggactaatctactgccggtttcctattctttagaagcgtccagaggntacctcagtcgagtgccagcttgagtggtaatctagttgtcatgtcttgcatgttctctaatctggactatctcagttgagtaattctaatcgtgtgtgatgccacagcgtacgttgcactgatacaagagtaatcgttccattgagtagtctactacgaattggcgaacataggtcaagtctggtggcgatctcgtgtgaagcactcttcgtctcctacagaatttgtccacccgtagtgagtcagacacacgagataaagaaatcatagtaatacctcaagtatttactttacatgaatcagattaaatcgtctagttgaaacacgtgagaagaaaacctttaagaaaaaaggatggaactgacaagtagtgacagactgtttgtagaaacttggttactaaaactggtaaatggagttggacaggtgctttggagcatccaccctcgggacgttacaaagggaatcccgctgctgtaatcacgatgacccaaggttggttaaccagagtagagtggtaccggggggcaacacatggactgacgcggggaaaacaagcaaagacaaagggacgaactcactcagacgagacaacacagaaccagcaaacatagtgggaccccatttcgccagacaacaagagacagggaaaaatgcgcgcgaacatgtggcccagttactcgaggcgcaaccgagactcaccacacgcgagtaaacgggtgaacacaaagcggctcagagacagtagtacaacgacagcaaaagcagcaaaacatagaaggaacaaagataaaacagaacgagaccgcaaagaacggcgaacgaacaaagcaagacaaaacgacgacgagcagtcgaaaaaaaaagagatcgaagaccaacaccacacagcgaaaaaaaatagaaaacacctcccccctcgcactgctcctcaacaatgatcgatcngtn

SEQ ID NO: 664006 - DNA, 202 bp, Homo sapiens
tcccgcccggtcgctccttccccgcggcgggggcgggggcgggggcgggggcggggtccggggcacacggggcgcatctgcccagcgctgccctttcccgcgcgtcaactcccctcctgcccgggctgacggctctcccgccgctccctggccagtgacagactttttcctcgcgggtccgccacgtgcgccagccccccgc

SEQ ID NO: 664007 - DNA, 444 bp, Homo sapiens
cagctactcgggaggccgaggcaggagaatggtgtgaacccaggaggcggagcttgcagtgagccaaaatcgcgccactgcactccagcctgggtgacagagcgagactccgtctcaaaaaaaaaaaaaaaaaaaaatccgggccaggggttcacaccggtaatccaaggcactttggggtaggcaaaggcaggaggattcacgtggaaggcctaggagtttcgagaactagttcggggtaacaatagttaagaccccgctttcgtcatacaaagaaaaaaaaaaattacttaagtagaattatagaagcggggacgaaggtgggtgtacagcatgtgtaatttccagtagaaattgtgggagaggttcagaggacagaggtggattcagcaaggctaagggaagaaggggaacaattcagggtttaacacgggttgaaaggcc

SEQ ID NO: 664008 - DNA, 235 bp, Homo sapiens
  misc_feature (9)..(9): n is a, c, g, or t
  misc_feature (58)..(58): n is a, c, g, or t
  misc_feature (105)..(105): n is a, c, g, or t
  misc_feature (184)..(184): n is a, c, g, or t
ggaattttnctagtgaggagtggaggaagggggcctggtggaggagtagcagcctttncaaaggccctgaggcaggaatacctgggaagtgggggcgtgcttgtntaagatgaggctaaagaggaaggcgaggctttacttaggaggaatgggaagccactgagtgttaaaattaaaagcagtnggggctgggcacagtggcttacacctataatcccagtactttgggaggcca

SEQ ID NO: 664009 - DNA, 451 bp, Homo sapiens
tggtcaaaggagatactgaggccacttgaggagtctcggttttaaaggggtgcaatcaggaagggctgcctcccccatgggctgggtgtaatcaatcatgaaggactgtctccccgatgggccaggtgccatcagtcatgaaggactgtctcccccatgggccaggtgccatcatgacgggccatctccctgatgcactgccaggaacagggaggctggtgcccagcttgtggcctcactgcccagcctgggcttctttacagccttgtacgtggccacccacagggatccagctgatgtgaaggggaaggcctgtgggaatggggtcatttgtctcatttttacaaaaaaataattttactgtttttaaattttaaaaaatagtgcattttttggaaagaattgtatatccatacaaatataaaaataaactttagtatcaaatcttaaa

SEQ ID NO: 664010 - DNA, 267 bp, Homo sapiens
  misc_feature (3)..(3): n is a, c, g, or t
cancctagcctgggcaatagagctgaacgttgtcgatccgccgcctcggcctcccaaagtgctgagattacaggtgtgaaccaccatgcccggccactactttgttttttttatttaattcttcccttattgttttttggttgtcttttatttattttttgttaattctaacacaaaaaaatcaaaaaagccaaaaaggagctcttatggcccaggcgtggagttcctctttttgcccaggcgtggagtaggtctaatggcgggaac

SEQ ID NO: 664011 - DNA, 654 bp, Homo sapiens
gtttcctgtttaagatggcgacccccgaagcagcgcatgccgataagcttctgcgagccctagcgctgtggccccgcttgctgtcggccgcctcccaggcggttcaattaacctccagatgatggctgaacctgcaggaataccagagcaagatactgatgtctgacaacggagtgagagttcacagattctttgtcgcagacactgcaaatgaagctctcgaggctgctaccagactaaatgcaaaagaaatcgctataaaagcccagatcttagctggaggaagaggacaaggtgacttcattactggcttgaacggaggcgttcatttaacataggaccctactgttgtgatacagctgactaaacagatgattgtgctcaatctagcgcatgacaaactccgatggtgtggttaacacggagatggatgctgaagcctcgaatattcccagagactcctacctggcatttctgatggaccgtgccgtggattgttcacgtgctggtcgttacgccccagtggagcgaccacattggaggtgcctgattcagacccggagctcagtttttaggagcagattgacctttttgatgcatgatggacatgccagctcaccggatggccggatacctaggattcgctggcctttg

SEQ ID NO: 664012 - DNA, 119 bp, Homo sapiens
catatttatacaaaagagtgccaactcgaccagaaaacggcttttcccaaagaatgtattttgctggtgcccaccattacactgggataacccaaaggctggtgtcgcccggattgtcc

SEQ ID NO: 664013 - DNA, 168 bp, Homo sapiens
cgagagagcacaccgtctatgtagcaaatagtgggcaattacagtgactaagattctatcttggacaaccagctatcaccaggctcggtaggttgtcgcctctacctataaatcttcccactatttggctgcatagacgggcgtgctcttttagctgtcctcaggatc

SEQ ID NO: 664014 - DNA, 406 bp, Homo sapiens
cacacatccatcatatatcgctagtgtgggtttcatatgtgcagcatgtcatctaatctagagtgtattctgacagaaaacaaaaatccttagttctggttctacattgtcctctgcgccagggccccatcagagaaccaagttacctcagcctgctagaacttctgccaggcatgccctatagacttatggaagcagtgggtatcttcggggggcaggagccttgtaaaaggctcagcccataccaagtagcagcctgaggcagcagcaaacgtgggaagccatcacctggtacctcccttcctttcacttgcagatctctttcaagtgcccagctggaagctccttaatacaggagcgtgggacacagtccacgtcattcagccctctaatgtacggggtcaga

SEQ ID NO: 664015 - DNA, 610 bp, Homo sapiens
  misc_feature (42)..(43): n is a, c, g, or t
catcagcgagtagaggtgctccgaacctggggttacgtgacnnaggtgggcactgtaaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaaacggattggtgaggtccaggtggcttgtggcctgaaccaaacggtggaggaatttgtgggggagctgaattttgggctggttgaggttgtatatgagtgggcccggggcatgcccttttccgagttggcagggctttcagggaccctaaggggcctggggtcccctgcattcaacgcctgggttaaaagggttccccccttggggggggcagcccccctggtaggaaagcctgtgttgggtgccaaaatggagacagcggctaccttgttacggggggacattgtatttgcggccagcctttacacccagtgaatgccccatgtaaaaacatgatgataaaacagca

SEQ ID NO: 664016 - DNA, 703 bp, Homo sapiens
  misc_feature (20)..(20): n is a, c, g, or t
  misc_feature (220)..(220): n is a, c, g, or t
  misc_feature (235)..(235): n is a, c, g, or t
  misc_feature (242)..(242): n is a, c, g, or t
  misc_feature (246)..(246): n is a, c, g, or t
  misc_feature (250)..(250): n is a, c, g, or t
  misc_feature (261)..(261): n is a, c, g, or t
  misc_feature (273)..(273): n is a, c, g, or t
  misc_feature (277)..(277): n is a, c, g, or t
  misc_feature (288)..(288): n is a, c, g, or t
  misc_feature (293)..(293): n is a, c, g, or t
  misc_feature (299)..(299): n is a, c, g, or t
  misc_feature (362)..(362): n is a, c, g, or t
  misc_feature (382)..(382): n is a, c, g, or t
  misc_feature (419)..(421): n is a, c, g, or t
  misc_feature (469)..(469): n is a, c, g, or t
  misc_feature (473)..(474): n is a, c, g, or t
  misc_feature (476)..(476): n is a, c, g, or t
  misc_feature (482)..(482): n is a, c, g, or t
  misc_feature (484)..(484): n is a, c, g, or t
  misc_feature (496)..(497): n is a, c, g, or t
  misc_feature (504)..(505): n is a, c, g, or t
  misc_feature (509)..(509): n is a, c, g, or t
  misc_feature (514)..(514): n is a, c, g, or t
  misc_feature (518)..(518): n is a, c, g, or t
  misc_feature (569)..(569): n is a, c, g, or t
  misc_feature (572)..(573): n is a, c, g, or t
  misc_feature (576)..(576): n is a, c, g, or t
  misc_feature (579)..(580): n is a, c, g, or t
  misc_feature (593)..(593): n is a, c, g, or t
  misc_feature (597)..(597): n is a, c, g, or t
  misc_feature (602)..(602): n is a, c, g, or t
  misc_feature (622)..(622): n is a, c, g, or t
  misc_feature (638)..(638): n is a, c, g, or t
  misc_feature (698)..(698): n is a, c, g, or t
taaattatctaattctgtcncatctaacggcaactaagtatacgcttacatctgctagtggcacctaaaataaggatattgttggtcatctttaaagaaatgatcttaacataccaaagtagtggaatcaatagaataaaatatttaggtcttacaaagcggtacgacactaaagtaatataggataccactaaatttatatttctatgtatgggaagtnaaggtattcggtggnacatggngcgnggcngttcgtttttntcgcctatttcntctncggccctttcntcganattccntattagcgcgagagcgttcgaatatgtcaaataaataaatttgctccatacattcagttaaanccttcaactatgtagtaatncctaaagtgagtattatgttgctggattaatgccaannnatgtttcccatggcaatccagcctaatattaattgtggtatgggtgcngagnngntaaaangngggataattttnntagtggnngggnttgcntttnggggctctatgctgttcttaatcaaaactcttattttattatcaagaattncannagntcnngagagtgagtgantttnctgtnggagacaggaaatgaagaantactaacaccgggaangtatttttcctttctcaatattaacacatgatatatattcatattaataacaactctggnaacta

SEQ ID NO: 664017 - DNA, 101 bp, Homo sapiens
  misc_feature (93)..(93): n is a, c, g, or t
attcagcgctgcagagtgaacttttccaaaattctggaaatgtatgtgcttttctttttttcttaagggtgagtcagatgattccattctccngatggcca

SEQ ID NO: 664018 - DNA, 376 bp, Homo sapiens
gtcgacgaaaggcccacacgtcctagcagtcttcacagacaatcgggtacttcccactggcatgtttgtctcttgggatgtgatcaaaggcatcctttctcaaatttaaaatatctgaagaaaagcattttctttctttccataaatacctgaagtatcatcaaaattgcgtgcaacagacaatctctgacacttgtgtgatcattcattcttctcatgtcactgtgattttccccacctgagataaatgtaggctgacatattgattattcattcttggcggtgggaggagattttgctcatattgatcaaactgtttagggatgtttgtttatacagatgtcatgtgcactataacccagaatattagtcgacg

SEQ ID NO: 664019 - DNA, 182 bp, Homo sapiens
gtggacatccaaaactcaggtggcacttctactgaagcagttcacctcctccaactgctgaagtaccagcatgcgaacctcaactcctggaggaagaagcactccattaacaagtatgcctgtcagacacacgccagtggccagttctgaggctagcaccctttcaacatctcccgttgaca

SEQ ID NO: 664020 - DNA, 918 bp, Homo sapiens
agcggagtgctcccaacggcagagcagcgggggagataaacgaactggtgacacgtgtgctgtacattcagtcacagactgtggttgtccccagatgtgcctatgtatcgcaggagcacattcagatgaggagctggctcgtatgaccggatgtcccacatctgagagcagtgggccggtagagatacccgatcatactatgactccagacagcgaatccgcagcgaccatagtaaactgtctaagaagactgtccccctgtttcagcctacaagtacagtgagagtcttgcgacttgtgtctgcatggggtgacatcctcacttcgtgtcaattagtgaggcttcgatcgatcttcgcaggatggaatacagtccgaagtgatgagttcaccaactatatcagtaatatccggttatgtaatccactgatttgcatagtcgaccagcttacgatgtttaagctattggtatattggacttgcagaaagttaagtccttgaagcgccatcaagtcaataatacagtcatactttcaatcactacatcgcgtgcatgcttgcctgttaggaagctgcttcgatgggcggtcaccggatgtagtcactcgtctgcggccaggttccaagcgacggaagcgagctgcgagatgaaacatacgataggcgctcctattgtctgacaagtctgcccaaaccattcctgggactgaaagttgcccatttttcctttgaacttcgggttccctgaacaacttcttaactcaagttcgatcgagggtaacattctgcaagggcattcatacgtgatcagatgctctgggggggaatcatatgtcccttggaaacgttgggattgacttcaaattacagggacccaacgagcattcttcaggtgaacggttaccttttgggaatccg

SEQ ID NO: 664021 - DNA, 367 bp, Homo sapiens
aggagattacgtgttcctgcaagccgcgctatgtgtcccgaggagggatgagaacgattatctgacctctcacaggactgtggcccatgaacactctgaaatgtacacccagagtatggccttttgctggaatcttattggagccgtacgctatacgacttttgaatatcccaacacgatcaggaatacttgtaacactgggctgtatctgaatggcgctgagtctgccaagcgcactgaggaaggacatacctacgtttgcaacacttcgggtctataagccatgagctggaaacaattccctctatacggacacagaagtttttgaatgtttgccaccatgcgatgtttggtgatacagttcctg

SEQ ID NO: 664022 - DNA, 483 bp, Homo sapiens
  misc_feature (82)..(82): n is a, c, g, or t
  misc_feature (84)..(84): n is a, c, g, or t
  misc_feature (389)..(389): n is a, c, g, or t
  misc_feature (401)..(401): n is a, c, g, or t
  misc_feature (442)..(442): n is a, c, g, or t
  misc_feature (474)..(474): n is a, c, g, or t
  misc_feature (481)..(481): n is a, c, g, or t
tgagacaggttcttgttctgtcatccaggctggattgcagtagtgcgatcatggatcactgcagtgtgttgagccctggggnantacaccaccacacccagctaatttttgtattttttgtagagacagagttttgccatgttgcccaggctggtctcaaaactcctggactcaaatgatcctcccacttcagcctcccaaagtgctgggattacaggcttgagccaccatgtccagcctctattccttttcatatctgttgaatttcagtacccactcatatatgtaggtacaaaaagtgacttgggacttgtaccctttagggtaggatgcctgagtatagtaatctctaaagctgtacatgggatgggacttgttgggcatcacantgggtgaggcanccagaggcaaaggaaggagaaaacctggacccatggaattngctgtaagtttctcagaagttgagtcccattncctgaanga

SEQ ID NO: 664023 - DNA, 1153 bp, Homo sapiens
ctgtggtcttactcagaaatcagtgaacgagacagaacaagtgatatggctacagtgtaaccgtatggtccccgaggacatgccattggggcaaaactagtatgaaagcacatagatatctaacctgggcacagacttgaggaggtgatggtggaaggtggcggctgagtgagacgatgtagtagatgtagagctcagtgctggactccgagagcagtggaacattgcatggggcacaggcctccctgacgaaccactgactcctcacaccctatcgcaagccacctcttctgtctccaggaagcaggcttctagagctagcattcttgcttggaggagcaatgcatttagtttggagcattgaaatagcataagcacatgtatacaaggcctagaggtcaagctagaggcgagatgtcgcttcccatcccttgcctaatttgtctcttagaatagcacgcaggctggagctcacgaggaccgtcgggagaaggtagacaccacacgtgaacgagtgttgcgcgtacgctagtgcccgcgcattgcttaagacgaagaagtactcatcgattcccttgggccactcaagcaagtctggtgtgccacttggtgcagaatcttgacagtcctgtggtagtcctctaagtttgcctccatattgcagagagccagtgagttgtgcttcccagtatgagcgcgtctgtagcgaacgataagatggacgtattggccaggcacaggtcgcagtatttgccacgtaattgggttacgtagagaaaggacgaaaaggcgcacacatgagtgcttgaggttcatttcattaggctgcccccggggaacctagcgattcgcctcaggacagtgattccccgttccgcgaccgttcgtcccttggcggtgttcccttgtcaagattcctcgggacaagggggccattcccccgtgctaggaccaaggacgtcgccatgcaaggcccgctttagcccaggccattcttgttgaaacgagcgcttgccctctatgttccctggaggaccaaccttagcagcattgctgtttatgtatcctcccccagagttcctacggaaggaaataggggtgaaaaaacctttcgataacgcggaaaaaaactccaaaaaccagtttgggacga

SEQ ID NO: 664024 - DNA, 604 bp, Homo sapiens
tacacatgcgcaagaagccgtttacgataatacatctaaatccacaatactggaatgaattgaatcctcgtaaatgctggttcgaagctcaaccgccatgggctctatgactcttgccactgaagagtgatcatgtatgataaatgcatcggagatagtgggtgtgccaatgtccattccagatgtgtttgatacgaggacgttcgcgcttcacgggaccaaagattttgagaatggccccccagaacatatacacaccttttacgcagcgaaagtcagctacaactgtttcatccgctgcaggatattataccctccgtccgtcggaggcttctctttcatgccaagtacaggcgtcaataagcgcaaggaatacatggtgcgctagggccccggcgcgtttccccgctccagtccctcctcttaatttaaagactccctgcaccgtgtcacccaggtcgcgtccacccttggccggcgcctctgcgggactgggtttcccgggcgagagactgaatcccttctcccatctctggcatcggccccgtggagagggctgaggctgggggctgtccgtatctcaataaagagaatctgctctccg

SEQ ID NO: 664025 - DNA, 206 bp, Homo sapiens
tcgtactgcgttcataacggtatcgtaccgagtgatacaaggttactaactagatgtaaaatgcttacaatgacatagcggggacatgatagtattaaatgatgagaatgattgatgtttggctttggttgtgtttgagacagtaccattgactgttcctattacgcagatgaagaaattaagtatagagaggttaagaaacttga

SEQ ID NO: 664026 - DNA, 152 bp, Homo sapiens
ggggcccccaggggtttttcccccccccccccatttttcggggggtaaaccccaggacccccttaaggtttttttgggttccccccccaccccctggtaagtttccccttttcctgggtttgggggctttaaaattccattggggttcctta

SEQ ID NO: 664027 - DNA, 458 bp, Homo sapiens
agctggggccacccggcggcgtcggcatcgaatggcaatcgagcagcacagcatagccgtgtcgcgccagcgcgcggtcgaggagcatgtcgatgccacgatgataggggcggtgcagcgcgccgacgcgcgcttcgacctcggccaggcgcagccggctggcatagatgtcgagaccatgcgcggcgatacgggggacgacgccgagcccggcggccacacggtcgctggcctgaccagccgacggcggcagcggatcggcgatcatggccgggtcgatttcgtcggcgtcgcggttgaggtcgagataggcgcggccgtagcgggcagcgatcagcggtacgccctcggctaccgcgtcgccgagcagctcgtcgacataggcgtcctcggcgcggcggagctgcccgagcgtcagccgcgactgtgccaggaaggcgcccggatattcgcggccg

SEQ ID NO: 664028 - DNA, 713 bp, Homo sapiens
  misc_feature (16)..(16): n is a, c, g, or t
  misc_feature (132)..(132): n is a, c, g, or t
  misc_feature (164)..(164): n is a, c, g, or t
  misc_feature (414)..(414): n is a, c, g, or t
ggaggcagtatttagntgtgaggaaggttattggatttatgtgttttatctgtaacaatggttgtctcaatttctaacttcatactggtaagtgattgataaaaattggttggtgttttatgatatgtggantttttttgaaatagtaagttaaatgtagtgancaaattgtggaagagatttctgttaaataggaaatgtgtaagtttgtctaaaagctgatggttatgtaagttgcttaggcatttagatgacagcagattttgggttttgggagtgttttgtgccttttacatgccttggaggctttatggtttcagtgctgaggtggcacacctgtagcacacttgtgtaatgtgtggtttgggccagttacaaggaattgtgttgtttaagccaaagggggaagctgantgtgatttaccaaaaaaaattttgtaatttaaaccaaaatgtttgcggaattaccagtttgatactttttgtaattagaacagtgggcagtgtctgggtgaatgtgtttagcagccactgtgtgggattgttgtaacaggagtggaatgtacatatttatttacttttttaaatggtccaacagccaaatgccttttttatgaccattgtattcagttcattaccaaagaaatgtttgcactttgtaatgatgcctttcagttcaaataaatgggtcacattttcaaatggaaaaaaaa

SEQ ID NO: 664029 - DNA, 170 bp, Homo sapiens
  misc_feature (33)..(33): n is a, c, g, or t
ggcccattttgtagcagaagctgtcccacgggnaccacatgattccagtaggtgcctatgagacttcccttagcgacgtggaattcattcttgaccgaggagatccagacaccgctgttattgtaccacgagaagggctttggcttggccacttgtaggcctgcatggga

SEQ ID NO: 664030 - DNA, 131 bp, Homo sapiens
tcaaacattacaggatagagcatatgtggaaggagggtgaggactagatatgaaaaaagatgatgacataccccgggattcataatctaggagtttcctcctaggaccaattcaaaacttccaacaataag

SEQ ID NO: 664031 - DNA, 167 bp, Homo sapiens
ctctagtaggatccccgtaaaaggatgcgatcaccgagatctccttgagacgccggttctgcgagacgaccgccacgaggatcgcggtagtcagcccggcgatggagccgcccagcagcagcgacctctgcatgaggaaggccacggccagcccgggaaacaccgag

SEQ ID NO: 664032 - DNA, 336 bp, Homo sapiens
gcgacgttgggcctgtagcctctgttgttgaggttgaaatgcagctgctgtgtagctcagctcactgtagctctccacctccacatgttttaaatagttcttgtgcctcagcctcctacaggaggccagtttactggcacctgccagcacgcccagattatttatgtatttatctttagaatttaatttatttttaagttcctggatacactttctggatgtgcaggcgtgttccttaaatctgtgccatgctggtttgctgtacctattaactcttcaccttggtatttagccctgcatacattagctgtttatcctaatgctcttcccactccc

SEQ ID NO: 664033 - DNA, 249 bp, Homo sapiens
cttatacagtgctgctggaaatgtataatggtgcagttgctttggaaaacagtttggcagttcctcaaaatgttaaacagttaccatatgatccagtatttccactcctaggtgtgtacccagtagaaatgaaaacatgcccacaccaaaccttgtatacaaatgtttatagcagcattattcataagcaaaagtagaaccacctgaatgtccctcaactgatgagtgataggtaaatgtggtgtatcc

SEQ ID NO: 664034 - DNA, 226 bp, Homo sapiens
  misc_feature (98)..(98): n is a, c, g, or t
ggtttagctgcgatgtttacggggcatggtgcgtgtgtttttgaaatacactctcataatttaggcagaagctgatagtccagaaatgactatatatntgtttttttttttttttttttttttttttttttttttttttttttttttttttttttgtgggggggggggggggggggggggggggggggggggggggggggaggggggggggggtgaggttgatggg

SEQ ID NO: 664035 - DNA, 568 bp, Homo sapiens
attaaaccaaaaagaaaagaaaagttgccagttactgggattttgagatgatggtgaaaagaaagtcctaggaaatggatccacaacaggcctgcacattcatgtatgatatccttgcctttcttgacgtttttgtgtatgctgtctttgggtctcaaactcaggtgatttgtgggccacaggcacacaatgggcaagagtaaggacagatgtaagaaacagcaggccagggggaagctggaattgttggctccagctaaatgcattcagatctgaaaatattttttttaagactgattaaaaaatacatgatgagtcatgtcaaatactggccatggaccagttggtaactttaaatccttcctatatttcaaagcactgctttagtccagctgttcttagcagagggcgattttgcccctttagggacatctgtcatatgcttgagatgtttttgactgtcaaccgtggagaaaaggggcaggtatgtgacaggtaccttactcaatgagaccacggatgctggtaaacattctaccatggacacggagaggttcccgcacagata

SEQ ID NO: 664036 - DNA, 234 bp, Homo sapiens
  misc_feature (82)..(82): n is a, c, g, or t
  misc_feature (181)..(181): n is a, c, g, or t
  misc_feature (184)..(184): n is a, c, g, or t
  misc_feature (227)..(227): n is a, c, g, or t
  misc_feature (229)..(229): n is a, c, g, or t
ggccgagcatggtggctcacaccctttagtccccagcactttgggaggctgaggcatctttactaaaaatatgaaaatcagnccaggcatggtcataggcacctgtaatcccagctactctggaggctgagacagaagaatctcttgaactggggaggcagaagttgcagtgagcggagantcngccactgcactccggtctgggtgacagagtgagattctgtctnanaacaa

SEQ ID NO: 664037 - DNA, 266 bp, Homo sapiens
  misc_feature (36)..(36): n is a, c, g, or t
  misc_feature (104)..(104): n is a, c, g, or t
aatttttaagtaatccaagtagtcctgtaatgtttncactagttgatattctcatggctatgatgtaagtacctattttcccataatcttaccaggctaacttnggtctttctcaagctgataaatacctgaaggaaacttgttctttgcctataatgagatattacagatattttccccagtctgtttgttgactttgtttatgatgaaatatagccaaacttatcctttcctttttttgagacaggcttgctctgttgcccagg

SEQ ID NO: 664038 - DNA, 729 bp, Homo sapiens
gtggtcgctgtaccctgtttttttgtttttttactggggctctttggtgtttcttctatgggttattctttctgttgtatgtgacaattctcaagtgtattgtcgtaatgtcttatcagctgtccacttcgtcggtttttcgtggtttccagcgttccaggtacttattcctcagaaacgtttggtattcatgcatgtatatcagtagaataacaacgcttgcttctagtacagctgattcggggcagatgttaactgatatttcgtttaaccaatttgtaagtgtactgcttctatatattacacttctagcaaagctgtaactttactactcatgtcctaataggagaatactgtggtaatataagtatatttgttatagtaactaagttgaaataggcttggttttacagagttccagtatataagtaatcacaaattgaagacctgacagtatcttgggagtctccagtaatgtcacaaattagtgaatatagcatgccagtgtgcaagggtaatgtaaggattgttagccgatctaaatagttcaataagtactttaagaactgaagtatgttttctgatttgataagtattcagaagtgttctgtaatggattcagactgtcttcatttgtacgtataatgaaatgttgacagaccacgataacgtggtcacttagatagtgtcagaaatgtgtgtgttgtgttgtcacttcacaacggcata

SEQ ID NO: 664039 - DNA, 327 bp, Homo sapiens
ctcgcaaaaccatagtatccatcatccactccgaccgggcggccaaattttttccgcctcgtactgttggcctataagggcgcggatgcactagccctaaagaggcctccccatgacatggcctgagctgggcctccaccgactgctctgctcacccctgggctgagggaagggagagaagaggaacaagggtctccgaaaccccaaccctgaggtagactggattggccttgcggcccaggacccatacgcatgacagagcggactctgcctgagatgaggaggacttcctgctgcccccctccaccagtgccttttgcgagcgat

SEQ ID NO: 664040 - DNA, 867 bp, Homo sapiens
gcctcttaaatgtgggagtgtgcccgtactcctgggttaagagatgttcctcgaccctgcattgtgaatgttagcagatttgcgcctctactcggttggtgggagttagattcctcggcaaccctgtagtctctactcggacgtcacttacgcactacacgtcttgtagattttatctccctccggcgctctctctcgccggtttcgttgccgcgtcttctccaagccactttctgttttcttcgcgcacccccccgtcgtcgaattagaactcagcggtacttctcaacagcacttctcggactggtatggacacaccccacgcgcaaggaatttgcgccctgttcaccgcgctctcaacgctcgctacgcgcgcaccgcagagtggctccgccttactgtacctcgcccgctctaagacacccgggcggtgtcttagtgcccccacacagttgggagtgcctctatgtctcgggtcaaggacaagttgtctcccgcactcgcttcatgcacacggctgggcgcccccctcatgcgcgagtctcccccctcctcgcgtgtatacgtccacgcacacgctgacacacacgcgctccctctaagactcgcctctatgctctctctatcgctcgccagcgcgcgctcaatttatgacgctcaccccactgactcgacctaattgatcccgcataagtatagccacctagtctaacaattatatccgcgagatgttgtgaaacaatcctagacccaccccccacttcctctccaaccacctctattccgcccctcctccgccgttgatcgttcattccgctttattcccccctttaataatgataacaaatcttacacaacaaatcatca

SEQ ID NO: 664041 - DNA, 169 bp, Homo sapiens
tctacaggatcccgtcatcgtcctcatcacagagacttaagggaacgttctcctacccattcctgttggcagtatgctgtcgtcagctacgtacttggtatagacctccagtactgggctgtctccatcggaaatgttgacggccacctctacccacaagccatcctgg

SEQ ID NO: 664042 - DNA, 926 bp, Homo sapiens
gatatctgccacgcgccctttttcgttagtagggtctttccgccgcgctcttgtgcacgggcgaccacattttgtgggtctcggacatggctgtgggggtgaacaccctgttgcgcgggaccctttcttaccactggggcccttcattcctggccgtggagcgcttgtcccggcagcatgtgccccgcgtagctgtccacacgaagccggtgtagcttttcctcttccggcctctaggtaactcctcctgctggctgtccgcgtggaaacaacctggcacatccgcgccgcctctgttccctgcccttcatgggggtccctaagcatccacggccgttgcttgttgtccccctggagttttcctcccctgtgtctcctgggatgtatgggcccgaggtgttgtggccgcgttcattgtatccccagccggcgccctatctcggtgcccttggttattccaggccgccttggacccacaggcggtgaaccctcaagcctgttggctcccccaaggggagcccctctccaggggtgtcaccgagtgggcacctccgccgtagaagcttgcactcttagccgctcgcttaggagtggtgtggtcgacctggcgctatatgggtgaagccgaactcaggcgacattgttgtttgaagcggcctacactccattgtgttgctccctcggtcgagtggctaggggaatgtcaccacactccttcgtggtcttgtatctgcctggcgcgataatccacgcctagtgggcccccttgtgtaccgaggcaacaacgtgtcacttcccccccaccgcaaggatgccgcccatctgtatgtctcgcctcgaccagcccatgccgctcccacttcaccgtgccccccccctggtggacccttaaaaagaggtggtacggcaaacaaacaatgacaaca

SEQ ID NO: 664043 - DNA, 244 bp, Homo sapiens
cagtagtgagctgagattagagaatccactatttctatactcagtcttaagtatctgcatgcctactgtgtgtctctttgaactgagggagactctagtgtgtgtacgtgcgcgtgtaagtgtgagtgtaaaacactaccctaaatacaagccaacagattcatctgtggtttaaccagaattactagtgttccactccaattgctggaggaatacctcaactagtggagaagggaatcgaatt

SEQ ID NO: 664044 - DNA, 630 bp, Homo sapiens
  misc_feature (228)..(228): n is a, c, g, or t
  misc_feature (247)..(247): n is a, c, g, or t
  misc_feature (252)..(252): n is a, c, g, or t
  misc_feature (278)..(278): n is a, c, g, or t
  misc_feature (287)..(287): n is a, c, g, or t
  misc_feature (305)..(305): n is a, c, g, or t
  misc_feature (307)..(307): n is a, c, g, or t
  misc_feature (372)..(372): n is a, c, g, or t
  misc_feature (417)..(418): n is a, c, g, or t
  misc_feature (445)..(445): n is a, c, g, or t
  misc_feature (449)..(450): n is a, c, g, or t
  misc_feature (455)..(455): n is a, c, g, or t
  misc_feature (461)..(461): n is a, c, g, or t
  misc_feature (464)..(464): n is a, c, g, or t
  misc_feature (527)..(527): n is a, c, g, or t
  misc_feature (559)..(559): n is a, c, g, or t
  misc_feature (624)..(624): n is a, c, g, or t
ttgaaaaaggagccttagagccgcaagtttacgctaattggcacatttgctttatttatttatttttaaaacaaactgggttttttgaattttttcctttttgttcattccatcacattgaaaaggaggaaaacaaaaatgattttgaattcactcgatattttggactcctcagatgaacggaacattgcacacacacttggaacagagagagagagagagagaggnaagtggactcccacagggncacangcaccagatcaaataacttggatacngtgcaagantttcccaaaatgattgantnatcattaccaaaaacttgccataacaacaccaagaaacaaaaaatgtttaagccacactgtttgncttgggatctttcctgcttttttttttttttttttaaatgtttgnnccacagggggaaaggggggtagtgggngggnnagggnagggtnacnggggtgagggggggggggaggggcttcggggtggggctggggggggggtggggggggacaggntcagggggggggggggtgggggtgtgggaagncatttcttagagttcaggcatgttcttggtcagcctcaggttcctcttctttaccctcgtcctgncgggca

SEQ ID NO: 664045 - DNA, 260 bp, Homo sapiens
  misc_feature (27)..(27): n is a, c, g, or t
  misc_feature (101)..(101): n is a, c, g, or t
  misc_feature (132)..(132): n is a, c, g, or t
  misc_feature (163)..(163): n is a, c, g, or t
cggggccgaggcggaggagcggcgccnaccggggcccagccggagccgccgccctcgcccttgcctttgcctgcgcggctcagaatcaccatccgcggctngaggacagagccggccagtcccgggccgggngacccgcccgccaatggccaccaaggcatcngggttatgtatgattttgctgcatgaacctggaaattaatgaacttgacggttaatgaaggagaaatcatcacaatcacaaatccggatgtaggtgc

SEQ ID NO: 664046 - DNA, 287 bp, Homo sapiens
gacaaaaaggggccctgagacccccactttttttaggtgatggggtgaagataaagggggtttttaagccagagggggctcttttgggaaaatgtgcccgggccccccttttttttttttttaaaatccctaaagtttttccccttagaaaacaacccctgataatgtttcttttttataaagggggggtgtgtttttatcttttcgggccccttttctcttttggggtttcctcctctgttgtgccccacaaaccggtggtagaaatttgtaaaatacgtggcccg

SEQ ID NO: 664047 - DNA, 1171 bp, Homo sapiens
gaaagctgcactctgttgagctccagggcgcagtggagggagggagtgaaggagctctctgtacccaaggaaagtgcagctgagactcagacaagattacaatgaaccaactcagcttcctgctgtttctcatagcgaccaccagaggatggagtacagatgaggctaatacttacttcaaggaatggacctgttcttcgtctccatctctgcccagaagctgcaaggaaatcaaagacgaatgtcctagtgcatttgatggcctgtattttctccgcactgagaatggtgttatctaccagaccttctgtgacatgacctctgggggtggcggctggaccctggtggccagcgtgcatgagaatgacatgcgtgggaagtgcacggtgggcgatcgctggtccagtcagcagggcagcaaagcagactacccagagggggacggcaactgggccaactacaacacctttggatctgcagaggcggccacgagcgatgactacaagaaccctggctactacgacatccaggccaaggacctgggcatctggcacgtgcccaataagtcccccatgcagcactggagaaacagctccctgctgaggtaccgcacggacactggcttcctccagacactgggacataatctgtttggcatctaccagaaatatccagtgaaatatggagaaggaaagtgttggactgacaacggcccggtgatccctgtggtctatgattttggcgacgcccagaaaacagcatcttattactcaccctatggccagcgggaattcactgcgggatttgttcagttcagggtatttaataacgagagagcagccaacgccttgtgtgctggaatgagggtcaccggatgtaacactgagcaccactgcattggtggaggaggatactttccagaggccagtccccagcagtgtggagatttttctggttttgattggagtggatatggaactcatgttggttacagcagcagccgtgagataactgaggcagctgtgcttctattctatcgttgagagttttgtgggagggaacccagacctctcctcccaaccatgagatcccaaggatggagaacaacttacccagtagctagaatgttaatggcagaagagaaaacaataaatcatattgactcaagaaa

SEQ ID NO: 664048 - DNA, 247 bp, Homo sapiens
gccgcaatgttttcaagcgtcacatctgcagttgttgcaaaattcaagtctgctgcttacaacacatttggatcaccaatacccaatgatattgcgccagtgcgttaatcgcttcaataccagaagttgaatcttctaagccaatcgtttgttctggtggcaatgataaaatttcagccgcccgcacaaagatttctggatcaggcttacccttagcagcgtcgctggattcaacaatcccaacaaa

SEQ ID NO: 664049 - DNA, 834 bp, Homo sapiens
gtatttagattcctccccccattattcacaatcatattgtatttcgggaaccccaatgcgagagcgagtttgctttgaaacaatagttgtttttaaaagtttaatgtcaaataattattttttagaagtttttttttattttttaaagacaagggtctcgcgtttatggcccaggcttggagtacaggtgatgcaatctcagtccactgtgcaaccttctgggccctcccgggattaaagcagttctccgtgccttcagacctccgtggagtagctgggattacagggtgtgccccacaaacgccgggcttaattttggtagtttatagtagaagaacggggtttcaccttaccgggcgtggatctaaaatctccgtggacctcagaggtgatctaccgtggcctcgtggcctccgcgaaggtgctgtggattcacaggtgttgtagccacgtggtgttccagcctggtaacttattattttgtttataaaagagagattcttaattttctgggcttttggatggtatctggtgccgtgatagataatcatgggctagtaactcctagtacacgggtttcacagttgggtacctctcctgctattctctaattattacgccaactcaagtagttaaaaatcagtaagaaaaatgtctggagctagaagaacccatagaggaagatttggtaagtgcgaaatctcctcgtcataattgacgttctgtaaattcaggggttaagctgggccaggggtatcattaaggccgaaacaaggcttactatgtcccagaagggtattaggtaaaaatttaagtagaaggtataaggttacc

SEQ ID NO: 664050 - DNA, 964 bp, Homo sapiens
gaaagctgcactctgttgagctccagggcgcagtggagggagggagtgaaggagctctctgtacccaaggaaagtgcagctgagactcagacaagattacaatgaaccaactcagcttcctgctgtttctcatagcgaccaccagaggatggagtacagatgaggctaatacttacttcaaggaatggacctgttcttcgtctccatctctgcccagaagctgcaaggaaatcaaagacgaatgtcctagtgcatttgatggcctgtattttctccgcactgagaatggtgttatctaccagaccttctgtgacatgacctctgggggtggcggctggaccctggtggccagcgtgcatgagaatgacatgcgtgggaagtgcacggtgggcgatcgctggtccagtcagcagggcagcaaagcagactacccagagggggacggcaactgggccaactacaacacctttggatctgcagaggcggccacgagcgatgactacaagaaccctggctactacgacatccaggccaaggacctgggcatctggcacgtgcccaataagtcccccatgcagcactggagaaacagctccctgctgaggtaccgcacggacactggcttcctccagacactgggacataatctgtttggcatctaccagaaatatccagtgaaatatggagaaggaaagtgttggactgacaacggcccggtgatccctgtggtctatgattttggcgacgcccagaaaacagcatcttattactcaccctatggccagcgggaattcactgcgggatttgttcagttcagggtatttaataacgagagagcagccaacgccttgtgtgctggaatgagggtcaccggatgtaacactgagcacagtgtggtctcactacattgcccaaggtgtctcgaactctggactcaagcatccaacctgattcagctcccaag

SEQ ID NO: 664051 - DNA, 505 bp, Homo sapiens
agcggggtccccctcgcgcctctcgcagaggctcgcccccttccccgccacgtccctgcgagcgcgggcggcggggtgggcgtgtgcgcgcgtgaaggacgccgcctctctctcgctcctgcgtcgcaacggcggtggcggcggctctcgctcgggcacggcggggggcggcggcagttccggagtcccagatgagaagatgctcaaagtcacggtgccctcctgctccgccatcgtcctgatcttcgatcaacgacagtgcggaccccgggaaacgcaagcctcgtccggattactgatcgagggctccaacagggatgcgctgagacgataacatacgaggaaggagctcgagaactgggacggggtgctacaatccattgtgtacacgatgcaaagacagaagggagaccagaagactgatgctctcaaagtgttaaagaaaacgtggacaaaagaaatcgtaaaaaactgagatagaagtccttcataagcctctcaatca

SEQ ID NO: 664052 - DNA, 743 bp, Homo sapiens
  misc_feature (3)..(3): n is a, c, g, or t
  misc_feature (69)..(69): n is a, c, g, or t
  misc_feature (82)..(82): n is a, c, g, or t
  misc_feature (86)..(87): n is a, c, g, or t
  misc_feature (115)..(115): n is a, c, g, or t
  misc_feature (117)..(118): n is a, c, g, or t
  misc_feature (125)..(125): n is a, c, g, or t
  misc_feature (127)..(128): n is a, c, g, or t
  misc_feature (130)..(130): n is a, c, g, or t
  misc_feature (133)..(133): n is a, c, g, or t
  misc_feature (136)..(136): n is a, c, g, or t
  misc_feature (143)..(143): n is a, c, g, or t
  misc_feature (157)..(157): n is a, c, g, or t
  misc_feature (159)..(160): n is a, c, g, or t
  misc_feature (166)..(167): n is a, c, g, or t
  misc_feature (171)..(171): n is a, c, g, or t
  misc_feature (183)..(184): n is a, c, g, or t
  misc_feature (187)..(187): n is a, c, g, or t
  misc_feature (203)..(203): n is a, c, g, or t
  misc_feature (205)..(205): n is a, c, g, or t
  misc_feature (209)..(209): n is a, c, g, or t
  misc_feature (211)..(212): n is a, c, g, or t
  misc_feature (218)..(218): n is a, c, g, or t
  misc_feature (269)..(270): n is a, c, g, or t
  misc_feature (280)..(280): n is a, c, g, or t
  misc_feature (283)..(283): n is a, c, g, or t
  misc_feature (289)..(290): n is a, c, g, or t
  misc_feature (292)..(292): n is a, c, g, or t
  misc_feature (304)..(305): n is a, c, g, or t
  misc_feature (310)..(311): n is a, c, g, or t
  misc_feature (314)..(314): n is a, c, g, or t
  misc_feature (342)..(342): n is a, c, g, or t
  misc_feature (345)..(345): n is a, c, g, or t
  misc_feature (347)..(347): n is a, c, g, or t
  misc_feature (353)..(353): n is a, c, g, or t
  misc_feature (361)..(361): n is a, c, g, or t
  misc_feature (369)..(369): n is a, c, g, or t
  misc_feature (371)..(372): n is a, c, g, or t
  misc_feature (389)..(389): n is a, c, g, or t
  misc_feature (392)..(392): n is a, c, g, or t
  misc_feature (402)..(402): n is a, c, g, or t
  misc_feature (413)..(413): n is a, c, g, or t
  misc_feature (417)..(417): n is a, c, g, or t
  misc_feature (476)..(476): n is a, c, g, or t
  misc_feature (668)..(668): n is a, c, g, or t
  misc_feature (672)..(672): n is a, c, g, or t
  misc_feature (737)..(737): n is a, c, g, or t
gcnggcgggcagttgatcatgtttccctttgggccccataaccctaaaagggacagatcggccggagcnggggctgaagagncgannccccaaaaagggcaggcaacaaccaccngnnagacctnannantanatnccggggntgatacaacccatncnnctccanncccncaaaaccctcanngcnccggaccccatcactntncccngnnccacantccggaaaactaaggctacatgaaactccggagtactcaaatgcatccacnncggaaaaacngtnacctcnntnccctccgtacannaagcnnggncaaaaatgcagggccaaaaacaggggcngananggcctnagcacggncattgacngnnctggcgctaagatgttnggntggattaaanaacaaacctgngacngcaggcttttagtagacacggcgaaggaaaattttagcaccatgactagcctctacggntccatccaccccgcggactcggtgtacctcagcacccgcacccacggcgccgtcttcaacctcgagtactcgcccgacgggtcagtgctgacagttgcttgtgaacaaactgaagttctgctttttgaccctatatcttcaaagcacataaaaacactttctgaagctcatgaagactgtgtaaataatatnaganttcttgataaccggctgtttgctacctgctctgatgacactacaatagcactatgggctctgagnaaattg

SEQ ID NO: 664053 - DNA, 142 bp, Homo sapiens
  misc_feature (137)..(137): n is a, c, g, or t
ctttctccctggagaggttaccaaaccctggcttctcccgctgttcaggctgccatgtgggtatagctgtgtgttagtcgccagtctggcctcaggggccagaggacagctgtccagcatttctgttcatcccagcnctcca

SEQ ID NO: 664054 - DNA, 138 bp, Homo sapiens
  misc_feature (21)..(21): n is a, c, g, or t
  misc_feature (93)..(93): n is a, c, g, or t
  misc_feature (100)..(100): n is a, c, g, or t
tccgccctttcttttctaccngtgaaactcacgtgacggtgacgaccttcccacgacccccggacgggcgtggacggacgacggacgacctgntttgacntgtggtaccacggtacgcggtggacgcaactctactgt

SEQ ID NO: 664055 - DNA, 275 bp, Homo sapiens
  misc_feature (11)..(11): n is a, c, g, or t
  misc_feature (20)..(20): n is a, c, g, or t
  misc_feature (30)..(30): n is a, c, g, or t
  misc_feature (39)..(39): n is a, c, g, or t
  misc_feature (58)..(58): n is a, c, g, or t
  misc_feature (66)..(66): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (83)..(83): n is a, c, g, or t
  misc_feature (88)..(88): n is a, c, g, or t
  misc_feature (106)..(106): n is a, c, g, or t
  misc_feature (112)..(112): n is a, c, g, or t
  misc_feature (158)..(158): n is a, c, g, or t
  misc_feature (189)..(189): n is a, c, g, or t
  misc_feature (191)..(191): n is a, c, g, or t
  misc_feature (193)..(194): n is a, c, g, or t
  misc_feature (197)..(197): n is a, c, g, or t
  misc_feature (204)..(204): n is a, c, g, or t
  misc_feature (206)..(208): n is a, c, g, or t
  misc_feature (229)..(229): n is a, c, g, or t
  misc_feature (236)..(236): n is a, c, g, or t
cgacacagcgngacagcganggctatgctnttgctgtcncgacgtcttgtactctgcngctggganacncgcgcngcncacgncacgntgcgcaccgcttctgtcnccacgnacactgtgactcacacgtgcacactacgctgactgacggcaacacncacactctgcacacacttacggaacgacggngnannaantaaattncnnnggtgatgatacccaccctccnaatgaanacgggaagcaagttcatcagtaacaaaagtcagtgaggc

SEQ ID NO: 664056 - DNA, 406 bp, Homo sapiens
  misc_feature (295)..(295): n is a, c, g, or t
  misc_feature (358)..(358): n is a, c, g, or t
  misc_feature (379)..(379): n is a, c, g, or t
  misc_feature (393)..(393): n is a, c, g, or t
cctgcatagggctcggtgggagtgtaaattaggttcaaccattgtggaagacagtgtggcaattcctcaaggatctagaaccagaaattccatttgatccagcaatcccattactgtgtatatacccaaaaaattgtaaattattctaccatcaagacacatgtacacatatgtttactgaagcactatttacaatagcaaagacttgggaaccaacccaaatgcccatcaatgagagactgggataaagaaaatgtgggcacatatacacatatataccacaggaatactatgncaggccattaaaaaaggatgagttcatgtcctttggcaggggactggggtggaggctgggagnccacccttttttaacaaactnacacggggaccggnaaacccaaacatt

SEQ ID NO: 664057 - DNA, 106 bp, Homo sapiens
gttgtgagcagtgggcgcgacttgatcgtaaagtttgtcgagggcttcgcgctaccaggcaaacacattggcggcgcgggtacgtcaacgttgtaggtcgacgcgg

SEQ ID NO: 664058 - DNA, 241 bp, Homo sapiens
  misc_feature (114)..(114): n is a, c, g, or t
  misc_feature (201)..(201): n is a, c, g, or t
agaggggggcagcgcgttggcaaggggtccctcggaggtctcccggggatgggggctgcagcctcgcctgagtgcccctcgagcgttggtactctggactgcactgggggcagnagatcacatcggaccagccacctgacccccatgactggttggagctacaacgataatctccaggcgtaaactccgtcccagggcacncccctatctggggtctcgtcgtaatgcagtgtgcgtagcc

SEQ ID NO: 664059 - DNA, 1035 bp, Homo sapiens
  misc_feature (236)..(236): n is a, c, g, or t
cagatggctactactatcatgttcctggaccgcgtctcctaggaggtcattcactatatggcatatgcagcgcagacttaaggatcggtatgtgctgtaccttttgaactgccggtcagacacgaagcacaatggaaccctcacatactagagcgagaatggcgtacttgtatcacgtgctgacagtatacaaatggggttgcaggtaacaattccttaaactacatgtaccttanacaagcgtaaacaggttaggtaaacccgaatcaggagagagaactcccagggagatgcccaacacgacgtgtcctcacccaaaaggaaccacttcgttcccaacacgcagctgaactggtcctttcgtacagtggcacaacaagggggaattgtgcaagacgttacacattttccttcttgaagaaaaggtgagtggcattggggccatcattacccaaaagattacgcaaccatcttaagtaaaggccatggttagccctggaacgagggcctataccggtcacaaatttcccccccaagggaagtcggaaaaactctgggtgcagttccactgtaccacaggggcgtgggggactcatacacaccaagccaagagcattgcgcgagcaccgcattgatgttaaccttgggcgctttagcccacagatatggtcgaactcttgaccgacaccttactttgcgttttggttaccacaagatcaccctggtggtaacatgtccaaaagttcaacgaggtggcggcccaacaaaaaaatttacttgctgacaacggcacggaccggacaacaattcattggggcgccgacagtaattttggttcaagcaacaacccatcctgtgggatcaacactttagcgaataggggcgtccgtgggaacatattaccaagcgtttaccacttgcgactttctgggggcgcaccagcacgaaggaacgttcatctcattacccccgaacgaagacacctggcggtggtcactataagggcaagcgcgatcctggtcgcccacacctatg

SEQ ID NO: 664060 - DNA, 432 bp, Homo sapiens
atttaggatgtaagctaagtaatctacacacaaaaaggcagagttgcattcataattagtctctccttcagactgaatattacagacaaaatatagccattggtgttgcaatcacttcctttgggtttgtatccaagattaagaatttgggtctttggatgctgacattcttaaccttggatacaaacccaaattcttaatgtttttagttgataaagtttattcaaggtagacagcctgtgttgaataacttagtcttccacaaatttcaagaaaaatccattgtccctcttctccgccacagacacactttagttgaacattaagcatatttattaaagaaacattctccttgtgctttttctcccaagatggatggtgttcttacttagagttataagtgtcagaataaaaatgcccatgaggttgaaa

SEQ ID NO: 664061 - DNA, 432 bp, Homo sapiens
tcttcacaggaaaagccagcatcctctgctaaagcaccctggggccactaatgagcaatgggccagctatgccagccatcgcggctggtgtccatacgccagtagtggtgtccctttaaaaaccagcatggttccattgtcatccagggtggtagcatcaaagctccagccatctgaacagcgttcagtcacgtctgggtctggcttggtctcgccttcagcaccattcccatgggccctagtcggaggaagaggggtgccaatgcccagagcacagcataggctccacaacccacagtgcaccggtgtgctcacagtaccctagccatgttgagctgcagaggccacagcacatctctgggtgcacagttgaaccccctatatagagttgacagcagcaccacccacacctacatctctactgggaatgcg

SEQ ID NO: 664062 - DNA, 652 bp, Homo sapiens
aatcctacgtgacacttcagagataacctgtacagactgcagtaaacagtgagtcaatatatgagctataatatagatctcattgttacgtctggatagctctgtgttgaaatacttttttaagtgcagactaaaattatcaggaaattaaccttatggtatcagaccaattacttggcgcatggctgagattctacaattcaaggagccaagaaaataggttcaagatggaatatagtacatgcatataaggcagatgcacacatgctggttactttaagatagtgtgtaacgattagtcacaatgatagactataacatgagacaatacaaagttacatttttggaccatattaaaactgcaagaagacaggggtcttactgaagatcttttagaaaacttaaatcctgtcacaggatatatagacatgtgtagaatgtagctcaatttttaaaaagtaactgacctagagggtgaaagttgaaactgacacatttacaaattaagattatgcttatttggtacagaaaacaatgtttaaacacaagcagatctgttgtatgtaataagtaacacagagttttaaaacaaattaattatttagctttctggaagtttgcttttttccttccgaacctgaagtgtcaacgt

SEQ ID NO: 664063 - DNA, 252 bp, Homo sapiens
ggagctgggccgccagtgtacaagaccagcccaacttggacaactgccccttcatgaccagccacatctgaaaatggaaagcatttgcctttcagattacctgtgccttggagggcacaatgaccttgtcgaaatccacctgtcaggacgcctaggggtctgtaccgggctggctgtgctatcactttatgcacactccacccctgtattcccaccctggactggtggcccctgcgttggggaaggtctccc

SEQ ID NO: 664064 - DNA, 463 bp, Homo sapiens
aggttcggcttttctactagctatacaaatctgtcccaattattttcccatttaagaacaaaacaaggccaggtgcggtggctcatgcatgtaatcccagcactttggtagactccgaggtgggcagatcacttgaggtcaggagttggcaagcagtctggccaacatggtgaaaccccgttctctactaacaaatcaaaagccacttaaccggtgggttgcagtggggtcatacctgtaatcccaggcctttgggaaggccaaggcgggctgggattgtttgagctcaccaattaggagaccagcctgggcccagtggcaaaacccctgtctctagctacaagtacaaaaattagctgggtatggtggtgtgcaccctgtaagtctcagagccaactcaggaggctgagatgggaggctggtttgagcccaggaggcggaggttgcagtgagctgagatcat

SEQ ID NO: 664065 - DNA, 190 bp, Homo sapiens
gacaagttaaaggatggatgagcgggggattcgttcgaggggagacaagggagcgtgtgacagtatgggctctctctctctaactcgctctcgcggctactttaccgccgctgctcggcgacagaacacttccaccatgacacctcagcaagttccacttaaataaaggcatcaagcaggtgtacatgtc

SEQ ID NO: 664066 - DNA, 280 bp, Homo sapiens
aaaatagaagatagcaaaacttgaccttaaaattacatgggagaatacttgagactgccaagtaaaattatgagaaaacatgcactgcggagagacctgcctactagatctcataacagcgccatacatcgatacaatattgcctcgattagagaattaaagagaatccagaaatagagcccaggatatatttgagaatttgaaactaaaacctaaactaatttgatgagaaaaaggatagcttatctaattaatgatgttgataaaaccagctgtccct

SEQ ID NO: 664067 - DNA, 606 bp, Homo sapiens
  misc_feature (466)..(466): n is a, c, g, or t
  misc_feature (471)..(471): n is a, c, g, or t
  misc_feature (490)..(490): n is a, c, g, or t
  misc_feature (499)..(500): n is a, c, g, or t
  misc_feature (507)..(508): n is a, c, g, or t
  misc_feature (526)..(526): n is a, c, g, or t
  misc_feature (529)..(529): n is a, c, g, or t
  misc_feature (533)..(534): n is a, c, g, or t
  misc_feature (574)..(575): n is a, c, g, or t
  misc_feature (581)..(581): n is a, c, g, or t
  misc_feature (588)..(588): n is a, c, g, or t
  misc_feature (592)..(593): n is a, c, g, or t
tttattagataccatgtgcttttaatagctcatcaccggtaacacttcataatcaagagtaagttaacaagctagcatttaaaaatgtagactttcgtaagtgtataggccagcttgtggggaagtgaccaagatacataaggtaggagattcaagtgaccgcctggagtttctatacttcattctgcttacagaacatttattaaggttgtttaatatgtgacttttcatttgacattgtggaagtcctttattgtaaagctaatccttctgcctggtcacaagcagcagccacaacgacgatcactctggacccccacgctggataaattccatttcctcctgagacataggtttcctcctgtatttctgaggtaatgattttattaattctgcagtgtctggtggcccctgatgcatcagtaaatttggggacaaatttcctttagaatgctgggaaatacanaggantgggagggtagcgcaccanatctcaaanngtctganncactgagcttaggtttgnctntctnntagggaactttattaacggagcatgggcttcactacctgnncgaacntggtgcngaannccatttgctgccc

SEQ ID NO: 664068 - DNA, 335 bp, Homo sapiens
ttctcctcctcctgtctctaaacttaggctatatggctcttggaaccctttctctgaccccatctccactcctcttccccaatcccccaagccttactctatgtcctctgaagctcagtcagtaatcagcaaatctgttatattctacctcctctctttatgtactcttcacctttgccctaaaacctttacaattttctggaacatctcccagacaatattactagaaatactagaaattcccgcattctggaatagggggcaggcctgaagagaacataaaggaggaggaggaacacgaggcggcggaggcactacgcccaggcgagaggagg

SEQ ID NO: 664069 - DNA, 528 bp, Homo sapiens
  misc_feature (142)..(142): n is a, c, g, or t
  misc_feature (162)..(162): n is a, c, g, or t
  misc_feature (320)..(320): n is a, c, g, or t
  misc_feature (349)..(349): n is a, c, g, or t
  misc_feature (379)..(379): n is a, c, g, or t
  misc_feature (395)..(395): n is a, c, g, or t
  misc_feature (498)..(498): n is a, c, g, or t
agcggggcgtcggcgtgcgtgttccagcatgaagaggagagctggcctggggggcagcatgaggtcagtggtgggcttcttgtcccagcgggcttgcatggggaccccctgtcactcaggactttcagaggagacgcctgcngggctgcagaaacctctacnaagaaggacctcctcggccacttcggctgtgtcaatgccattgaattctccaacaatggaggccagtggctggtctcaagaggaaatgaccgccgggttcctgcaatggaccatgggaacaagccattcaattccagggttaaggcccataacagttnaaagaggaccaccatttccaacatttttngcttggctttcaacattgggaacactaaantgttctctggaggcantgatgagcaatttaatcctccatgatgtttgaaaggtaaataagattggtggtgtgttgaaggtgattgactttgtttttcatatatgaagaggcaaatatcnctttagactaaaatagttttggttttttga

SEQ ID NO: 664070 - DNA, 100 bp, Homo sapiens
ttcaccataaaaaaaaatgcagaaaatatcagttctttatagacatacaatctataacagccagtctaccagagagtgcggcaacagattagttctctat

SEQ ID NO: 664071 - DNA, 519 bp, Homo sapiens
aaaaaaaaacagaaaatcccctttattttgaaattgttaaaacccgtttttttggatttgaatttgaatgccaatactattggggtgaaaaacccccccccttgcaagttttaaaaattttaacgggggagggatttttgaaatttttttttaaaaaaaatgggtaaaaaaaaaaaaaccccttgtaaaaaagggttgggttttttgaaaaatcatcccccgggtttgtttaaaggatttttggcccctaaaaaggtaaaaaaggaaatgtgggaaaaattgtagggaaaaaaaaatcccccctgcttttaagggtttgtagaagccccatttaacattttaaaagggtttgtttccccaaaaccatttggggtgaaaaaatttaaatttttttttttaaagggcaaggaaaaattgtttttttttggccggaaacccctttttttttatttgcagattcctcctcaaaattggaaatatgccccggttttgttttcaataaaacaaaaaaatccttga

SEQ ID NO: 664072 - DNA, 114 bp, Homo sapiens
gatctatactactgacccggcatctgtatactagaccggcatctttactaataggcggcatctttactacatggccggcatctttactacatgaccggcatctttactcatgag

SEQ ID NO: 664073 - DNA, 244 bp, Homo sapiens
  misc_feature (75)..(76): n is a, c, g, or t
cagtttggatccttgcctagccttttccccccccaaatgggttttcctccaggggggcccctggaccccccccanntggaccccctccccatgggttttttccttcctttgaacttttttaggagtccctgcttgtgtggttcctgggacccttaaccaatgccttttgggaccgcccttttttttttttttttttcaagtattggaagggggggggggatatataaattaatcctgaaatcca

SEQ ID NO: 664074 - DNA, 273 bp, Homo sapiens
  misc_feature (23)..(23): n is a, c, g, or t
atgtaacttgctcacagttcaantaacaggtcaaagcagagtggggaccagaagcatgcatctcctatatcctaatgctctgtaaacctttgtccacaccagagaaaagggagatctcgagcaggacccagcaaactcacctgctctgagggatacatgcgggccttagaaatacccacctatgcctcagggcacactcacaaaaacagaaaaagacgaacggacactggacgtcacaacccagaggggtacggaccgacttgggacccacga

SEQ ID NO: 664075 - DNA, 378 bp, Homo sapiens
ggcaccccgtgtggctctcaatggtgccaggctggagtgcagtggcgtgatctcagctcgctacaacctccatctcccagccgcctgccttggcctcccaaagtgccgagattgcagcctctgcctggctgcccagtctggaaagtgaggagcgtctctgccccgccgccatcccgtctaggaagtgaggagcgcctcttcccggcagccatcccatctgggaagtgaggagcgtctctgcccggccgcccatcgtctgagatgtggggagcgcctctgccccgccgccccgtctgggatgtgaggagcgcctctgccaggctgcgaccccgtctgggagggagaagtgaattcaaacggtgctggaagggtcaaggg

SEQ ID NO: 664076 - DNA, 602 bp, Homo sapiens
ctttcttcgcttggaggaggaaaaagcggggaggacgttatcttgcattttggacaccagcttagtccatagcaggaaacgggcatcgtaatcagagtcaccactccatagtcattactaccctgttctcatgacatagttcccagattacacttctagacacatcctgggtcacaagggaacccgctgccttgaaggaaaggacccagtcctggcagcattcatcaccagcaaagtgaagagactttagatgctgaataaccagcagagatacccaggtactacactgagggctttgggtagccactgagacttgctgacttcaggcaaggctcagcacattaccagatgtgacagctacagggcaaaactgctgcttgagaaaagcagagggaaaagtaaaggggacttcatcttgcaccttaggtaccaacactgccacaggagggtagagcatcaagcgagctcttggggtccctggttccagaccctgactcttggatggcatttctggacctgcccaggccagaggggagcccacttccctgaagggtgagtccaggccaggcagcattcacacaggctgacttaagaaacttggg

SEQ ID NO: 664077 - DNA, 300 bp, Homo sapiens
gcaggaaagaccagtggacacaagaacatcataaaagcgcaggcatgaggtaagagcaacaattgtggaaaaaaccctatgtccacaagtctgggcaaatgtatacaagatgatcccacttgttctcatcaaccttccctagtacaaatttaattacatcatctgactgaacactactgactttactgaatctattccttgatttgatgttacctttcatacaaatcacagtagaaaaacgtatgaagttttttcaatacagccaagatgctggcttctcacctgtgaatatagttttca

SEQ ID NO: 664078 - DNA, 395 bp, Homo sapiens
ttcgaccgaacaaggtcgggcgttggtctgtcattcgcttcatagccggctcacgcttggggttccgtggcatgggtggtgacgagctgcagcagcagcgtgtgagcgtggtctaactcaaaggtatcaaccgcagtccgcaaagcttggacttgcgcgcgttcgccgagactttccaggcccgtgcacaccttctccagtaccgcatcgctcaattcactgtgctcaaagcatctcagcagagcctgcatgtgggcgaggagttcgggctccagcatgggcgattgaggtacttcgttatcgacgacgagtgcctcactggcctgtagctccttggcggctgactgcagcaagaggcgcagttgggtgatttgcggtcgtgcttcctcgcgcca

SEQ ID NO: 664079 - DNA, 156 bp, Homo sapiens
gcaacggggtgatttatgattggtcgcatatcgcgttttatgacgcgttttgtcagccggtggcttcccgatccactgatctttgccatgttgctgacattgctaacattcgtgatcgcgctttggttaacaccacaaacgccgatcagcatggtg

SEQ ID NO: 664080 - DNA, 952 bp, Homo sapiens
gatcacaccatggcgtatgagtgttcctctgtgtagactcaacctgcattactgaatcggcaaccccccacaccaccccccaacccacactccctcccacactcctaccacatccacctcccctccaccccactcaacctttccctccaactccactccccaccaccacacctctaacaacacacaccatcccaccctccctaccacccacccccttcacttctcctcatctcctcctccctcaccctcctcccccaccccaccatcccccatccctcactacccacaccctctccatctcacaccccacatacaccccccaccaccccgctacaccaccccaccccacccccccctcccccccacccccaccccccccctccccaccctcacccttacctcccccaacaaccactcaccccacctcaccccccaccctctacctcaccacccacccccctccccccctaccccacacaccccccaccaccccctcctcccctcccccctacccccctccccccctaccccaaccaccccacccacccctcccccccccccccctcacccctctctctcatccccccccccccccccccccccctccctctcccccccacccccccccacacccctccccccctcctctccacctcttcccccactccacctcacccaccacccccctcaccctcacccaccccccctctcctccccccactccacacatacatctcccacacaccctctcccctctcccccactcccccccacccaccaatccccccccaccccacccacaccacccacaccctcccccttcccctcaaccccccccacccacccacccccctccccaccaccccactccccatccaccaacaccaccccataccccacccctccccctccccaacccgcaactctcaccctcctcccctccctcccaacc

SEQ ID NO: 664081 - DNA, 159 bp, Homo sapiens
  misc_feature (135)..(135): n is a, c, g, or t
gccacacatgtgagctgcaggttgggactgcatcttctgaagcacagcttagctgtcattggcccttttgtcacagctggagctggagtggtgggaggctagaagacaatactgctaatctcacttattgtgaanttttaaaagtcaaactcatagaaa

SEQ ID NO: 664082 - DNA, 204 bp, Homo sapiens
aaggggtacacatacagataaagacagaaataataggtactgaaaagtacctataagggtggaagaattacctatggggtacaacggtcactatggtagatgggtacactagaagctcaaatctcagcattacataatatatccaggtaataaacatgcacatgtgcccccaaactatagaactacatactacacaaactaccg

SEQ ID NO: 664083 - DNA, 658 bp, Homo sapiens
ggctcgtgcctgtaatcccaatgctttgggaggctgaggcaagaggacactttgagcccaggagttggtggctgtagtgagctatgactgcgttactgcactccagcctgggcaacagagcaagattgtcaaataaataattatctatctatctatctatctatctatctatctatctatctatatattttttaaaggaaattggctgggtgtggtggctcatgcctgtaatcccagcactttgggaaactgagacaggtggattacctgaggtcaggagttcaagaccagcctggccaacatggcgaaaccctgcctctactaaaaatacacaaattagccaggtgtggcggtgtgggcctataatcccagctactccgcaggctgcggcagcagaatcactcgaattcaggaagcagaggctgcaatgaatcttgggccactgcactctaacctgggcaacagagcacgactttggcccaacaaaccctccctccgaacagaagagaatcgcacgaacgcagagcgcaccatccactgctgccctgagtagctctgctcaggcctaaacatctaaggcaccttgcctagcccgacgctcccacactgccgtcaccagctcgtcacacccctgccacccgcgccctctctcttctct

SEQ ID NO: 664084 - DNA, 202 bp, Homo sapiens
aggacccgccacggtagattcaccacgttttggaagatcgggttggaggtcagggcgaagagttcttcatggaagtcgatataggcgttcatgccggcttcggcatcgccggcatccaggtcttcgcgcatgtccatcagggtcaggcgcagttggccgatttccttgctgctgatcgactgggccaccaggccgacgatga

SEQ ID NO: 664085 - DNA, 587 bp, Homo sapiens
agggagaaactgaatagaggcaggctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaactaccctttaaaaggctcggcatccagtgtggaagaccagcactcacacatccggagaccttacccggagccaggctgcccctgatcatctctgataactttaaaaggaaggcctcagaagcagccccagaagcaaaagtttctctctgaccttctcctgcctcttgtctctggcttttcattctcccccaaggctacccatagaaactagaatccctcttccccaaggcaggtcatcagaaaccagaaccggttttacccaaagccagccataaaacctaaaaatagtcctctcactcccattcccctttctgtgtaaaaactggtaggaaagaaatgatctgacctaccgtgtttgactgtcgtaagatacccattccagagagggtcccaccccg

SEQ ID NO: 664086 - DNA, 550 bp, Homo sapiens
  misc_feature (47)..(47): n is a, c, g, or t
  misc_feature (49)..(49): n is a, c, g, or t
  misc_feature (62)..(63): n is a, c, g, or t
  misc_feature (70)..(70): n is a, c, g, or t
  misc_feature (77)..(77): n is a, c, g, or t
ggggctgtggggcctaccgcggtggcgttcgcgtagaacagtggatncncgggctgcagganntcgcacnatgcgcncagccggggcagggcactggtggccttctcgaagggatgaggttcttgatcggggctgccgggtgggatgccccccaattttcaaaaaaaaagggttccaacatattttttgggggccccccccccccccccggttgtttctcccggggagggggggggggggcccccccccaaaaaaaggggggcaaaaaaaggggttttttctcttaggggggggggggggtttttttttaaaaaaaaagggggtagaaaaaggggggggggggccccccccccaaaaaaaaggggggggggggccccccctcttggggggggggttttttataccccccttttggggggggggggtccacccgggggagggggggggggggaacacaaaacactgggggggggggtaaaaaccccccgggccggggggggtgggtttgggggggggttctcccccccccccggggggggggggggggggg

SEQ ID NO: 664087 - DNA, 246 bp, Homo sapiens
acgctaagcagacctggagtttagatccgaacttcggcaacagcatctggagtgcctcaatgaacagcggctgtagggcatgtactgtagacgtgtcatgtggtggtcaagggccatgccttcaaggcccaccggcggtggcttgttgccagcagttcctacttccgggacctgtttcaacaacagccgcagcgccttgttggaagctaccggcgactgtagcagccccagtctttccagcagatc

SEQ ID NO: 664088 - DNA, 598 bp, Homo sapiens
tagatagagtcttgcttgtcacctaggctggagtgcagtaatgcgatcatggctcactgccgccttaactcctgggctcaagcagtcatcctgcctcagccttccaaagctcagggattacagacatgagccacagcaccaggccaacaatatttcttaaagctcctggagtgattccaatatgcagccaaggttgaaaactaccctttaaaaggctcggcatccagtgtggaagaccagcactcacacatccggagaccttacccggagccaggctgcccctgatcatctctgataactttaaaaggaaggcctcagaagcagccccagaagcaaaagtttctctctgaccttctcctgcctcttgtctctggcttttcattctcccccaaggctacccatagaaactagaatccctcttccccaaggcaggtcatcagaaaccagaaccggttttacccaaagccagccataaaacctaaaaatagtcctctcactcccattcccctttctgtgtaaaaactggtaggaaagaaatgatctgacctaccgtgtttgactgtcgtaagatacccattccagagagggtcccaccccg

SEQ ID NO: 664089 - DNA, 489 bp, Homo sapiens
  misc_feature (466)..(466): n is a, c, g, or t
gtctgtccttgggactaacaaagtcatctgctgtttggggaaatctctggtgttgggaacaggcccccaaatctggccataaactggccccaaaactggccataaacaaaatctctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctatcagcacaaaagcccgtgagacccctantttttacgtcctcaccctaaaaa

SEQ ID NO: 664090 - DNA, 941 bp, Homo sapiens
  misc_feature (1)..(1): n is a, c, g, or t
ntgctcggaacgcaggagtacctttgggatggaaacaagagagctgggtgccatctaaccacgttggcttgttcaaactgctggaaagggtcaattggatccaaacagtttactaatagtatttaagtgacctcgagaagaggtaccaaagaagattttcccaggactgaacaagttccagaaaagactgaagaatagtcacaattctaatggaacaatatatacttaattcttttgtacctagaggggggggtttactcctttagagatagaggagaaataacatgttgccaggatgtcatattgtaaattgaaaattacattatatggagcatcacaatacggcatgtgatatatatctatatgagaaactattcattatgaccttaacgagaggagaactacttaaagggagtgggttctcatggtagggaggagaaatacgatgcgacactttgttgatgagagaaattgcgcttcatgcagacctaggtgccattctacgtgacggctctaggcggaagtattgcgggcaatagcttcggccaagaaaccacctggccttcggtgggctcagccgcggaaagtgtggcgggcgcttgcccttaggagcggggtgcctcatgatgacttggtggtggactccgtggcgtcggggcgggtggcggagggggtgcgaaggcgtctcttggcgggggggttgcggggtaaagcgagtggcgggagacagccgaactaacatgtagacatggggtcgacgccggtgtcgtcgagtcgagggggcgcgctgcgggccgtacgatatcgcgcatggtacagccgaggtaatggagcccatctccgcgcctgcggcgcggcccgtatgcaggtgcggagcgcgccgcgcgccgcgcgcgtagtggcggtgtgcgtgggtccgcgggcttccggtgcgcgctcgt

SEQ ID NO: 664091 - DNA, 400 bp, Homo sapiens
catgtttccctaaacatgcacaccatgcattaaccgtactaaatacatttccacagtgaaaacaaagtgcttctggatgttttgctacagtcagctgctttacagacaacagaatactttaggtactttggagccttctcaaaacctcatgtcttgggtggcggaaaccagcttgggattgctttgcgcacactgcctcttggcagtatgactacacaggggctccgcaatctcacacggcgaccgaaggccccccgttaagtccgacgggccccgctcaccactctcgcacaagtgtactaagctttctgggctccagcagtgcgtctcgtgtccggatcgctgctggacgaactgagatgattgccctcatacactccgcactctgtgggacacacat

SEQ ID NO: 664092 - DNA, 980 bp, Homo sapiens
  misc_feature (35)..(35): n is a, c, g, or t
  misc_feature (104)..(104): n is a, c, g, or t
  misc_feature (112)..(112): n is a, c, g, or t
  misc_feature (119)..(120): n is a, c, g, or t
  misc_feature (130)..(130): n is a, c, g, or t
  misc_feature (134)..(135): n is a, c, g, or t
  misc_feature (184)..(184): n is a, c, g, or t
  misc_feature (224)..(224): n is a, c, g, or t
  misc_feature (240)..(240): n is a, c, g, or t
  misc_feature (256)..(256): n is a, c, g, or t
  misc_feature (279)..(279): n is a, c, g, or t
  misc_feature (287)..(288): n is a, c, g, or t
  misc_feature (291)..(291): n is a, c, g, or t
  misc_feature (306)..(306): n is a, c, g, or t
  misc_feature (313)..(313): n is a, c, g, or t
  misc_feature (329)..(329): n is a, c, g, or t
  misc_feature (333)..(333): n is a, c, g, or t
  misc_feature (347)..(347): n is a, c, g, or t
  misc_feature (359)..(359): n is a, c, g, or t
  misc_feature (363)..(363): n is a, c, g, or t
  misc_feature (367)..(369): n is a, c, g, or t
  misc_feature (372)..(372): n is a, c, g, or t
  misc_feature (389)..(390): n is a, c, g, or t
  misc_feature (393)..(393): n is a, c, g, or t
  misc_feature (403)..(403): n is a, c, g, or t
  misc_feature (407)..(407): n is a, c, g, or t
  misc_feature (424)..(424): n is a, c, g, or t
  misc_feature (462)..(463): n is a, c, g, or t
  misc_feature (474)..(474): n is a, c, g, or t
  misc_feature (483)..(483): n is a, c, g, or t
  misc_feature (497)..(497): n is a, c, g, or t
  misc_feature (505)..(505): n is a, c, g, or t
  misc_feature (512)..(512): n is a, c, g, or t
  misc_feature (554)..(554): n is a, c, g, or t
  misc_feature (594)..(594): n is a, c, g, or t
  misc_feature (852)..(852): n is a, c, g, or t
  misc_feature (859)..(859): n is a, c, g, or t
  misc_feature (919)..(919): n is a, c, g, or t
  misc_feature (943)..(943): n is a, c, g, or t
aaattttttggttaaaaaaagaataaaggtatganagggtttgaggcctgagagcagtgtggtaagcccagcagggaagaagccccctatacttctctaaagcntgggtgcntggttgnngtgggaaggnaggnnctcaggggtaggggaggggatctcttcagcaattatgatgaccactgtnacctcctgggccagggttcccaggatactgagtaaggggnccaaagagtataaacncagctgtgagaatgcntgtttgctgggcctcatcaaggnctccaggnnctnagtgcaagggaaganggaaaanagagaaaaaaggtganaganagggatagataganctggtggttggngttntggnnngtncatgtttttgctcctgnnagntgatggtacngagnatgagactgtgaggtangggccccatcacatggtgctaacataatctgcgatggnntgggatgagtnccatgagtngctaaccacatggnaggtagcncggtgcngccggatggcttccctggctgtgactgcatcctggtccagcnagttttggaagaggcgcaggtgaccaaaggctccacggcnccagcgctccagccgcttggcgaactccagaagcccatctggcttgatgcagttggaactgatgtccagctgacagagagaggaggatgaatcctctgagaaaacatctgccaaggccagcaggccagcattccccaggcggttccctggcagccggaggccttcagtgtggagttgcccttcatagcagcaaccatctcaggcagaaattgggctgggcgcttctcaaacagacggcagaaggagaaggtaatctcntgcagantaaaattctgtagcaaaaagagcacctcgctctgacagtcagcgagattcatgtcatggnagctcagtcttttcagggctaggntgtactctttgagtgtttgcaaaaaagcccaaaatct

SEQ ID NO: 664093 - DNA, 105 bp, Homo sapiens
ctttatgttgcgttgggaccctgggtgcttgtatgccagtcccctcggctgcagactctcctttgggtccgaccaggccgctgtgacccagttctcctttatccc

SEQ ID NO: 664094 - DNA, 109 bp, Homo sapiens
aaagggggctttttaaaaatggggggggccttttttttccaaaacttccaagggatttttttgaattttttcccaaaattttaagcccccttttttatcccggttttta

SEQ ID NO: 664095 - DNA, 823 bp, Homo sapiens
agtgactacgtctacagtcaaaagttctcaacctatcttaggaatcttactttacttcaccaaaaacgtgtgtgtgtgtgtgtgtgtgtgtgtgtgtgtacatatatataccatatagtgtacacgctagtgtgctttagttaaaatacaaacgcctcgtgtagaaaacgagaagaattcgtgaaatcaccccgtgaaaaataatttattttctacgtgctatctcataactcgtgtactaaaatcaatttggaaaaattaagccccccttctctaacgtggtactctctctctttatggaaggttgtcagtgcacttcaacaattatttctagttacatttctttacagagagggactttattccagagataattcaattgttgtgggatgagtgtgcaatctttggcgtgtgggggggtaggagtgtgtgggctatggctagtttaagagggaaactctgtgagttggcgtgcttatatccaaacactttaaccaaattcagggtgttaacaaatttatattaacaacgtttagcaggttctatcagtgattattagggctacttgaagtgtagaggaggagaggggggcaggtggggaatacttactaggggaatgcaggtggcgtgtatatattgggctagaaaattatggatttgtggcaagattgtctacgtggtgtactatgatataggagtatctccccacttatacttttaaaatattcggctgtgtcatattaaaagatccttgaggtaagagaggacctttaaccctaagggaatccagaaggggtaatggggggggggggggtcaacaatc

SEQ ID NO: 664096 - DNA, 918 bp, Homo sapiens
cacactgtcacgctggctaattgtttttattgtattttagtagagacgggatttcaccatgttgcccaggttgttcttgaattcctgagctaaggcaatccgatctgctcgtggtgcctcccaaagtgcataggattacaggcagtgagccagccacagcatacttgtgcccggctgtagctatgttttaaaagagtcacctagatataccttttttattttggtgggcgagggagtctcactgtgttgcccaggctgaagtgcaggggtctcgatcttggcttctgtggctcagatagaatccccgactaccgggttcaagcagttctcctgcctcatgctccggagtagctgtggactacaggtacatgccacgcatatctggctaattatgagtatttcaagaatagatggggtttgcaccatatggttcgggctgttctccaagctccctgacttcaggtgatccactctgcctcggcctcccaagagtgctgggcttacagggcttgagccaccgtgcccaaatctagtatactgccttgaaatatggtagctcgaaagagtctgtggtgcctcagactgagacgggttgtagacggagtcaaggcggttgacagcccatttgcaacacgcttacgttctatgcatggtgagtggtgactttttgctagtaatagacatcgaacagacttttttacacttgaattacttatgttcccacttagtgtccctggtctggaccggcaattaatgaggtgaatcggtcccgtactgtttaccgtacttcttagtttcaccagactggtgtatgtgtgtaaacatcaaccgtcggcgggcctgcataacgcggagtaccgcgaattgcgtggcgaaaacacgagtggtcagagaacacgctatgtgatgttctcgtca

SEQ ID NO: 664097 - DNA, 666 bp, Homo sapiens
gctggaccgtgagatctgggctgaaacacggttggtgctgatggccacagacagagggagcccagccctggtgggctcatctaccttgacggtgatggtcatcgacaccaatgacaatcgccccacatcccccaacctgggagctccgagtgtcagaagatgcgttattgggcctcagagattgacacaggtaacagggaatgatgtggactcaggacccgtgcatgtggtatgtgctaagcccatcatgggccccaggatcccttcagatgttggacgctatggaggccagtgtctccctcacggggacccatggacatttgagcagatgtgacacagctagcagactgcgaagctgctggcacatgatgggcctcatgagggccgtgaccaaccatcacagtgctatgtggaggatgtcaatgacaatgcaacctgccttcatcacagagcctcataccaggtaatgctgcttgagcacacaccccacaggacagtcgccattcatctccgtctctgccactgatcgggactcaggtgccacgggtcacatttactacaactggattcccctgcgatggcttcagtgttgaccaaacactgggacctgttcacaataagtgggaacagtggcttggcatggagggtcaggagcagtggctgtga

SEQ ID NO: 664098 - DNA, 121 bp, Homo sapiens
gagtgtctcaatgagatcgtgagtatttgcagaccaaccaggtccatagcaggaaactggaagtccagagagccagcaggagcaacagtgtgtccaacaatgttgtcacccggaggaagtc

SEQ ID NO: 664099 - DNA, 215 bp, Homo sapiens
  misc_feature (184)..(185): n is a, c, g, or t
acatatttcaaatatcaattgatttgttcttgccctatgcaagtaccactcctcgcttccttaacagtacccgtggcagaattgtaaaacggggcccaccaagtcgcttgagtgattctagctgacatcctctttgcataaatgaattaattagccacgagtggtaccggagtctacagaattnncgtaatcatagggtcatttagctgggtttc

SEQ ID NO: 664100 - DNA, 150 bp, Homo sapiens
ggcacgagggggtaataactaaagttatatagtaactatagtactatagtattatatatatatatatatatatatataatactatataggcgatactactataaaaaggctatagtatacaatatatagatataggcaattaaagaatat

SEQ ID NO: 664101 - DNA, 251 bp, Homo sapiens
cttttgttaaaatttttccccccccccttattggtttgccccctggggtacccccccttacccccccttttcccccagggtttcaagaaatttaatttagggggcccagaaaatgcaaatatttctccttttttgtttttttttttttttaatttaccccaacaaccgggtttgggaacctttttccccccgggttctttaaaaaattgggggggttttaaaaaatttttttttttttttttgccccccca

SEQ ID NO: 664102 - DNA, 295 bp, Homo sapiens
  misc_feature (201)..(201): n is a, c, g, or t
acaggatctctgatgtatcgcccaacacaagaaagcagtcacatgaatgtttttggtttcccaatgcatataaaagttatgtttacactatactgtagaccagcaagagtgcaatagcattgtctaataaaacaatatacatacctaaatttaaaaatactttatagctaaaaaatgctgattatcaatctgagccatcgntgagtcgtactctttttgctggtggagggtcttgcctcgaggttgatggttgctgactggtcagggtggtggctgctgagtgttggggataaca

SEQ ID NO: 664103 - DNA, 229 bp, Homo sapiens
atgacgagtaatctcctgaaaggctgggtcggacactctcccgggtggcaccagaacaagaaaaggttcggtaccatgtctgtagcagccgtggaaaagaggtgttataacacaagatctcaaggaacgatggacggctgtaccatatgcgtacaacgatgatgcagttactatctgacgatagaagaacacctgaactgtaccatttctcaggttgagccggatataa

SEQ ID NO: 664104 - DNA, 114 bp, Homo sapiens
ttatatccgggtacaacctgagaaatggtacagttcaggtgttcttctatctcagatagtacctgcatctcgttgtaccatatggtacagcctcatactcgtctcttctctatg

SEQ ID NO: 664105 - DNA, 1295 bp, Homo sapiens
gccggtcgccagaagctgggtttgtcgcaaaacctatgtgaccccacggagacccttcgagaagtcgcgtctcgaccaggagctaaagttgattggagagtatggactccggaacaaacgtgaggtttggagggtcaagtttaccctggccaagatccgtaaggcggcccgggagctgttgacgctagacgagaaggatccccggcgtctgtttgaaggcaatgctctcctgcggcggcttgttcgcattggggtgctggacgagggcaagatgaagctggattacatcctgggcctgaagattgaggatttcttggagaggcggctgcagacccaggtctttaagctgggcctggccaaatctattcaccatgcccgtgtgctcatccgccaacgtcacattagcctttggagctgacagatgtgagcttacccttgagggttcagaatcgtgccctgcaaacagcttatgggggactggggacagccttgtttccccatagcccagcgcaagggtcactgcggctcaagccgtacaccttgtgaaggtgtctgccaggcactcaagcagctggacaggtaacagctcttggtgccaccccccctggagggagattggagtcaatgttgaggtgacaaagctgtctgtggaggtacaatctaggccttcattgctatatttctacttgttaatttgccagttgagaatgcacctgtctgaagtgactggggtaaatgaaattgcatgctcgttaacccttctgtaaatgagcaccaatcatgacagctatacagagtgaagtctcagatttctttctcaccagctttcgtttatgggcagagatgtactcttgtctgaggtggtttgagaccacatggcattacaatgtggacaggaagcaaatcaaagcattagtatgggcactcttgttttccttccaagttactgagtctgaggtcaggagtgcctgtgagcctgcttgagtcaaagggcaggaccaaatggttcagcctcactttgtccccttattctgttcttcctgtccagggtccgcaagcaggtggtgaacatcccatccttcattgttcgcctggactctcagaagcacatcgacttctccctccgttctccttatggcggcggccgtccaggccgagtgaagaggaagaatgccaagaaaggccagggcggggctggagctggtgatgatgaggaagaggattaattaatacttggctgaactggaggattgtctagttttccagctgaaaaataaaaaagaattgatacttgg

SEQ ID NO: 664106 - DNA, 292 bp, Homo sapiens
ttaggggcccaggggccgggggtcgcttttgccccccagttccagccccgtttgggccccctggtgaacccgttttcccccgaaatttgccgggggggggggcccccccccgtggtccctgccccccggggggccttggggggggggtttcctgggcccggggaggtccaacctgtggtggggtggggtcccccccctgcgctttgggcctgggggcccgggtttccccccttttcccaaaaaaaaaaaaggggttttgccggtgttaatttttttttgtttttttatttga

SEQ ID NO: 664107 - DNA, 184 bp, Homo sapiens
gctctgactcagcagactccacgaaaatgcagcccactgaccacatgtccacggccgtgagagtattcctaagacgccaggagaggtgttcaggaaggccatgtgcccgcgaagctgtggagaggctgcatgcggggacagggagaggcactcagtacgcccaggtactcaccgttggcaccaa

SEQ ID NO: 664108 - DNA, 221 bp, Homo sapiens
  misc_feature (50)..(50): n is a, c, g, or t
  misc_feature (87)..(87): n is a, c, g, or t
  misc_feature (115)..(115): n is a, c, g, or t
  misc_feature (124)..(124): n is a, c, g, or t
  misc_feature (172)..(172): n is a, c, g, or t
  misc_feature (181)..(181): n is a, c, g, or t
aacgcgagcagagaacgaaaggagaagaaagcaaaggttttgggaatgcnaaggggcctcattttggctgaagattaataatttttnaacatcttgtaaatattcctgtattctnaactttttnccttttgtaaattttttttttttgctgtcatccccactttagtcacgngatcttttnctgctaactgttcatagtctgtgtagtgtccatgggttct

SEQ ID NO: 664109 - DNA, 108 bp, Homo sapiens
atgttgctgacgcatcctgagagcagtcctccttttccacctgagctcttcctcctacacatcatagcggtgccggagctccaaggacagctaggacaaccaggacag

SEQ ID NO: 664110 - DNA, 291 bp, Homo sapiens
ctttcctgttgattaaaaacatggctctcttatacaggtgcgtgactggggaaagccctgagggcaaagtctcactctgtcacccagtgctggagtgaagcagcccaatcttggcttactgcaacctccaccccctgggttcaagcaattctcctgcctcagtctacctagtggctggtgattacaggcgcccgccaccatgcccaggtaatttttgtgctttagtagagatggggtttcaccatgttggccaggctggtctcaaactcctgacctcaagcaatccaccca

SEQ ID NO: 664111 - DNA, 320 bp, Homo sapiens
cccaactcaaccagtggggtgaaagagaaatccactctatacgctggctcatgcctgaatctcagcagttagagaggctgaggcaggaggatcacttgagcccaggagtttgaggcctgcccgggcaacataatgagacctcatctctacaaaaaaataaacttaaaaaaatttagccctgtgcagtggcatgcatctcaccctggggggctgaggtgggaggatcacttgagcctaaggaagatagagctggcagtgagctatgatcacgctacagcactcaatcctggacgacagagtgagacgctgtctcaaattaa

SEQ ID NO: 664112 - DNA, 257 bp, Homo sapiens
ggtcacacgcacggacaggagggtcgtgggttctgacatggtgacccgtggaactctccctcgagtcgacggtccgtggggtcgaccctatctccgtgcggtgattggcccaggtcccagggcccgcagggtcgaccagcatgtccctggcagacgtggggccctgcttccgagggcccgcgtgggtcgaccagcacgtccctggctgactgtgggcccagtgtccaagaatcgccttctccggatgtgcgtggtgt

SEQ ID NO: 664113 - DNA, 775 bp, Homo sapiens
  misc_feature (213)..(213): n is a, c, g, or t
  misc_feature (537)..(537): n is a, c, g, or t
ggtaatcatcatagtatgcattctaatcggaagggtattcttatctgcttaccgatcgcgacacaatgctatgctatatacaactaggctgaggccccaacgtagtagtccctacaggataatataacctttgctgacgccattaaaggcttcaccaaggagtccctgaataaccgcgccaaatctaacatcaatccctcgtgacatgtcacngtcccggatctgtaagcgtcatcggcaatacagcgtacttgctgattgattgaaccccgcgcatccctcgataacacgctagaccccccatggtgtgtgcgtacaagaagctttagggtcgtacgcttgatttatattcgtaagcgctccctacttagtctttagacggttgagtgcgtttcctcctggatcaaatggttgtagtcattgacattgctgacttagtcccgtggatacggcgtccacgtgtcaaagaagcctaaacccaaatgaatgcttcatgatgaagcttcactcatgatacattcatttcctgacttgtcnaacaagttcacctatatgaagtgggctcccttttaacacctcgtctcaactcgcgttatcgatcagacgacaaacgaaacacctctcgaattacgtgccttggcagtcaatggagtcctttggcgtcatgatatagatgattagtgctccaacaattagcgtgaggacctaaccagaggccctccttcgagcttgcggaaggggagtcgaagtagtctcgaggctacaagatcaatgc

SEQ ID NO: 664114 - DNA, 481 bp, Homo sapiens
  misc_feature (296)..(296): n is a, c, g, or t
attaaaattactaccaccaaccaccttcccacccacaacacaaggtctctaagcactcactctccacacaccccctccacggcgggtggacgcagcaggtgcggttggggcacatgtatcccgaataaccaagggcatcctactctcacacccaccacccctagtcaccattgtcaccaccctaacccatcacacacaacctcttttatatacccatccccccaccctcccctcacaccccgcactcaccccttccacccacctccccccatggcccgtgcacgcctctgggcccncttgacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagcaatgtcaaa

SEQ ID NO: 664115 - DNA, 108 bp, Homo sapiens
gacagtgaagcgccccctaccttgtgaaagctaggcatacagccaaaccctcctctttcccacccaccaactacttgccaatttcctaggtcaccatgggtgtattct

SEQ ID NO: 664116 - DNA, 1278 bp, Homo sapiens
  misc_feature (135)..(135): n is a, c, g, or t
  misc_feature (149)..(149): n is a, c, g, or t
  misc_feature (258)..(258): n is a, c, g, or t
  misc_feature (388)..(388): n is a, c, g, or t
acagatccgggcagagggacagcgccaggcccagtgagtatgatggccctgcatgaatcatcgagggtcaacgcatggaggtctgtagatcagtccacacatacgcgctcgtgcttgtctggaaacgattggcgnagtgtgactttaangtcttgcgtcgatagccttgtggactagcgagctatgtcgcatgcaatgaccatgccaaaagatcatctatccggccggtatgagtaggaatgggcaaagatggatgtnctgagtgaccaatagatcatcctaaagattagctgaagtggcatgtaagcccagatcagcagagccgagcggatacacctttggggagaggcaggacggcctcaatttacaacaacgctctcagagaagntttcgagaagaatagagacaacaaaaccatataagtatacataggtgagtggggggcgctcgggaacgccttactaccctttgtgcaacactccaagggggggcgccgacactgtcttgaaggatttcgcgcctgttctttgtgtgtctcaccaagggggcgggtcaaccacataggagtggagtggaagacacgtaagtctcctggcaaggcacaaagagggcctccaggggccgcaatttccgttttcccataaatagttgggttagtgatgggggtggccatggccaggggagaaaccctttgggaaggcacttattgggagtgagaaagggtactcccattccttacttaacgtgggcgggggagcgcataccccaataaatggggaggtaaaaaactaaacaattggggtgaaagtagattatgtaagttggtccttagggaggggagaagactttttattcagcttctctgggacaaagtgggggttatttcgtcgtggttggttctccccattggaagtgtcgccgggggaaacaatgggatcagagatggttctgagatgaaaacaattccggggagggttacgggagaggaaatttttgccttgggaagctaccaaggggttattcaatgttcccgcagacgtgaataatgagacataaaaaatgagcggacaggagaggatttatctaaaaacgaagggggaaacacggacagagggggatgctgtgtaaacccctctcgtgcaccaagcagaattgtccacacattatcagccggggtacaccctgtggcccccttttgtaaggtggcctgtggtacaccgaaaccctaaggcgggaccagggtttagttaaagaccatgtgtgtcaaacattcgtgat

SEQ ID NO: 664117 - DNA, 251 bp, Homo sapiens
tctagaacattcccttgctagtccaactaacaacaggtgctgctctaagagaaactccagaggaatgaggaaactgagggctgaagacagggagcagacaggagacaaatgtaccgaaaaaaaagattcaagctaatcctaccccagcatcctcctgtcatgatctctggcaggaagaacaaaagaaggtaatccataaagacacagcccttacttagaaattctgacatagacagcaagacaaatctgct

SEQ ID NO: 664118 - DNA, 1018 bp, Homo sapiens
taacaggcttcgccttgcattgtgcgtagtcatatatataaagcctctatgcgcgcggtgcagcacgccttaacgtgcgtgcctcttcattgcacgtcataatatgatcctccaggtggcatataccttgatgtgtccccctgtccatgtcctactaatcgattctatcatcctggtgctgactcacactaaagcacaacgtaagcgccactatcggcgcacaatgcaatggtggcgcaccgtcaattacagaggaaagtcacgatacgcagggggctcatcacaatcattcatgcgtgctgcgcatgaatggtctggcaaatacggaaaatccatgctgttgacttacctcgtgtgatgtgtgctcctctgcgacgactctcgtcagccacgccttgttacaaacctgcatttcctcttccctgaaggcatcataagggaatggtgctgggccgctgaggctgatcgcctgcagggcaaatccccctcaaagtccctcacgccttgaggaaatgcgccatcctattgaggtcggattcatgatagaaacggacgacagcctaagatcaagttgggatccagccggcaagcggggccattcataatttgggatcccgggggatcgaccaatggttgccgggtgtctggtacagaggcctgtgaacagaaacgtgaaccttttttcatcttcaattgcctgatcacttttcaggccttggatggccctaagggataacgctggtgccatcccagtgaccccatcgtccaggggttggtccgcatagcaggactcatccttcttgggattcctgggcacaaatgttgcggttaacaacattccgctggtggtggcaaagcccggcgacagggtttaggggggggcaggatgtcctgacttccaagacaagtgggcttgacgttcgcgagtgttctaacggcccccaaaccagggtagaccacgatttctcacaggcggatgtagacgaacgcggacacaagccacaccgcgaaaaaaatg

SEQ ID NO: 664119 - DNA, 260 bp, Homo sapiens
tatagcggtcctctctgcttcatgtgtcctctcaacattcaagccaactagcgcttgataatagtgacaatcggcatcaaccaaccccacctagcatttacttcacatctagcatgcacgctttcttcaaagcaatactattcatatgctccggatccattatccacagcctcaatgacgaacaagacatccgacaaataggcggactgtataaagcaataccattcacaacaacaccaccaatatcaccatcatcacca

SEQ ID NO: 664120 - DNA, 175 bp, Homo sapiens
acaagccgggagaaaggccagatgggcaagctgtccttctcatggcttcccctaagactagtccccagtgactcacagtcccactgttcccattacagcagagttgcggagatgagcagacacccttactctgcagtaaggacacctggaaacctacccccaaactaccctcagc

SEQ ID NO: 664121 - DNA, 166 bp, Homo sapiens
tccggtatagagtggcatgtgaagatgtgtgctgaatgcctggaggtgagagttacggagggtggagtggggcgagagaagcctgagccattagcaggcgcagagtctacagggatctgcaaaccacattgaaagtccttggactacatcctgaaggcagtgctga

SEQ ID NO: 664122 - DNA, 297 bp, Homo sapiens
gaaaaaaggggggccctttttttttatttttggggggggaaaaccccccaggccgggggcgcccgggcccctgggggtggtttttttcccgggaggggttcccgggcttttttttttttttttggggttcccctttcccggtttttggggggggggctttttcccccccggccgggggcctggtttttgggggggttttgggttttttttggggaaggggttttggggggcttcccttttttttccccccccttattttttgggcccccggggttaaaagggtttttttttttttta

SEQ ID NO: 664123 - DNA, 327 bp, Homo sapiens
gggactatattgggctgggaagattctgcgaagcaggggaaacagtcagcggagtgaggagacaatctgtagaacgggagaatatgtgcaaactatttatccgacaagggactggtattgagaatatacaaggaattcaacagcaaaagaaaaatcccttttaaagggtgggcaagggacgtgaggagacatttctcaaaagaagacatacaaatggccaagtatatgaggaagtgtttaacatcactggccatcggggaaatgcatatcaagaccacgatgagatatcaccttaccccacttggaatgactattattaaaaagacc

SEQ ID NO: 664124 - DNA, 264 bp, Homo sapiens
acgcgttgacatggagactgtagtaactcagaattaaacgctgccatattgccagtgttagccgctgcagtatgcatacctgtaggacaacatgccatccactcctgtaagaacaagcacaataccacaacttaacaaagaaaaggcttatgcactgtcccttacattttggtattctttgttctacaaaaacagaggcaaaacagaatcacgtccagttcaccacaagttatgcacacccgtggcgagcaagtttagcggcat

SEQ ID NO: 664125 - DNA, 806 bp, Homo sapiens
cgcagttggatcactgcccgcaatcccaataccctggcaggccgtgcctgaaggatcactcgaggtcaggagttcgagaacagctggcagcatggaaaactcggtctctacgaatgacacaatgactctagtccaggcgtgttggcgcagcaccgtgcaactcgcagcgtacgtccggaggcttgaggcaggagaatcgcccgaaacctcgggtcaatgtcagtattttagtgctcagccatgttgagtcaggtttttcccaaatttcctgagttcggatgatccacacacctgtggtgtcccaaaggtgctgcgtgattcacatgaggacacgattggatcacctgaggtcacggtatgttcacagtatgcagccatggctcattaggatgatgaataccgccgagtctccagataaggaacaaaagtattagcgccgggcgcaaagtggctcacgcccgaaatccccaacaccctgtgtgaggcccgaggcggggaggatcaactcgaggtcaaggagtccgagaccagcctggccaaacatggcgaaactcggtctctacgaaaaactaccaaaaatcagccagggggtgattggcgcacaccttgcaaatccccagctaactcaggaaggcttgagggcaggaagaatcgcccgaacccagggtagacaagaggccgcagggggccaagattgtgcccttgcacgctagttctgggtgacagagcaagactccttcccctgtgtagaacacgagacttttttcacccttgtggttttaacacagaattcttcgttgggagcg

SEQ ID NO: 664126 - DNA, 512 bp, Homo sapiens
ttaaagtttagagatggatcataatgaattgtgccaatatttttctttgagagaaatgtatactatgttataaaccacaggtttcgggggagaaaggctggaggtttaaacaccctatttttgattctgaaaatgatattaatagaaagtgtcggtcacagtctgattatatagagacatctgccctaatggttgtgatacatcgtcatgaaatgcaaaacccctacagttgtgggcatgcacaagaaaatttccaaatacctaaagtgtgggcaggtgaacgtcctgggtggaatacgaagatgtattagacgtctttgtctctgcctacttgcggccatatgcttgtgaacggaaagtaaaagaaattccccttcttatacatttgtgctggcctgtacaggctcaggcactgcctcatctgttaaccgaggaccccatggtctgtcccatctttctgaagccaacctgctgatggtgacagttgcttcttcatgaaagcaagcaactgt

SEQ ID NO: 664127 - DNA, 196 bp, Homo sapiens
tagctgcagatgcttacctaccacggtcgtctccaccagaaaagatcgccaagtccgtgcgatcagattgtgacttacaaaccgtgtttaaaagctgctatacatgacttctgtcccttaaaagcttaccctatggctgtggacctctgtgttatgcctgggataccttccaagcactcattacgcccaggttacg

SEQ ID NO: 664128 - DNA, 298 bp, Homo sapiens
tgcgtgtgattccagaggatccccgcctaagtggtatgctccgaggcgagtgataccgagagctagccagcacgaaccctgagtccagacggccagctctgtggcaatccagccacatcaggcttccctgtacagatcctgcgctatctctacctcggctgcgccaaggactccaccaacctggacgtgctcggcaagtatggcaatcaagtatatcctcaaggtcacacccaagctacccaacgccttcgagcacggtggcgagttcacctaaaagcagatccccatctctgaccac

SEQ ID NO: 664129 - DNA, 265 bp, Homo sapiens
cattgagcccctgtgatgccttgagttctagtttggaaacgttatttctaatttctccccagtccctagctcccagataccagagctggtcccagaacactctccccttcactgggaacagagccacatccaacatccctattctatcggccatcatctgctgactgtggtctaagggatgtgtctggccccctagcacaggccctgagggccaggagaagatgaggttgctaaaactccaggacactaccaggccctcctcagt

SEQ ID NO: 664130 - DNA, 348 bp, Homo sapiens
  misc_feature (226)..(226): n is a, c, g, or t
  misc_feature (243)..(243): n is a, c, g, or t
gtttgctgtctgatatttatcattttaccaaatgggaatgtgaacacaaagagaaaatattttatttataaacaaaaataaataaaaacatggctgggcatggtggctcacacctgtaatcccaacactttgggaggccaagggtggaaagaacacttgagccccaggagaccaagaccaacctgggcaacacagtaagaccccatctctacaaaatttatttttnattagccagggaaggtngcacgcacctgtggtcccaactacttgggagactgaggtgggatgatcacccgagcccaggaggctgaggctgcaatgatcacaccactgcactccagcgtgggg

SEQ ID NO: 664131 - DNA, 361 bp, Homo sapiens
  misc_feature (218)..(218): n is a, c, g, or t
ggcgcataggcttcttacgtgttgaacccctcgtgtaggaccttgagctcttcctaactgtttgttcatggtggtgcggggttctacgcctgtgattcccctcactttgtgaggctgaggtggttggatcacctgaggtcggtagttcgtgaccagcctgtccagcatggagaaaccccgtctctcctaaaaatacaaaaattagccaggcgcctgtnatcccagctactcaggaggctgaggcaggagaacatgggaggcagagtttgcagtgagccaaaattccgccactgtactccagcctgggcaacaagagcgaaactccatctcaaaaaaaaattaattaaaaaaaaagttttac

SEQ ID NO: 664132 - DNA, 214 bp, Homo sapiens
  misc_feature (4)..(4): n is a, c, g, or t
  misc_feature (24)..(24): n is a, c, g, or t
  misc_feature (70)..(70): n is a, c, g, or t
tttngaaaatttttaaatccatgnttgccccaacccctttggggtggggcagaaggttaaagattcccantttattaaaaattcaggccctgcagggccctataaaacctgtggccatccttgagccccctgcccccaggtgccttgggccaaattcattgccccccttgggccccccttccccctaaaataaatttaacagtttcccgtggta

SEQ ID NO: 664133 - DNA, 106 bp, Homo sapiens
  misc_feature (2)..(2): n is a, c, g, or t
  misc_feature (8)..(8): n is a, c, g, or t
  misc_feature (60)..(62): n is a, c, g, or t
  misc_feature (69)..(69): n is a, c, g, or t
  misc_feature (89)..(89): n is a, c, g, or t
tncagcantttccagcagcgggtttgccgccagaacacaggtgtcgtgaaaactaccccnnnaaccccncatgggaaaggaaaagactnatatcaacattgtcgtc

SEQ ID NO: 664134 - DNA, 448 bp, Homo sapiens
caagatctacacctgtgactctaccctataagacttcatccgccatcttatgcagaccatagtgaacggctcctacacgctcaccatacaagcccatagtctaggaatatgaataggcagagacaaacataaatgccctgtacgatgaagaggcgcacagcccaggcatccatatcaccatcaccactgacaaagccttagtaggccatgtcaaagaacgcaaagagataccttttctatacaccactgttgctatattccttccgctgtaccggacgcgggtccactcccgtgagattgtgggcgcaggcttgcagacgaagaacactctgctctggtatttttgaaatatcctccacagcgcctgtgaagtcaaaaccgcaagtcttgggtcatactaccgataaccttgtagctgcatgccagcatccctgaagatgggtgtgtg

SEQ ID NO: 664135 - DNA, 187 bp, Homo sapiens
tggtgattacaggattgtctagcggcagtgattcgtgtgctagaggtgtcagtgcgctatacatgcagctgcagcagtgtcacatcacaccgagagagagcagtgactcttcccacacctcactgcacctaggactcactgccataggatgctggcactccagacattaatccccacccaacagatg

SEQ ID NO: 664136 - DNA, 619 bp, Homo sapiens
gcactttgggagaccgaggcaggcagatcgcttgaggtcaggagtttgagaccagcttggccaacatggcgaaactctgtctccatgaaaaatacaaaaatgagcagggcatggtggcacatgccaataatcccagctactaaggcggctgaggcaggagaatcacttgaatccgagaggcagaggttgcagtgagccaagatggcaccactgcactccagctgtggctacaacatagggtttttatacaagaaaaataaagtgaattaagcgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagaggggggggcgccgacgaaaaataagctaccccgagaggaggacacggggcgcgacacccagttgtgaggacagaggggcggacccaaaggaggaggagcgatataagaaagagagagggagagggggaggcaaaaaaaaagagagagcgggacggagaaacaaggaagcggcacgggaaaagctgaggagaaagaaaaacaccgacggggcgggcgagacagaataagggcgcagcgagaaagacgaga

SEQ ID NO: 664137 - DNA, 333 bp, Homo sapiens
ccgacacagcacatgtaccagatcgtgccaggtaaaactactaaacactcatacatcgtagcagagattaagttctattaccagataagaattgaagagaatcaaggcttgcatagcaatctagaggacatacctgttgtgggggttgatgagcatgatgacttggatgagagacttcttcattcacatgcagactgtgtgcattctcatggttctctcctataggcttcaactggttgacttgaggcatggatcatacacatcttctctgggcgggggcctgaagaagcctctagtcttgatgacttgtgaccataaagtagagaattgtct

SEQ ID NO: 664138 - DNA, 272 bp, Homo sapiens
tggcctactgggtgctgtggggaagggttaaggacctttaaaccccggagcgaggctctgcttacccgaggccgctgctgcgcggagacccccgggagaagccaccgccatcatgactgaccaggaggcaaaaccttcaactgaggactggggcgataagaaggaaggggaatataggaaactcaacggcacgggacagcagagagaatcacttcaacgtgaacatgacaacacataccaagaaacacaaagaagcatactgccaaagacag

SEQ ID NO: 664139 - DNA, 302 bp, Homo sapiens
gcggtcacctccgcgtaaattacattcccggccctgccctccctccggtggaacttcccctcaccgccagacttaagctgaggatcgttggatctcttgcggggttacagactaaagcccaggccacagaaccctattaaacgttctgtgcttgtcccaaggtttaaagtgatcctcccgcctcagcctccccaggtgctgagattacatggatgagccactccacctcgaaaggggccagaaatgtgaagtgctacctgaaggatgagcagcagctagccaggcaaagggggcaatggcgg

SEQ ID NO: 664140 - DNA, 622 bp, Homo sapiens
tctggatccttcatcacagggggcagaagacaactatggtggggtctggcaattggagttttactccccggcaagtgatgaatcttaacaactgtgcacctgttagactggtattattttaactgggtttccctaactttaacatagagatgaattacttagctttgaggaagttgtgagggaccagtgagggcgtatatggagaaacaacgaacaatggaactggcacaggtgaagtggtcaatgaagatctggggaaagattggacaactctgttctgacactggatggtaacattggtagtcagcaacttccctttcccccagagctggtgaaggcctgaatctgggcgaaccctcttccatggccccagttcacagaacttcccatatgtagttcccggacatatagccagtgactgatgggtcctggacactttcactctcactggctcatctggtcctctcaagaagcctatataagaagcgcgaaacagttggttccttggctgggtgtggggggctcattgctggtgttccagcactttggggagaatgaagcgggtggatcacttgaagtccagagtttgataacccctggccccttgtttcccgcttgttct

SEQ ID NO: 664141 - DNA, 510 bp, Homo sapiens
  misc_feature (11)..(11): n is a, c, g, or t
  misc_feature (20)..(20): n is a, c, g, or t
  misc_feature (59)..(59): n is a, c, g, or t
  misc_feature (103)..(103): n is a, c, g, or t
  misc_feature (119)..(119): n is a, c, g, or t
  misc_feature (132)..(132): n is a, c, g, or t
  misc_feature (155)..(155): n is a, c, g, or t
  misc_feature (190)..(190): n is a, c, g, or t
  misc_feature (227)..(227): n is a, c, g, or t
  misc_feature (354)..(354): n is a, c, g, or t
ctcccttgtgncctagagcncccagaattcctagtcaagaaggtacagcaaaattccanggtctcctacagacctgacccagtttgtccatcccgggtgtatnggtttcctttcctganggtaccatagatnaccccacccccaggagtttagtnacatataattaaagtactcccagaatggttccatnggaataaaatattcctaacccaaaagtgtgtttaggnccaggcacagtggctcacccctgtaatcctagtgctttgggagataaggcgggaggatcacttaaggccagaagtttgagaccagcctgtgcaatatagcgagaccctgtctctacaaaaaattctnaaaattagctgggcatggtgacacacggctgtagtcccagatactcatgagggtgaaatggaagatcacttgagtccaggagtttcaggctgcagtgagctgtgatcacaccagtgcattccagcttggatgaggcagcaagaccctgtctcaaaa

SEQ ID NO: 664142 - DNA, 831 bp, Homo sapiens
gggcgacgacggggagccaagcatgaatccactgctctcagggtgagggtaagagcgggacacggtgacttgagtccagtagatgatgacttgcctggagtatgattagagagactcagtctcagagtcatgagagttacaagagtggtggataagacaagattatcataagctggagtgggaaggactactgacgaaggaagagatttgacatcttctgagagaggggcacagagtcctggcagaagactctgaagaaagatcgctggcactgaagaagagtcgcagaggaaatatgggtgggagtcaacctgattttgggaacgtggggcgatggcaaagggtacagatgagttatccaccatgaataaatacaaatgtctgggcaggaaaatcagggagtaataggtgaaagtgaacagcttgttttgctgaaaggtggggggcaaatggaagggagagtggttgagattttcagactccaagagatattcacggaaaaggttttgcaacaggaagctgagattgacagcattcacgagttagttgtgggggcaacgtgaaatatcacggaaggcaccgaagacgtagagaaggcattaaaaagaaagtgggtacgggtggggatccctgttcttctcgaggatggggtcttttcctcgatcttcctcgaattggtagacagaaggcaggcaggcctcgagaaagttttagacatcgttgggggggcagagggatcgagaatggttaagtgtacaaggaaattggtgatggaggtggtttcaaagaacgggaaagggtgaagaagggttggattggataaggcaggga

SEQ ID NO: 664143 - DNA, 258 bp, Homo sapiens
tgccttgggctcggttaggttgaagccaacgcggctgaggcctaccccatctggcctcgtcgcagcccggggaaccgatagcagggcggttccccgggcgctccattctcatgcttcggcctgcttttgcgccgcccaagcgaaattgcggctggcgacgggaatgcccgcttgatagagccggacattcatacgccggttgatctcacgcccgacgccatattgtttcagcggccgcgtacggatggcggccttgat

SEQ ID NO: 664144 - DNA, 256 bp, Homo sapiens
tgtatccccctggagccgttttctccttataaaagtatttacatacatttacaaataaacaaccaacatcttaaccaaatacaacacttcagactataattaattcaacccaaggtatcatagtattctacactgcatgaaaattacatgttgatagatctttgagtaccttagaagttagtctaatattaacatattatcaggatccagttaggtactattctatttctttaattattccttctgtgagcaacag

SEQ ID NO: 664145 - DNA, 632 bp, Homo sapiens
attaaaagctaccgcagatgatacaatcatcaaaattcaacagtgggaaattctaaccacaaggtaacaacacaaaaagaatggaaacctatagttctccttggttagtggattttgggaaaaattcattcacacgtagccaataaacacattaatatctgggatggattaggagacataaaatgtgggacgagcttagctgactacacattgcacaagctgtggaacatttccttgtagttccactgggcgtaaagtctcttaaaatatccttcagaatacaatggcacatgtagtgatgttggcttactgtcacttcatagcacggcaaattaaataaagtaatcggtttatgatattgattatggctccaaaatacccgcaaactggaaatatctcacattgcccttacatgtgcggtgtggagtaagtagaggtagatttactatttctggatccaatatatggggcacctttccagagttgctctctaccagagctcattattttcaacgaatggtgaaacgaatcagacccctggatcagaaagaagtggaatgacaatacgagtcaagacagtatagttgcggcttcataagatagaatatttgcagttggtaatcattgagatg

SEQ ID NO: 664146 - DNA, 845 bp, Homo sapiens
tcagccttcttcgggcctcggcagcggtatgctggctcgctcgcctcatgccccagcgcccctcggctaccctcgtgccccaggcccgcagcgcctgccctgccctcggcctgcccctgacgcctgtgccttagtgtgcctgctggctctagagccccgtggctacgcgtaaggctgcctgaccgtggtcccgggtccctggcccccttaatggggccccgggctaaggagtgcgcctgtctggccgacacggacccatgcggagagcccccggataagcataggacccggaaggggacatgccgggtaagcttagccggggcgcgctacagcgcaatacgaaaccggctaacccaataccggcccgcaaggggcaccaacataccgcgccataaaccaagggcaggaagggggccccgtcacactacagcagggagggtgcacgaacaaccccatagtgtaattggaacaccccgtatggcagaggaacaggcgacagtcgcgacgcgacgggaaacgccttggggtacacccttttagtaccctgaacgaccacatgagccagcgcaatgaaaacaggccgtggcaattgtagcaacgcgcactaaaaaacgcatcaaaggccccataggaaagtaggcgcccaagagggggacaccgaggcgagaaaaacccaaccaggaagcagcgaaccgggaaaaacaagacgtataccaggcgaagacacggggacactcccaccgaaagcgacgcgccaatagagagcaactgacaaggaggtgacccacacaccgagcagacagagacggacaagggacgacacaaccgccagagaagagacggct

SEQ ID NO: 664147 - DNA, 156 bp, Homo sapiens
atcccttccaaaagtgagtttgagtaaataaatgggttaacaattgagagaaattaaacattacataaatacttcaaaagagacagcaagaatgacactgcctcttaggccagttattccagatgcctgaacaggtttaaggtatatggtcgctga

SEQ ID NO: 664148 - DNA, 372 bp, Homo sapiens
cccacacaacaggtttgaatcgttctagtaatcattatctagagtgatgatcataacaggttgacacagtggtcgttcaaagcacatgcatagttaccctagagatcaatccttcagatctatttaacgttcagaactaggtttggcttgtaacaaacataacttattgcgtggactcccagtctgttttaattagtaaaaggagggcactgtgcgagtggtggacagggaacaggctgtttgtttcactaacataggtggtttattaagagatcatgagtgaagtctcaggactcgcgttgggatttacagttagtaataaaagttctccccaatcaatgttaatcgatcaccatcacaatcagatgagag

SEQ ID NO: 664149 - DNA, 1763 bp, Homo sapiens
gtatttttgtgatgatttttagaggaacaatgtggtagccaaaactttgttcccaaggattctccacaagaacttttttacaaatgacagcttgaaaaaaaatactcgtggcacggataacctcaaagtttgggcctctaacaagtggtccccttataaacgcggggcgaggacaattttaggaaactcacaaatttgggcacattaaagaaagtgtccgcgaacgagccagtgttttccattattacagccaactcaaattagaggacacttatagtgcaccttaagagccaagagggtaacactttctcttgtggaacactttacacaattctcttattcaccaaactgtgagcgtccacacctctcgtggcccgaggtgagtgagaaggtgtgagaaatttgtctccacaacacacgctctcttaaatttatacattacgtgtgccaggccaattctgctgcgggtactatccccgcgtgatgagtgggcgcgtggtggtgtttctccacacgaggcgagtgtttatatagacacgaacgcgtgggcttgggttcaccaacatcataaataagcgcgtgggcgaggccctatatatatctcccccacgcttatgtgggcaacacaacaacgagtgttataaaattcttaatgagatttctccaaaattttggtgtgggcccaagtgtgtgagtataagcgtgtgatatatttatacactgttttgtaaaaaagaaaacaaacaaccacccatttatccgcggggggtggggagcgaggggtgttataaaagagaagaggtgtttaatagataataactaccgaaggctgtgtgggtgtggcaataacaactttaagagaagtttttacaaagcaggcccacaatatacgcgacatatagtgcggcttcacaaggcgggtggaacacctctttggggtgcaaacagtgtaaacaaacaacactactcttgtgggggtcatattaacaactatggggctcttatgcggttatatttggaattcccctatttttgcaaaaaccccccaaataaggaaggcatatttacacccccccctttggggtgggtcccccctggtggtcccaaggggaaagcaccaacacgcactgattttttgggacaccagtgtgctacaaaaacacatattctctataagaaaaattagtggcccccaaggcttttattagaaggagtccttccaacacacgcacaaacctctagggagttttgttcctgggggaccatataccacctcggggtgacgcaaactgagagagggcaaatatttcctgggtgcaacccacacttctcttctttggggacaaacgtggggttccttcaaattaccccttgatcacattacggcgctccagattccgacgataaaagagccctataaaaacaaggaagcggcgggagggagggttgtgagagatcatccacccggacaagagggaggaacaccccaattagcagtattctcatgaagagggccatacccggagagcacaaaaccatcctcttgagatgtcagagcagaagaggaggggcatccccaaaaaaacgacgaggagccaacgagcggggagggcggcagcactctatcatctaacacagcgacatcatacatagcaagaagtactaactcggggagagacagtgatacaaccaagcgggacgtacgcgagagtccatgtgcgtaagaaactacttatactgtcgtctctcagccagagtccaga

SEQ ID NO: 664150 - DNA, 1658 bp, Homo sapiens
tttttttttttattcggttcagtctaatccttttggtagtcactcattaggccagaactttagggcttaggagtgagtgatttaattaagaagggagtgcacattaacttatttagtgtggcgaggtatagtgtgttgtgtagggctctcagtggttaggggttaaaagggagggacaatttctagaactccaaatataatataagaagagggtaaatagccatactataagaagagaaattcttctcctcaccgctataagcgaggtgtacaacctctcgcctttcccacacccttatactatacaccattataagcgaacaaaatacacccacacccccgagtgtctctcgagcgcctctatactctcacagctctccacagcgcaccatatataagtgtgtgtagtagaacgagcggggatctctgtgtctatataacagtcattgcgccggatttcaccaacccccctataaggcgagaacacaatatatgcccacacctataaatctccacaaagagctttcatagagccagctatagtggcttatgagggggcgcgctataaatacaagcacagctctgcgtggtctgcgagcagacgaggtctctgtgagcgcccccgctcctttaccagacacaaaggagtgcgatcccctctcgaaacaacacaaatttgcggatcagccccgttttctgctcaccacatgctactacaagagatctccaaagcctatacggcgacacccctccaacatacaatataaggtgtactaaccaaaggctcgccgggagcatattcaacagcgacaagcaccccaaacgatgcctataagaaccatttcttcgcggtgtgcacaccaatctttggtgtgtagccccacaagcggccccctgttgtcctttctacaacgaggaggcccccaacgtaaacacatacataaattgtcagtaaagtggtggtcggagccctgccggcggggggggtgtccaccactatgcctgaaacgtccgcgaagcacaaaagccgctcttttatacacccacacggtggagcagcaaaacgagaaattattcttctgcggcagaacaaaaaacatatctcaggggggaagggggaaccggtggcgcttcgaaaacacacagccgcaatataaccccctttcagttaccaatgctctttcgcacataaacagacacacacaccactaagaccaaagacaagaaccatacgatacaacgacatagcacacaccagccgacacgacccgacaagaggcggggcgggggccggcgcagcacactaaactaaaaaagaacaagcacacccccaacagaagaaggtggcgagcccacacaacggtatactaaccgagccgaccaccacccagcaagtcagttatggctgtgtgcacacacaaacagcggcgggacgacgccacccaccgacacaagagagagaagcacgagcgcgagctactcatatacatagcaaacagcagcaaacagaaacaacgaggcagccgacggcagagattagtcaaacaaaacatcagcgctgacacagtaatcggcaggggacgaacaaaccagctgactaccacgccgggtggacaacccaccttagcgaagagcaaggacaaccaactacaccgagg

SEQ ID NO: 664151 - DNA, 622 bp, Homo sapiens
tcttgtggggggacatctgtattaatgggaggaccaaagtagaggagggctccaatgtgggggtgggctggggcaggaacgggcgggattgggggcagggcctaagaacccggaaagtgtgcaaaacaccccaacccccaagaggtctgcccttgcaagtgctatgcagctgtgccagggcagggggctacagggaactgaggctctccgaggctggctgggacaacactctccctctccccaaaatatgggcccccaagaagccggccagtgtggctctccactgtggcatctggggaccacccagtgtaacacaggccgggcacatctatcccctaatctggacacgggttctcccctgggagagaccctctgtgtcaggctatgtgtcccatggggagatcttgggtccctgagatgtgatgtgagaccgtgtaagagatctcccaggggggaacaccctactgtgcctctctccgagaggttcccgccaaggggagaggtgtgcaacattacattcacatcccgcaagaatgtggaggggcacgtttgggccccaatttggggggcaagacggcatggggcgttggggcgcccggtgggagggtggcaggggtgtggt

SEQ ID NO: 664152 - DNA, 715 bp, Homo sapiens
gtatgggcttagacaaatgtatgatgatatctacaattatggaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagttgttaaggataatggctccagccccatccatgttcctgcaaaggacatgatctttctttggcaaccactttttactgtcgccatagttcttccttttctagaatgtcatatggaatcatatagtatgtagccttttcagactggcttctttcacttaataatatgcaattaaggttcctccatgtccattttcatggcttaatagtgcatctatttttagcactgaataatactccattgtctagatgaatagtttatccattcacctattgaaagacttcttgtgtggtttccaagtttggcacttatgaataaagtgttgtaaccatcaaaaaacaaaaaa

SEQ ID NO: 664153 - DNA, 402 bp, Homo sapiens
gccggaccggcttactgaggcagaggcgggagaatggcatgaacccaggaggcggagctagcactgagctgacatcgtgccactgcactgcagcctgggcgacaggccaagactccgtctcaaaaaaaaaaaaaaaaaaaagtttgcttctaaaccccttggttctggcaggtgtctttccctcctttccttacgggcccaaaggtttttaattaaactttccttcctgggtcctcaaaggtaggctctggatctaacaagtgtatggggggggcggccacttaaattgggattccctataagtatttgggtggtatcccgggcctcaaagaaaacgcggggggatcctctaagagtcaccctggcgggcttgcaacctggggcttggggccgtcgtttacc

SEQ ID NO: 664154 - DNA, 915 bp, Homo sapiens
  misc_feature (457)..(457): n is a, c, g, or t
tcgcaaactcttctaaggtttcgcatggctcggtaccctttgtcgcccgtctaaaccccatgggtgtgacacaccacgtgtttggccgacccatttcctctggcccccccagcgagatgttgtgccaacggcggcaaaactttgatgttgggccacacttatctgcgctgcctaaacacatctgcagtgtactgtcccccgccgcgcccctcttcatccccccgtggatagagcagtagcgctggtttctgcttatccaaggggacaccacagtcaagcccgcaacccattctattgcaataccacacaatattggtcacaagagtaccacaactgtggcaggaccaccaatggaaggacttttcttcccccaaagaagaatgcttaaagaactccctttgggccacctaatataaatgaaaaccacttctgttagtaatatacaatgttgtaaaangctgcactcacgtctcctggaagaaaccaacgctggtgatagtagcacccgcactatgcatgtttatgagacagagtttctactccgcaacacacactgttcctgctaattgcttgcgcgcacacttcccccacttgttactacactcacgtttttcggccagagtatcttccctcagaagcacaccgaatctcttagtggggggacactcgctaactactcgcaggcgtggcttctttgatacattctgtgccccgaaatggctgtaaaatgcagggcgggggaagtcatccccagcagagactcacctccagacaacacgccccgggcggttttaattcagcctcccgtgatgcaatcgcaagaacgcccaccacctctgacgcagccttcaaggaagctggcgattcattattatgggcgcccgctcataatctcacccaatcaaaacaaagcca

SEQ ID NO: 664155 - DNA, 660 bp, Homo sapiens
  misc_feature (541)..(541): n is a, c, g, or t
  misc_feature (658)..(658): n is a, c, g, or t
  misc_feature (660)..(660): n is a, c, g, or t
ggtggtctcctcactatgatggttttatttgctgtgcaggaagctttttaacttgatgtgatcccatttgcccaggcatgtcccagagagtttccccaatgttttcttttagtggtttcatagttggaggtcttagatggaggtctttaatctatttgattgattttgtacatggtgagagataggggtccagtttcatttttctgcatatggagttccagttttcccagcaccatttattgaagaaactgtcctctccccaagatatagtccttggcaccttgcgccaaaaaaaaaaaaaaaaaaaaaaaaaaaaaattgtggtgggcgcggcgcctggggcctaagagaaaaaggttttaaagaacccatccgtgtgggggcggcggggcgcccacgatagtggtatgtgtgagaccccgggcgccaaaaagcgcgcgtcccaaaaggagaaccccggggcgcacgaaccacagggggctggggttctcctgaccaaattaaaaaaagcggcgccggggcgaaccacgcgagggcgttntgggaaacaaccttcaagaggggagcgtcgggaggggaccataacaggcactctacatccagccgggggggtcacaggcagaggccagaaaacaaattagcccgccgcagggagaangn

SEQ ID NO: 664156 - DNA, 880 bp, Homo sapiens
  misc_feature (58)..(58): n is a, c, g, or t
  misc_feature (95)..(95): n is a, c, g, or t
  misc_feature (138)..(138): n is a, c, g, or t
  misc_feature (156)..(156): n is a, c, g, or t
  misc_feature (161)..(161): n is a, c, g, or t
  misc_feature (184)..(184): n is a, c, g, or t
  misc_feature (224)..(224): n is a, c, g, or t
  misc_feature (299)..(299): n is a, c, g, or t
  misc_feature (326)..(326): n is a, c, g, or t
  misc_feature (349)..(349): n is a, c, g, or t
  misc_feature (373)..(373): n is a, c, g, or t
  misc_feature (376)..(376): n is a, c, g, or t
  misc_feature (408)..(409): n is a, c, g, or t
  misc_feature (451)..(451): n is a, c, g, or t
  misc_feature (466)..(466): n is a, c, g, or t
  misc_feature (474)..(474): n is a, c, g, or t
  misc_feature (477)..(477): n is a, c, g, or t
  misc_feature (551)..(551): n is a, c, g, or t
  misc_feature (578)..(578): n is a, c, g, or t
  misc_feature (584)..(584): n is a, c, g, or t
  misc_feature (593)..(593): n is a, c, g, or t
  misc_feature (651)..(651): n is a, c, g, or t
  misc_feature (799)..(799): n is a, c, g, or t
  misc_feature (804)..(804): n is a, c, g, or t
  misc_feature (808)..(808): n is a, c, g, or t
  misc_feature (812)..(812): n is a, c, g, or t
  misc_feature (880)..(880): n is a, c, g, or t
acccgagcgagcagacgcggcctggcgcccgccctgcgcactcaccatggcgatgcanttcatcttctcagatacagcggtgcttctgtttgatntctggagtgtccacagtcctgctggcatggccctttcggtgtnggtgctcctgcttctggntgtantgtatgaaggcatcaaggttggnaaagccaagctgctcaaccaggtactgtgaacctgccaanctccatcagccagcagaccatcgcagagacagacggggactctgcaggctcagattcattccctgttggcagaanccaccacaggtgtatttgtgtcacttnggccagtctctaatccatgtcanccaggtggtcatcggctacttcancangctggctgtaatgtcctacaacagctggattnnccttggtgtggtcttgggctctgctgtgggctactacctagnttacccacttctcancacagctnagntggtgaggaacgtgcaggcactgaggctggagggacatggagccccctcttccagacactatacttccaactgncctttcttctgatggctattcctccancttatncccagcccntggaaactttgagctgaagccagcacttgctccctggagttcggaagccattgcagcnaccttccttctcagccagcctacatagggcccaggcatggtcttgtgtcttaagacagctgctgtgaccaaagggagaatggagataacaggggtggcagggttactgagcccatgacaatgcttctctgtgactcaaacaggaattncaaanattnaaancagggagaagggttcttggtgatgcagggatggaactggacacctcagctctctgctttgtgcctatn

SEQ ID NO: 664157 - DNA, 326 bp, Homo sapiens
gagacggggactgagagacaggactagctggatttcccagtccctaagcctagctgggaaggtgaccacatccacctttaaacatggggcttgcaacttagctcacacccaaccaatcagagagctcactaaaatgctaattaggcaaaaacaggaggtaaagaagtagccaatcatctattgcctgggagcacagcgggagggacaaggatcgggatataaacccaggcattcaagccggcaacggcaaccccctttgggtcccctgcctttgtatgggagctctgttttcactctatttcactctattaaatcttgcaactgcg

SEQ ID NO: 664158 - DNA, 555 bp, Homo sapiens
tagaaaaaagccgctctcacctcccgtacactaaaggtgtattatactatcttgtgtgctaacttacttagagatcctgtacttaagataggggatatgtaagctagctcaagctagcttttaggacaatcactttgtctaactcagaattatccctaagaagaaatctggtcttgttacacaacaaacttttattttgtgctcacctaagtttcagactccactactctcacagctattttgataacaatgacactagaacacttcactccatttcatcattgtttttgcatgaatatcatacaaatcagttagttcttaggtcaagggctaactacttctgggtctttcgccattaagttcacattataattagtgccagaattttagcaacttcacagatcgtgtattgacatttcttaaataacgcttcagatattattgctttagtgcttttttgtattggttaaaactgtacatttaacattgttatgttcctattttttacaattaatagtttgtatattttaaaataaattagtcgttaaaagtcaa

SEQ ID NO: 664159 - DNA, 303 bp, Homo sapiens
tgagacagggtcttactctgtcacccaggcaggagtgcaatggtgagatctcggctcactgcagccttggcctcccaggctcaagcaattctcgtacctcagcctcccaagtagctgggactacaagggcacaccaccacgcccagctaatttttgtattttaggtaaagacagggttttgccatgttgcccaggctggtctcaaacccctgggctcatgcctcggcctcccaaagtgctaggattacaggcgcaaacttttcttaagtatgaaattatttcaaaatagaaaggtcgtcgacg

SEQ ID NO: 664160 - DNA, 779 bp, Homo sapiens
gctcatcaggacgggatgcttcaagatttaagtgcaggcgtcttcttccctccttgttcacaacacagaacattagctcaggtacctgacaatgatgagcagttgttccagactatcaggctgaaagttggcttttcatggcctcccactgaaaatcaagaaagaaccccacagcccatgttcagaactcgggtctgcttgcagtcaagagcagccctttaaattcagctatggagaaaagtgcctgtacaatgtcagtgcctatgatcagaagccacaagtgggaatgaggccctccaatcccccgacaccatccagcactccagtgtccccactacaccatgcatctccaaacacagctcatactccgaaacctgaccgggccttcccagctcacctccctccttctcagtccataccagacagcacctaccccatggaccacagatttcgccgccagctttctgaaccctgtaattcttttcctcctttgccgacaatgccaagggaagggcgtcctatgtaccaacgccagatgtctgagccaaacatccccttcccacacaaggctttaagcaggagtaccacgacccagtctatgaacataccaccatggttggcggtgcagccagccaaagttccccctcctttgatgatcaaacaggaacccagagatttgcaatatgactcagaaggtgctagctgcaatccattatatgacggcagaaggcttccgggtcattcaagcagaacagaacgctgctgtttgagaaggtccg

SEQ ID NO: 664161 - DNA, 501 bp, Homo sapiens
  misc_feature (1)..(1): n is a, c, g, or t
ntaggtcttgtaacggaaaggtgtccctatccagaccccaagagagcattcttggatctcttgcaagatagaatttgaggcgaatccatagagtaagcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagctttattgctcacgc

SEQ ID NO: 664162 - DNA, 575 bp, Homo sapiens
taacccctccttagcttttgcgctcaaaaaccaaattaaacccccccccccttgtaaagggggggcgggaaaaaagcaaaaacgcacaaacccgccgggaaaccaccaggtccggccccccgcaattaatcgcccgggagtgggattagggtttacatcgtgccccgtgttggctggggctggagaggaggggggagcacccgggggggcaagggccacttgagccccccatgggagaagctcagagggaagtgtgaaaaaggccacgttgccgcccgggctccggggagacagtggagtggtccccagaagtccgtgaggccgaaggggggggttggagcagggtacctccctacgggtgctcacgagagggtgaccctcgaagaggccaacagagaggggagcaacaggagatagcgcctgaagcgatgccccgaagggaaagggcgcaaaaccagggtgtactacaacaggagggggtaccaaacagggcagggcacagggatgcaccgccataccgaaaacatagagagaaacccaccaccaactcccaacggagaacatttatgccagac

SEQ ID NO: 664163 - DNA, 235 bp, Homo sapiens
taagtctcgatgatgtcatgaggtgcacaagctggtcatgtgcgggtaaaggatgctggtgatggagagaacttagttatgatcggttcctacattgtctgagtgttggccagataggctggtactccctggactttctagcagctgaagtctatgccttgggggtgaacgatgagggagagcagctagaagaggggcacacctctcttgtttaggcttccaaggaaaatcagaa

SEQ ID NO: 664164 - DNA, 107 bp, Homo sapiens
tttgatgccccttttaagtgccattgtaccgggtagcatagatgaatgtttaccaaaggactatgtattccaactcatgggtgtatatatattgcttggaagttttg

SEQ ID NO: 664165 - DNA, 390 bp, Homo sapiens
cacgagggggggtcctacgctgaaggaaggagctgaggactgctagcatgggaaccctggattgcctggtttgccaggctctatgggagacatggtgaattatgatgatatcaagaggtttatcagacaagagatcattaaactgtttgatgagaggatggcttactacacctctaggatgcagttccccatggaggtggcagcagctccaggccggccagggcctccagggaaggatggcgccccatggcggccaggtgctccagggtcacctgggctccctggtcagataggccgagaaggacgccagggtttgccaggaatgagaggattgcctggtaccaaaggtgataagggagacattggtgttggcattgcaggagaaaatgg

SEQ ID NO: 664166 - DNA, 161 bp, Homo sapiens
gaagtgtcttggagcgcttcagattcagctttaaaggccaggacggggccacacggtggctgggctgtggctcgtcccagtggcggcacgtcctttggcgtctctaatgtctgcagcttaagggctggcacttttttaaatattaaaatgggtgtattttt

SEQ ID NO: 664167 - DNA, 734 bp, Homo sapiens
  misc_feature (50)..(50): n is a, c, g, or t
  misc_feature (62)..(62): n is a, c, g, or t
  misc_feature (96)..(96): n is a, c, g, or t
  misc_feature (120)..(120): n is a, c, g, or t
  misc_feature (143)..(143): n is a, c, g, or t
  misc_feature (152)..(152): n is a, c, g, or t
  misc_feature (162)..(162): n is a, c, g, or t
  misc_feature (199)..(200): n is a, c, g, or t
  misc_feature (209)..(209): n is a, c, g, or t
  misc_feature (214)..(214): n is a, c, g, or t
  misc_feature (216)..(218): n is a, c, g, or t
  misc_feature (231)..(232): n is a, c, g, or t
  misc_feature (277)..(277): n is a, c, g, or t
  misc_feature (299)..(299): n is a, c, g, or t
  misc_feature (328)..(328): n is a, c, g, or t
  misc_feature (360)..(360): n is a, c, g, or t
  misc_feature (364)..(364): n is a, c, g, or t
  misc_feature (603)..(603): n is a, c, g, or t
  misc_feature (610)..(610): n is a, c, g, or t
  misc_feature (620)..(620): n is a, c, g, or t
  misc_feature (726)..(726): n is a, c, g, or t
tcaatggtacagtcaaacatcacatgtacagaacacccaatttcgatgcnctgcaattatangataaaataaaataaaatccattttcagcaaacnaaaatcaaaacattaaggatcccngaaatattcttaaaccctaatgngatttcacnggactccagncattttgtagtgggacattcacaatatgaccctattnncccagtctnggccncnnngggggccggatgnntggccgcatcggacactctgacaaaaaatggtaaccagtttttgntctgaaaactcctcttaatttngctctgaacacatcaatcaagcttttggnatgcatcctcctccttgcccctcatattttanaccnactgttgttcacagtacagtttgcacgacatctttgttcaaacatagctcagtttttctggcaccaaagcaaatttgggttaggttcgtgtatgcagagacaacctacggggagggcccataaggcaccctccacttttgcctgaggagatacgaaagcagaagtaatgggatctgtacttggggcacagagagggtttcagaggatccttgtgaaacactagttaaaagatgacgagnggggagnagtgcgaggnaagaaggaaattagtctgactggctttctgtcctgcaccattgattcaatggagactggggggaggaaatggaagactagggttggagatgggatgggtggggcanggatggaa

SEQ ID NO: 664168 - DNA, 359 bp, Homo sapiens
atcctcttaatgcgagtaatgcgaatgtgtttagaagtggctcttctaggggattaagcgggttaatgcctgttgggggccagtgccctccaagttgggggtgtagggtatagtctgaagtggtaaaaggctcagaaaattcgtgcgtgcacagttggtgtgtggtgcccttggtatgtgctttctcgtgttacttggcgccctcattggtatatggtaagtgtgttggttagtagcctatagtatgagagagcgtatatgaagtgaaatgtgaatctcacatgttgagcccgagagtgtctttaggaggtctgagagggcccgtgttagggctcatggtctgggtttccccgcgtgcc

SEQ ID NO: 664169 - DNA, 1062 bp, Homo sapiens
tgggaattaaaaacccggtttttttttcccagggccctagggcccaaccggcccccccggggggaaagggggcggggggccctttcccccccttagggcccccccccccagcgggaccgggcccccgtggttggggcccgccctaattttggtgaagggagacccgtgtgcccttgattgcgaccaaaacagatgcggacgctggggcgaccacccacttgtgtcggtcgcgagcgttataagcgatctcccctctgtagtgacgagggcgagggggggggggtgggctcctagagcgtctccccactggaaaaagaggggcatcgcctaggccacgaagtgacaaccgccacctaaccaccgcgaggaaacaaacggtcgtcgcggggcagaaaaaaaatgaagaggtgcccaaacgaggccgaaaaccgggcgcgcggggtttcccccccgcggggtcgaaccagggccacacagcaaaccgcgggaccaccatgaagaggggtctcgagaaaagcgagaaaccccgggtagtaacagacaacgtctcccacatgtgtgaagagaatggagcgggggacatcgacaaacagacggaacgggacggggagttcaccacaccgatatcgaggagaccgaacgcctccaccaacacagcgccgtcaaaacacccccacaggcgaaccacctgacgccgaccaacggttcgcagagaacaccaggcgtggtgcaacgacgcaaaagcacacacacaacaaaacatcgctagacagccaccgggcgacatgtcacgacgcagcggcgcgcgaccacctatgacaaacggtcaggacgacccatgcggacacggccagcaccacacggtgcatgccagaccgggcccacaagggggaaacacgtaccagcctgcaacattggcacgcgcatcaagtggcccacaccaaggggagacgaccaaccgccaaaccgccagcaagccccacaacccacgggtggaccgcgccacaccgtgacacccaacccacggtaccccggtacaggccagcgcagacctcgcctcgc

SEQ ID NO: 664170 - DNA, 406 bp, Homo sapiens
gcagtagcttgatctccggctcactgcaacgtcactcccaggtcatgaagtagctgggattacaggcacctgccaccatgccagacgtgttggccaggctggtctccaactcctgaccttgtgatatatatctatatctatctatcgctctctctctctctctctctctctctctctctctctccatctataaagcccaaaatatttgtggtcccgagcattttgtataaagggtactcaaagtgtagaaggcaaacatgaaaaggctaatacagattctctaacctacaagttctaattctaaatgaatgtctcattctacgagagtacactaagtatatacgtgatgattgcttttttacacccactccaatggtccagagctatctctaatatgaaaatactt

SEQ ID NO: 664171 - DNA, 925 bp, Homo sapiens
tgggggtaagggaaaatttaatttttccctaaaaaaaaaagggggttgggggggcccaagggtccccaaaaaaaaaaaaaaaccaaaatttggggtgtttcttcttctaaaaggaacattcaaaaactgtggtcaaaaaaaacaactcttctaattattatctatagaataaagaatggaaatcttaccttctttcggaagggagtataagtggtacaaacacgcgtttctcctatcatcagaggagaggtatacgaccaccgcgggttgttgttggactcccaagaactactatcgactaaaacaagagaggaaacgtgggggtccccagacgggggggtgaatttccaacccgttaaacacaccgcgcggaagaaacacaaaacaggtgggggtcgctgcggcgagacgccctctctatagagagaaaacatctccacgagaaaagacctctacgccacccgtgaggagcaaggtattatacatacccgcgggcagacagaaactcagagaggggcgtggtgggggcccccaaaaagaaattccaaccaagagcaacaaacaaggatgttgttttctcccccaaacaaaagcacgggtgtatactcaccctatcaagccccaggaaagaatgggggaccacaacgcgccacaaggtttaccacaaggggggtgagcaccccgcccaagaatgtttgtctgtcggggtggttatacaacaaaaacttacgcggggggaacaacagtgtaaaagctcaaacaacaacagcgggctacaaaaaaacacacaacacagagtggtgttactacaaccccggggggggtaaatataatcaaataaaagagtggctctgaggagaaacatttcttgagcaagggagtttcactactagctcggaagaggcaacaactgggggtgtgctgt

SEQ ID NO: 664172 - DNA, 205 bp, Homo sapiens
  misc_feature (6)..(6): n is a, c, g, or t
cccaantaagctactatcctcattagtagccagacctgagcgttacacagggttgcgaacacacctcggcttggctactaatgaggatagtagcttattggccagcgggtgccatgggccagcgggcccgctggcccaatgccattgaggttgatggacgcctcctcctcactctggcctccagacaggaaggtgatcccagtga

SEQ ID NO: 664173 - DNA, 279 bp, Homo sapiens
tcccccgggggggaaagggggcctttttcctcccccccccccccggggggggggggtttaaaaaaaaccccttttttttggggggggggggggggccttttttttcccccaaacccctttttttgccggggtttgggggggggttttttcccggcccccggggctccccccaaatttaagagggggaggtgggggggtttttttttttgggggttggggggggttttttccggttttggggggttttggccccaaaaaatattttatttttccccccca

SEQ ID NO: 664174 - DNA, 421 bp, Homo sapiens
  misc_feature (24)..(24): n is a, c, g, or t
  misc_feature (69)..(69): n is a, c, g, or t
  misc_feature (84)..(84): n is a, c, g, or t
  misc_feature (135)..(135): n is a, c, g, or t
  misc_feature (157)..(157): n is a, c, g, or t
  misc_feature (223)..(223): n is a, c, g, or t
  misc_feature (267)..(267): n is a, c, g, or t
atcattgtctggttgtcatggttnactttagatgtaaacttgactggattaaggattccctaaagtgtnaaggcctctgagccnaagctaagccatcatatcccctgtgacctgcatgtacacatccagatggcnggttcctgccttaactgacganattccaccacaaaagaagtgaaaatggcctgttcctgccttaactgatgacattatcttgtgaaantccttctcctggctcatcctggctccaaagctcccccactgagnaccttgtgacccccactcctgcccaccagagaacaaccccctttgactgtaattttcctttaccttcccaaatcttataaaatggccccaccccatatccctttgctgactttcttttcagactcagccctcctgcaaccaagttgattaaaag

SEQ ID NO: 664175 - DNA, 232 bp, Homo sapiens
caacaagcatacatgactaacacccttaattccatccaccctcctcatcccataggaggcctgcccccgactaacggcttatagcccaaaatgggccatatatcgaagaattcacaacaaaacaatagcactcatcatccccaccatcactagccaccatcacacctccttaaccacatacttctaccatacagcctaatctacaccacccaccaccactaagattatgtga

SEQ ID NO: 664176 - DNA, 816 bp, Homo sapiens
  misc_feature (202)..(202): n is a, c, g, or t
  misc_feature (237)..(237): n is a, c, g, or t
  misc_feature (333)..(333): n is a, c, g, or t
  misc_feature (565)..(565): n is a, c, g, or t
  misc_feature (612)..(612): n is a, c, g, or t
  misc_feature (622)..(622): n is a, c, g, or t
  misc_feature (692)..(692): n is a, c, g, or t
  misc_feature (745)..(745): n is a, c, g, or t
  misc_feature (786)..(786): n is a, c, g, or t
catccagcgagcatctgccgccgcgccgccgccaccctcccagagagcactggccaccgctccaccatcacttgcccagagtttgggccaccgcccgccgccaccagcccagagagcatcggcccctgtctgctgctcgcgccttgagatgtcacacgtcccccttgctcgcctctggctggtactgctcctgctgactgtncaggtcggcgtgacagccggcgctccgtggcagtncgcgccctgctccgccgagaagctcgcgctctgcccgccggtgtccgcctcgtgctcggaggtcacccggtccgccggctgcggctgttgcccgangtacgccctgcctcttgtcgccgcgtacgggtggcgactgcacgctgcgcccggggactcagttgccgcgcgctgccggaggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatntgatggccccttctgaagaggatcattccatcctttgggacgccatnagtacctatnatggctcgaaggctctccatgtcaccaacatcaaaaaatggaaggagccctgccgaatagaactctacanagtcgtagagagtttagccaaggcacaggagacatcaggagaagaaatttccnaattttacctgccaaactgcaacaagaatggattttatcanagcagacagtgtgagacatccatggatgga

SEQ ID NO: 664177 - DNA, 949 bp, Homo sapiens
ggcggccgcccgcgcccgatccgcgaaggcgcccgccagatgcgcccagatatgagggatgatcagtagcaccatccaggccggcccgagtgcaggacaaccagaatcttggggccaacatgtgctgagagaaggtcactcacgtgatagtagcgatggctatcagtagcaccctagtcggctgacatacagtgaggctgactcgtgacattgcgaagactggtaggcggatcaagctgtctacatacgatacgaggccgtctttcgtcaacaagtacggtgcctcgagccattctggtgcgacctggaacccgggaaccatggacagtgtccgttcaggggccttatggacgatctcttcaggcctgactagatttcatctttggtcagtagtgtgggccgagtcaataaactgggccaagggtcactacacgtgagggggcggagctggatggattcggtcctggatgtggctgcggaagggaggtgtgaaagacatgcgagctgccttgggaggggtgttcacaaacgtaaacgcatgtcggcatgtggtgggccgcgccatggggcctccgggtgcaatgcgggcgaccgattgtcgtccatcatgaagagggtagcggtgcatccgatggtagtgcctggaactcgccagtcaatgaatcaaccattcaagtgcttgatggtggcttcgagcagaaaggatgtctaagacaaacggtgtgtcagagggccctacctaaagacctcgttatgtgtccattctaagcaaggcatggatgcgaagaagcaacggggatggagacccataggtgcaattccgactgaacgtaggccgcatcttgggagaactctagtgattaccgtgtccctgtccactgttggggcgaagacccaagctaacggggaaaccttcaaaacaaactgggtaatcggaccaaccattgag

SEQ ID NO: 664178 - DNA, 90 bp, Homo sapiens
  misc_feature (47)..(47): n is a, c, g, or t
ggatttgctggtgcagtacaactaggcttaatagggacatggaaagngaaaaacagttaccagccaatacaaaaacataccaaaaaaaaa

SEQ ID NO: 664179 - DNA, 100 bp, Homo sapiens
atcccgcctcgggggccggtgtctgccctgtcgggtgttttccgtgtgcctgcgggtttactgttgttcctgtggtgggtgacgtgtccccactgtgctg

SEQ ID NO: 664180 - DNA, 188 bp, Homo sapiens
cgaatcttctgcatgagctgagattctgttcgaccttgacgctgcgtctgctacgacattgcagtggctcgctacacgttctattccaccggaccgcagttctgtgccgattacctgggacgaccacgttggagcgatcattgcggagcccgggtctgccggtgcccggattgcacccgctatgggga

SEQ ID NO: 664181 - DNA, 114 bp, Homo sapiens
gtggagattgtccctggaagccacctggagtggatcccagaccgtgccctcaccttgctcttctgcctgctttcctgcatgctctccagtctccaaccagtaagggcaaaccag

SEQ ID NO: 664182 - DNA, 573 bp, Homo sapiens
  misc_feature (573)..(573): n is a, c, g, or t
ttctgggctctggactccacggatgcgtgggcagaggaatgtgggctatgtagtcataataaattaggacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggagggggggcgggactgctagatgttgtctctctctctcgagagtgggggagctatagttgtgctcgcccaccacacacttatttttattaaaaagacggtcgacgcctaattagtagagtgtcttcttatatttacgaagaggagcacgcgcggcgcgcgcgctcgcttatatccaaacacacgcagcgacccgggtgcgaagagagaacacacacacgcgccgcccgaccggggagcgctaccacccatcggaggaggagcgcacaacaccccccatactccggcgggaggggtgcgagaaccaacctaaagagagcgagacacacaaacacaccgccccgccgaagcaagcattcagacagagcaccgcccgcagcggggcgacaacacaacgtaccan

SEQ ID NO: 664183 - DNA, 490 bp, Homo sapiens
  misc_feature (181)..(181): n is a, c, g, or t
aagggcccccccccccccagggtcttttttgggcggcggggggggaggcccctcttttttttccacaccacaaagggggccccccgccctggcctctggttttgggggggtgtgccaattttttttaaaaccccccgcgcccaacccccccctttggggggggggcccgtgcgccccctcnaaatttttggggcccggtccccattttaaggggggtcccccccccccccccgggggttttttttttgggggggccggtggggggggggcccccccttttttttttccccccccccaaaggggggaccccccccccggttctgggccctgggggggggggttttttttttccccccgggccttcccggggcccggggggggcttttttttcccctttacccttttcccccccttttgtttttgaattccccggttccggttttgctggccccgtttccaatttttttttggggttttggggcggggggta

SEQ ID NO: 664184 - DNA, 436 bp, Homo sapiens
  misc_feature (368)..(368): n is a, c, g, or t
  misc_feature (409)..(409): n is a, c, g, or t
  misc_feature (422)..(422): n is a, c, g, or t
tgaaaactggccatttatggtcagaaattatctgccctaccttgtttgactgtaggtcataagacccctattccagagagggacctgccccatacccagaaggaaggaatgctgctcagagaggccaagaagaatctggacagacaggccttgctgggtttccctactctgtttactatcattagatcctacccttcatgtccattcatttctacaaggctgtccatactttatagaaccttaaaaacaatgggacaatttcccctgtatctttagggccttcattttgaaggggctcccatgtcacgtacaactgtggtccaaataatttttttttcttctatttcatctggcctttagtcagtggntttcaggcaaaccttcagagggtgaggggggaggttttccntttactgtgtaangtaattcagggatt

SEQ ID NO: 664185 - DNA, 685 bp, Homo sapiens
gatctaactcgggctacatagatactatattattatcagaacactacttaaaactcttcactaccagattaggatggagctagatagatagatagatagatagatagatagatagatagatgtggttttgtataattttacccttctaggacaattttttatgaattctacgtttctcttaattcagcacagacactcgtagtgtcattgttattcttaaagctagcgtaacacttgattcacatcagcattagtttggtttttttctaatcactaaaacttctctaatcactaaacactcatgaaagaatgtaaatcatggaacatgtagctttttaaacttatgtaacacgcagtttttaaaagataaaatatctttttccacagacaagtacctacatctgctcttactagaaatcttaaccctttcatctaagtatagtttgctctcacccagacatactcctgcctggccaagcactacatcttttatcctggaccaggccaaattattccattaccaatctttggaccatataatgtaatacagctcatgagactagatctatggaactctgaaatgaagcaatccagatgtccatatgtagcaaataccaagctatctgtagattaattcgctagataatatatgagtaccaacacattcagatcggggatctctaag

SEQ ID NO: 664186 - DNA, 286 bp, Homo sapiens
gtgatcgtagaatacgagcaattcagactctgttgcccagctatgtaacacacacatggacactttcaaagtgatatgtcaacagatacagagtaggcgtactaaagtggatactctagggaaagtgactgctacttaaggtggatcaacagcagagagatgatgtctcctgaggcaaaatcaatattcatagcatggtagaaacaactgccttttggtgggctggaatcataacagggagaagtggagatattcttagggatcagggtacgagctcgaatcgtat

SEQ ID NO: 664187 - DNA, 385 bp, Homo sapiens
  misc_feature (10)..(10): n is a, c, g, or t
  misc_feature (15)..(15): n is a, c, g, or t
  misc_feature (95)..(95): n is a, c, g, or t
  misc_feature (151)..(151): n is a, c, g, or t
  misc_feature (164)..(164): n is a, c, g, or t
  misc_feature (366)..(366): n is a, c, g, or t
gcccctaacnccttnaatcattcctaatatttcctgatgaagtgggatattatccccaaaatggaatttttaggtaatccttaaaattacattgntcaagctgggctcggtggcctcacatctgtaatccccagcactttgggaggctgancgtgggcagatcncctgagaggtcaggagtttgagaccagcctggccaacatggtgaaaccccatctctactaaaaatacaaaaattagctggacatggtggtgtgcatctgtagtcccagctacttgagagctgaagccagagaattgcttgagaacctgggaggcggaggttgcagtgagccgagagttgccactgcactccagcttgggggncagagcaagactccatctc

SEQ ID NO: 664188 - DNA, 1303 bp, Homo sapiens
cccggggcaggaggggaggccaggaagccggaaggaaactcctgaagctttttacggcaatgacacgaagacaaaagatgtgctgcgttgctctgcggtctggtccaagaagcttcagcgtcccaggagcaccagacagatgatctctctgttctagcagctggttccagggagcacgaatccgccaaggcactgagtttgtaagtgcaggtctctaaagagaattgtaggagaagctgctaacagtgggtggcaaagctctgttagaaacatagaagatatgaaaccgtgttttatggggagaacttataagcagttgggaggaggtcttgccacgggtccgatcacacagcgctcgcgctggaaattggcaaaggagtcataagattatccaatctctaaccaggatggatagatagatcgaccaaaagacggatgagaaggggatggccatatttgctccaatggctgctgggaagctgctaggcatggctcatggcgaactaatcaaaccgacagggagtatctccttaactcgcactccagtcccacgagcttcgtttcgtccacaacgacgacagaatgcagcgtcctagaccagggtataaaactagaaacgcgtgtcacgatagaggattcctcaagctttgatggaagcaactggggaggcttcgtggtggtgtggcttacggatatcgccagagatagccccccatcaatgtctaatttacaccaatgtttctcaatcctacaatcgttttcagtgtgtggcgcacctttttgaaaccaattgacacttcgagagtccctttccgaccgttgtggtaacccctgtggggttggaaaagagctgtcctgggaagagagcctagaggtaacccctaggtgacgaagaccgagattaatacgtcctggggaaacccgttcccctgggaaagaccctcaggcacaagggcgcggaagtactctcaaatgaccctgggggagggttcccttcaaacattccttgttcaacccccttggattggctgactttggcacgccgtccttaggggcctttggcagttctcctcaaaagggacttttcgccgccaagggccaaggccctatgtgttgttcccccccttggttaaaatacggattaaggtcttaaaaaaacctttcccattggttttccaatgcgggtgcctaatcccttttggcccgaatgtcccatttgtctcctgaaacagttcttgggttgtagcaccctttgttgggtgcccccttatttctttatcacggtgaaagaaccgggactccg

SEQ ID NO: 664189 - DNA, 475 bp, Homo sapiens
  misc_feature (456)..(456): n is a, c, g, or t
gcgagcgaatcaaccactgttggctttcctgatcatgtgatatagatcaccacgacgggaatttccatctgcggattctcatggtgagagaaatggatcattagcgccatatggagtacacgtgcgattttctcttaggctacatacattgcggagcaaaatggatatgcataatcggtaccgcgatgtcgtaccaacttacattttgcctgacattaccctatggcaagtggtaaagatctgtacgccttgccacccaacacgttagaggagtatcaacatatgtgagcctgacacccagttgaagaatcagtttgattattagggtgggatattttgtttttcacgtgagaagacatgaagaaattttaaaagataaacatcatataattgtgaaccatcagctgaaaagataaatttgtgttcaatatataggcagaaaaaaattcgcgtcanagatgttgaattgttactt

SEQ ID NO: 664190 - DNA, 352 bp, Homo sapiens
aaagcacacgcataagaatgacagcacaaaacccaccagtataaacacaagcaacatgaagttgatgataggacaaacaatggatatccagatgtacgaggaaagaaaccaccatcgtcaccacggcgcctgtcactccgacgctccactgaagtctcagaccagcgcacgctataagtgtggagataggcctagagaacatcgatcaggtcgataaaccatccaagctgtggggctatgaagtcccgcaacagaaacattggcaaatataattcggtctccatggaattctaagtggaagtccaaatgggtccagagtcctatcttgtggctgtgtggcaagaaaccactc

SEQ ID NO: 664191 - DNA, 936 bp, Homo sapiens
gcgctcttttgggccaaccttgtgtgcgtcaaattttgtgagtcctgggtctcctcgtgtccccttgggctccccaacaccaccccgggtccaccctctggcgccgtgtgagacacaatgtggtcgcgccgaattgtgtatgatttcccctctcgaccttggcgtcttttgatgaccctccccccttcccggcaaggtttctcttccttttcattccccgaggcaggtctgaagcgactttgcgcgcccacatggtgcgcaacttcctcttggggaaaccgcagccccctcttcccctccgcggggacaagcagagcccccagtcctggtcgttccccaggtggacaccccccccctgggggggaagatcttgtcttccccccgggccccccgactgggcgacccccctaggtcccgcggagggcccccaagtgggcccccgggaattcactgaaccaggaacttcttgggggacaaccatcagcatgtttgtctacccctgcgtcgcacgaagcgacgttgtgaccctactagtcccacgagcccattttgtcctacgttgtgaccgctgaaaataccacttttcagatcgcccctgtgattgctgcgggcccgttttgtaaagaagcccctctatatgaggccggcgagcaaccacgccctcggtggaacaacgatgagctcgccacaataatcatcacacggttctgctgtggcaccatataagctaatccacagagtttatgtgaaatcttgtcttcctctatggattaaaacggggggggcaaatattttccatggcgtcttaaagatttgtgaggacatgttcaagaatctcctagttgagtcccgctacagaacttcaatgagctcgaacatcccctcctcccaaagggggttttccacaaaaaggggaaaaggcggccaaaaaaaaca

SEQ ID NO: 664192 - DNA, 386 bp, Homo sapiens
  misc_feature (204)..(204): n is a, c, g, or t
  misc_feature (332)..(332): n is a, c, g, or t
  misc_feature (360)..(360): n is a, c, g, or t
ggggaaatgcataaagcagttcaagagagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatggttgatattttaagaangtatgttctagtgcttttcacagtgagtctaccatctggctaaaaacaccttgtagacaggcagtggcatttaaaaatgtaggacctatcgcccagtctgacagagcggggcttcagaatctacattnatatcaacctctcttaagcactcccgcngtgtacccagctcactgggcactttc

SEQ ID NO: 664193 - DNA, 312 bp, Homo sapiens
caataggggacacaccagttacttctcatgactgatgccctcatgtacctccgacggaactctgtccattcacgaagacaagttcatcacctctctgctcccatggcatttgcccctatacctcagcgccttgtagcagtcatgtgttatgagatggggagctccaagcaggtgggcatgacccaggggcctggtgaccaggacagacccccactgtccatcacctttcctggccctgtcctctgctaaacttcccacaggccttctgcccgaatcacacagagtatgccctaactctctcaggcctctggc

SEQ ID NO: 664194 - DNA, 435 bp, Homo sapiens
  misc_feature (12)..(12): n is a, c, g, or t
  misc_feature (29)..(29): n is a, c, g, or t
  misc_feature (367)..(367): n is a, c, g, or t
  misc_feature (419)..(419): n is a, c, g, or t
tggcccttggtnggggttggggttactgncctcaagctgggtaattgaaaaataagacatgatttaaaatatcctaggcccataaaagattgttaaaaaataagtacatcccacatgatcaaatatcattcaagtcattaaaaattatgacaaaggcttggcgcggtggccccacgcctgcaatccccagcactttgggaggctgaggtggtggatcacctgaggtcatgagtttgagaccagcctgaccaacatggtgaaaccttgtctctactaaaaatacaaaaattagccaggcgtggtggcgtgtgcttgtaatcccagctactcaggaggctgaggcaggggaatcactagaacccggganggcagaggctgcagtgagccaaggttggaccactgcacttcagcctgggcgncagagcaagatgctct

SEQ ID NO: 664195 - DNA, 585 bp, Homo sapiens
gcgaagggcgaagatctgagacgactgagagccagctatgaccggactatttcttgaaagcgcgatgacaggatgggaggcaatgatttcacatggaaaccacgcactgtgagacaatgcactatatccagatctgccgcaacaactagccgtgaaccctgactctctatccagcacaacataaaacgatcaatccttgcctttagggctgagggcctactgacactgaggctgatagccttgatcttcctcatcataaagagcgtacagaaaatatcaaagggagaggcttaccattttcccagggccatagctgagatgagatcctcttctttatggcaccatggcagatcactccaagccccatgcccgagactctaactcagatccttcagccaaactgtgatccatcccagaggaatcacttacctatggcagaacagctttaaaacttccagaagatgctcagattaaagtaacaaactaactcaacttttacaatgaggctcgaatccatttccactcatctgagacctatcttcacacatgacgtgtcactctcttacaaattgtgcaccaccacct

SEQ ID NO: 664196 - DNA, 839 bp, Homo sapiens
gggcttcccccccgtcatggggccccgttcgaggtacctccgctgcaataatctgcctctcggattatcggcaagctctcatgggtgctctccccctccccccgatgtgatggcgcgacgacatcgatggtggcgtatagaacctatcgagggctcgtctttgattcccccaacggagtgcacgatttttctcgcgcgcacaagtttctcccccttggggtgtactgatcttgtatatgtcgccactcgcgcgccagccgtccttaattgcggcccgctcttgctctcgcccgggaattgcgcgttcccgtcgtagtgtcacccaccttttgtgggttgggcgggattctacttcccctacgaaccgtcgcttcgactccctgcgctttgggcgcgcgtgcccacgaaaaagttggcgtgggggtcgcccactccacatggctgtttgcgcccggtcgtacacacgtgtgtgttatgaagaacaccacgcgacttgtcgtgcatattgactcagctgccccccgcggggggctcctcatcgcactcgtgtgcggcgcgtgtgcgcccagtatgctcgatgtatctcgccccacgcgacccctccttttgttacctgctctcgacacctctttgccatggcccgcgcctctccttgtatggcatctgtatcctccgcgtacgccccgcagggattgcgtcctcccgcgcttaggacgtcggtgagtcaccggagagtttgcatataggtggcgaaccaccatcggctcctgcccttggcgcccgtggtttccatgacgcgcagggcggcaaaaacccgtggatttttcccccacataaca

SEQ ID NO: 664197 - DNA, 446 bp, Homo sapiens
gcgcatgtacccgtgtcgcatctagtaatgccgctacatttaccctgagtttatgtcctggggggggggagataggtgtgtgaatgtagccccatgacaggcagggtgtccctcctatcctgcatgactcgtggcatgaacccggagagccaagaaagtgcacctttgacaatggtgcaccaggtcatggtggcaccatctcccctatggcggtggcatctggggcccttgtacactgggtacaaggaacctgaagtgcaggggagttgagctattgaggccacactgaggacagtccctctcactttgggaaagggagatggcactccggggtctgatgtaccagaattcctctccatggaaggagaggcgaacaccataagatattagagcagagaggggactccgcggccccaggcaaggcttctgtgacaaagatggggaaa

SEQ ID NO: 664198 - DNA, 1531 bp, Homo sapiens
  misc_feature (470)..(470): n is a, c, g, or t
  misc_feature (693)..(693): n is a, c, g, or t
tgggccggggaaatggagggctcggatgttaaaatttctacatgtggggtgtgaaacagggtgattttattttaaaccacaaaacatttcacacaaagacaaaaaagggttcacaaacccttggaagcgggatagtggtgtgggacaaaaatagtttaaaatttgtggcgtgatatgtgtgattatacctataaaaatataggaatttttataaaaatctacaaaaacaaaaaatataccaacgagttataggtgataaatgtgacaattgtggggcgggtttaagtgtctttatagaaaatgttttgtggccctttctctatagagcccttggtgtgcctataagagggggtatatataagcgggtggggtgcgctatattctatactttatagaagggggcaattctccatagtctctatatacacttatacagagagtgtgtgtgtctataaagagtggtgtggtcncctctcgcgcgagggggcattatatataagaggagggagtgtgagcagggcgtattagacaacctcatagaggggggtgtgtctgtgtggtgtaagagtctcctctcaaaaaacagtggtgtgtgaaagagtgtcgacagtgttgttctcgaaaaaaacagggtctcgcgagaaacgtgtgggtataagagaaaacaaaattatagaggtgcgggtatatccncattgtgaggaagattttttatacagacccaccaagcgcgctacaatagaacgaaattaggggcgacaaaaacaaaaaagatctacgaagaggtgacagctccccactacacatatagtggggcgggttttttctacaccaccaggtggggcgaggagatacagtgttacaaaaatcttccgccacgatattattttctttctgaagagaaacaccaacaagtggttaagggggggggtgtcgccttgtggggacataaaacaattactgacaaaagaaatatagcgggcatcattataacaagaggtggtatacataaacaatgggcgtgagcctaaacacgaggggggtaaacaagggggaataaaaacaggtgcggggtacaacctttcgtctggtggtgcacacaaaagtgtgtggggggcaagagcaacacactaatgcaggggagggtcatcgaaccatacttatctacaagaaccggaggtttctttggtgtaaattacaaacaacatactgtgggggcaccccaaaaccagagtggggcggcggggtctcccacacacaagtactacagactggccacagttagcaaagtcaaacgcacttacacaagacaacacacaaacaaacaggggggcgggggccgcgcccactcagaagaaactacatacacccccggcgcgagaggggcgccaccacgaagatatatgacggaacgacaaacgcacgcgaggctcgtccggaggcaaccaacaagcgggcggagaccccaccaacaagagcggaggacgacagacacaaacacgagagagaagcaacggggcgagcagagcta

SEQ ID NO: 664199 - DNA, 454 bp, Homo sapiens
aaccggtgtgaatgcccaagccctctagcatgtagaccaggtcttctgtggccaatgtttcctgatgcccccgtgtgcgtagggacagcctccaagtcctgccacagaagagtccacgaaactcactcccatctcagacaccataaggatggtgaaaccacagtggtggctggggccaagaggccaccgagatgagccttgcaaacctcccaatcgtcggtggcctgaaatactagagtcattcttggcttgggctcatgcattctgtggccatgcacaatcccacagaacgcagacagtgcttctcctttaagttactgtaaaactgtttcctctgccagcagtatctttcctttcatggtgaactctcattcttaaggttccagtctgaaagccaccggctcagggagaccttttctgatcaccagcctaaccccgtcccgaaactgagaca

SEQ ID NO: 664200 - DNA, 207 bp, Homo sapiens
atcgcacacgcacagtaggcgcgatgcaacagagaaaaaaccgaattaacccccaaacaggacttgacgggaagggaaggggggatggggagttgggaagaaggaatcacattttgcaaactgcccactaggggtcaccgtaccctcagaaccgaggctgcagaagtcacatccgcggcggtatgcgctggcggagggtcccagaga

SEQ ID NO: 664201 - DNA, 417 bp, Homo sapiens
cgcatgcaggtgggcacctgtggtcaggagttcgagagcagccttgccatcatggtgaaacaccatctctattaaaaatacaagaaaaggccgggcgtgctggctcacgcctgtaatcccagcactttgggaggccaagacggttggatcacgaggtcaggaattcaagaccagcctggccaagatgctgaaaccccgtctctactaaaaatacaaaacttagccaggcatgatggcacacgcctgtaatccccgctactcgggaggctgaggcaggagaattgcttgaacccgggaggcagaggttgcagtgagccaagattgcaccactgcactccagcctgggcgacagagcaagactctgccacaaaaacaatgtatcagaagacatatctaatcttcacttctgaatgttcc

SEQ ID NO: 664202 - DNA, 139 bp, Homo sapiens
cgcacggcttacgaagggcattgaataaataagtcaaaatcacaaatgacattgacgggatacatagggcaaaagttagtatgagtacttgttatgatacagtacacgcagtcaagaattcctggcttttaatcagagt

SEQ ID NO: 664203 - DNA, 385 bp, Homo sapiens
aaaccagcgtgtaaccactagtataacctgagcgctcagaccgaggagtggggactgtattaagaagtggacatcgtctggcaggagccctggtgccaccccgtggcaggatccagtcccttatgcctactgccatcacctcaccgtaagatccaatcagatcacacctcattgccctctgtctataaaacttgccccagccctcagctcagggagacagatttgagcatttcctcttgtctccttgctagtcaacacacaataaatctttctctttgcaaaagcctggtgctttgatgtttgactttccattactgtaggcaaatgaactcagtttggttctgcgacattaatttgcatacactcagtcccaatttagtattta

SEQ ID NO: 664204 - DNA, 232 bp, Homo sapiens
  misc_feature (167)..(167): n is a, c, g, or t
  misc_feature (188)..(188): n is a, c, g, or t
  misc_feature (215)..(215): n is a, c, g, or t
gggcagtggtgttgtggtggccttggcgtggtagtgacttccagctagcaggtaggtgccagtgtgtctgctgggatctggaatgtcttagcaggttcgctcctgaaaaatgctgaatatgatagctgtgaggggcggttccacttagctccgcaccttgaacacanaagcccacttgttggtgtctntagttccttggccagtctcctcctggnagctggaccaaagcgtg

SEQ ID NO: 664205 - DNA, 313 bp, Homo sapiens
cccttttaaaattaaaaataaaaatcctttgtaaaaaacttgcatcctaatttttttttattgcaattgaaagggtaaataataagccaatgtaagtaagcccttcctaatgtttaaaacaaactgggctccaacaagtggccctatttttattagggttttaaaggtttgggggggggtgggcgggggggggtgtgttttttttttttaaaagaaaaaaaaagtggggtctgtaaaaatgttacctgtagtggggttttttccaacaaacctgaaatttatacttttaaataaaactattgggtttttaaca

SEQ ID NO: 664206 - DNA, 914 bp, Homo sapiens
taccaagacaaacttaagcaaacacattgacccaaataaagtatatggctgatagaaattgaaacctggcgactaatagatatagtaccgcaagggaaagatgaaaaattataaccaagcataatatagcaaggactaggccctataacttctgcataatgaattgaactagaaataacttggcaaggagagccaaagctaaaaccgccgaaagcagacgagctacctaagaacagactaaatagaggtacacccgtgctatgtagacaagagatcagtgggacagatttataggtagaggcgacaaaacctatcgagcctggtgatagctggttgtccgaagatagaaatcttagttcaactttagatttgcccacagaaccctctaaatccccttgtaaatttagctgtaagtccaaagaggaacacgctctttggacactaggaaaaaaccttgtatgagagagtaaaaaatttagacacgccatagtaggcctaaaagcatgacaaccaattagagatagcgttcaatgctccaacagccagcatagctagaaaaatcccatgcatatgatctgaagctcctcagagccaatgggaccaatctatcaccctatagaagaactaatgtgagtataagtaacatgaaacacattctccttccgcattaaacctgggtcagattaaagctactgaactgcaatgaaccaggccaatatctacatcagctaataaaaagaaagtactccgaaaaaaaaaaggggcggcgctggaaaaccgcgagggacgaagacaggccgcgatctcacaaggggcccaagggcaagcaaagcagcacgggcgataaacgaagagaacgccgggccggaggcccccgggggcacgccccaaagaacggaacaggaaggcaccgg

SEQ ID NO: 664207 - DNA, 352 bp, Homo sapiens
gattttttaagagttcaaatgttaaacatgtttctgcaactctaatgtaccgttttcctggaaacatgctttaaataataattatatatgcccatctgtcttctctagatcataaactacttatacatgtatacatgtatatgcataacatagcatgacagtaataagtgatcagtacattctacatgtgaattgggtgtgcccagatgcattttgttagttctttgatctaccatagttactttggatttataaagtgcttttaaaagggatgttaccttgtcatagtggctcatgtctgtaattccagctacacaggagaatccctgaggccaggaatctgagaccatcc

SEQ ID NO: 664208 - DNA, 167 bp, Homo sapiens
  misc_feature (15)..(15): n is a, c, g, or t
  misc_feature (49)..(49): n is a, c, g, or t
ttccaccaggccggntctttctgattaggttttgtgattatcagcaganccagtcctgcactcccctgtaggggagagactctttctttcaaatggatgatcttcagaaataactggccacacccagatggaaatagcttgatttgttttcttttcttttttttttt

SEQ ID NO: 664209 - DNA, 502 bp, Homo sapiens
  misc_feature (24)..(24): n is a, c, g, or t
  misc_feature (125)..(125): n is a, c, g, or t
cgacggcagaggacccgactgtancctttgtctggtgttgaactcctaggctcaagtgatcctcccgcctcaccttcccaagtatctgggactatagctgcatgccaccatacctggctaatttntggaggggggtattttttgtagagacagggtctcactatgttgcccaggctggtctcatactcctgacctcagatgatccgcccccctcagccttccaaagtgctggggattacaggcatgagccactgcacctggccaggagagtttttttctgataatagaagtaatactttctcactttagaaaatgtgaaaagttcagatatataaggaagtcaaacaaaacgtctcctatatatgaagaagaaaagaagcaagttcaaaaaaaaaacaatgataccgaacgccacacatgggaagatgaggaggggtgtcctgccgcacaaagggggggcaccccaccgcgggggcacccatccccgtggacagagggggca

SEQ ID NO: 664210 - DNA, 433 bp, Homo sapiens
gttgcggctctgtattctggtttgggggacgactggaactgacacttgtgtacttgctgaggaactggaaacagtgaatgttgaggtaaggcctgatgctgtagtcaggaaagcagtagagcccactgaaggctgggtgatggttgtcagtgtggtggtagggatgtctgtagtcagggaagacagggtcatggttgtggaagtcaccatggaacctgaggtagtggaaactgaggagatggcagttgtggatgtgctgacggtggagtggatggtcgaagtgaagctgggagtactgtgagaggtggtctcattggtggttgttaccaagtttctggtacgaaattatggatgttcctttggttgtgagagaggaagtagtgactgggagagaaatctcagtggacaatgttccagctataacttgtggagt

SEQ ID NO: 664211 - DNA, 1537 bp, Homo sapiens
  misc_feature (1500)..(1500): n is a, c, g, or t
  misc_feature (1537)..(1537): n is a, c, g, or t
cttgccagtgtcgaggtgtagcgatcctagcccacttgcaaccttccaccttcccgggtttcaagcgattctcctgtgccccagcctcccgggtagctgggactacaagcacacgccaccacacccggttaacccctgtgtttttcctagttaaaaacggggctttcgccacgccggccaggctgtggtctctctcgaacctcccgacctctcaggcagatcttgttcctgtgcctctcggcctctcccaagagtgtgctgaaattcacaggcatttagccactgtggccctcttagggctcttgattttctgtgacttccacacaaacaagccagtgtgccacgttcaaaggtttgtggccctctcaatatagcgtggctctgtgtgtgaataagcctgtggcccaacaccacagtgtgttgtgttgcaaggggtatattgttcccaccctctgtgtggaaaaaaaaaaggggcaggggttttgcgccaaaaaagaaagcagctcattcttaaacgcgccaccccatttttgactttcaaacccctctgcatttttccttgtgtgcccatttttcattaataaccggggattttcccaaattgggctccctttttgtgcaccccaacttatatgtttgaagtggtgcttccttaaaacctcttctgtgtcctgtgggatattacccttgttataaagccccacaagccaagagggggggtgtctccccataaaagtggttttttttaaacaacgggtgttgtgaaaaaacggggtgtgtggacacctttcgaagggcagaaaaggtggaaacggggaacacagtttggaggacttgtggcgacacaacggggggtggtcaaagagcaattttaagagggccctcttctttattaatttggaaaaaggggattagaagaggttccaaaccattttttgtgatgagagatctaatgtataagctagatagttagaggataaaggttcatctatagatagtttcaatacacgatagggggggcccctgtgggttttattgtggggaagaaccaaaaaaggaagggcgtcctttattacacacaccgaatgaaaaaagggggagcgatatagagggagggtagtgttaggaggaacacattccacaacgaaaagtggtataaccctctataatagtttgcaaagggaggtctttttggattattccaccttgttgagaagaggggaagaaaaacttctcaccgacaaggttctttcttccttctcaaaagagagaacaacaccgcaatttttttattttccaccaaatggggagaaatacattatttccgcccccactatccagcctattttaccccccaccgaagattgtgtcccccctctcttcacccactttattgtcgcccggactctgtcactatcataccaacagatttatgtggtcagtcgtcagtgtcatacacaaaagatcaatcaccgctttatttgtgtcagagcatgctanctacccccattgatatcattccacacagtcattaaan

SEQ ID NO: 664212 - DNA, 457 bp, Homo sapiens
agaggatccaactgctgtcacttacgcgcctctgctggccctgctgtcccttacgcgctgttggcccttacgcgctgaccctggacttggacaggggtgggttgctgagccagcgtgaaatagtactggactggctcgtcaggagttacagactggcgcacctcctcctgacgctttggaggtttcagttcatctcttggaacaatatcgatgagaaaatcaaactgatcaaatttcgtaattgccatggcgatatcatttctctgtagagtccggcgcttgttatcttctgtgtgcgcgtaagggccagcctgctggcccttacgcgcgtgcagcccctgacatctaaggtcatcacagacctgttattgctcaatctcgtgtggctagaacgccacttgtccctctaagaagttgggggacgccgaccgcttcggggacgcgtaactagttagca

SEQ ID NO: 664213 - DNA, 1162 bp, Homo sapiens
gctaagatgctatttgctggctacaaatgtcccccaccccttggagcacaagatcatcatccagagtgcagaccacgccggactacagacccccaggaagcctttaccaaccgccgatcaccgacctcatcagcgagactgtccctgctggagtgagcgacttccggacagtgccgtgcttccccttcgccttctgccgtgattgtcagatttcctagaggcctcccacagaccacgacttcctgtacagcctgcagaacttctggcatggaaaagcccctgtgcaactggtaaagatatcaataagcaccaggaggtatctaaatccaccaggagccataggcatcacgttgacgtccatttaccagtcttccctggcacgattcttctgaattgtgctgccttggccaaacagaggaggaactaccctgccctgacagaggctggggatgacggaggaagagacagcgcggtccccatggctaacagagacccctccctggcgatgccagattcacatgggctggcagattctgcccccaaaacatgtccaaccagtcgtcagagaggaggcggtacctgggaggggcaccacggagctgccaaggaacagcattccccatagcacagcacagacctaccgaccacgcgacccaactgcgggcatgcagacactgcaaccggcacggccagacagaatgcacaacagctgcgaggacaagtcaccggccccaacggactctcatggcgggcacagacaccaacacagctaagtgatcaccggaggcaggccacacgcaacccgcggcaagaccatgggaacaaacagtgacagccccagaagacacacagctataccccaagaacaaacgaacactagacaggacggccaccgggcaaccaacgcggcaacccactccggcaggaccagcacgccacccaccgctgcacgcgcgccaacgcaacggtgagccccaaacactaccacccagagacagcgcccgggacacagcagagccagacggcaacagcacagaagcagaaatccgaggacccggagacaacaagagacagcgacagcagtcaccaaccaggcccacgcccgcgagtgagaagagagacagcacacagaaaacagagaacaccagcgggcacgacagaa

SEQ ID NO: 664214 - DNA, 289 bp, Homo sapiens
taaacgaccatgagaagagtctgaggcaggagaatagcttgaacccaggaggagaagactgcagggagccgagatcacaccattgcactccagactgggcaacaagagcaaaactatctaaaaaaaaaaaaaaaaaaaaaaaaaaaaaaaaaaaaaaaaaaaaaagggggccccccctggaaaaaaaaaacccttttttttaatccccccaaaaaaatttaaaaaaaaatttaagggaaggggttgaaaaaacggggggttatccgaaaaagggaaaaaaaattttggg

SEQ ID NO: 664215 - DNA, 745 bp, Homo sapiens
caccaattggacctcaaaacttaccacctttagccatccctgctcaaaggatgcccgcgtgccaatgttagacattcgcccaggactgatagcacaggctcccgggccacgattccctttactacagcctggaattccaccacaacgcggtatccctcccccatcggtacttgatgcagctcttcatcctccaccccgcggaccttttcctccaggagatcttttcagtcagccagaaagaccttttctggcccctggaagaccaagtatagacaatgttcccaacccagataaaagaataccacttgggaatgacaatattcagcaggaaggggatagagattaccgctttcctcctatagaaaccaggagggcattaccagacctcctcaggtggatgttagggatgtggttgggcgacgtctagatcccagagaaggccctggaaggcctccattagatgctagggatcatttggaagacctcctgtggacatgagggagaatcttgtgaggccaagtctagaccaccttggtcgaagagaccactttggctttcccccagagaagccttgggggcctagagattttgatgagagagagcatcgagttctgcctgtctttggtggtccaaaaggcttacatgaagaaagaggtagatttcgggctggaaataccgatttgatctagaagtggtcttggaacgaggattggtcagagtccgagatttgatgacggaaactggg

SEQ ID NO: 664216 - DNA, 228 bp, Homo sapiens
gcagggcaaagactaaaggctggcatcagaatccatattcttttcactgttgatgtgctagggctgcaggaacaaaatactgcaaactaggcagcttaaacaaatttattgtcagaggtctgactggaagtcccaaataaggaagctcaagatgaagagtcagaagtggtaacttgtttgttgcacaagaaacaaatttagcattctatttaggggatccagattacc

SEQ ID NO: 664217 - DNA, 137 bp, Homo sapiens
gtagcaaggctcgcagaaatgagcacagccctcaactacttgatgcagagtttctcttggaccactccaactcccactgagcccttatgctgctgggctggctggaaactttccccatacgcctctgggtaccgagc

SEQ ID NO: 664218 - DNA, 122 bp, Homo sapiens
cctcttctcagctgatttggctgcctccattgtaataggcctcatgagactccagcctaggcctggccttcagttcagcagcagagcccagagatgtactgggcaaaggtcctacaggtatg

SEQ ID NO: 664219 - DNA, 420 bp, Homo sapiens
tcggctatccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttgggcattccacgatgtgaaacgagcacgcgacccgggagaccccgacggctgctgtgaacgatgtgtctgtccacgccactggctgctgtctgctcatccatattgagaagtgccgtattcttacctcttggcatctc

SEQ ID NO: 664220 - DNA, 509 bp, Homo sapiens
  misc_feature (12)..(12): n is a, c, g, or t
  misc_feature (33)..(33): n is a, c, g, or t
  misc_feature (226)..(226): n is a, c, g, or t
  misc_feature (419)..(419): n is a, c, g, or t
gtgaccacggcncctcgcctgagcagtgggacntggtatacactccctgcttccttttctgaatgtggtgttgctgtaaatggattgaattatttttctcgagcttgctgtcagtaaacggaggaaggaggcctctgttcaaattgtgacttgggctgaggctggacgattgttatgtagttgtttctatagcccctatgattagacactttagtgtcagggcacnattatctaaattagccgctcttctgtcgggatcagggcgcataacggcgcaaagtagagctgtcaagatgggctagttttcttgggttctgaagaaatggatgtgcaaaggcttggtccgctacttgtaacaagctccagcccttaaaatgaaattaacttcctactcaggcaccctgctagtgccagctgtncatatacacagagaacagaaatattcctactgtctttgaaaccctggtgtacctctcagtggcagaataaacatcaacacaggttcaagt

SEQ ID NO: 664221 - DNA, 134 bp, Homo sapiens
  misc_feature (111)..(111): n is a, c, g, or t
gaggcatgggttgcgctagaaccaacgccctgatactcttcatccagttaagtggaaaccttagcaactataataaactatgagatggtaatcagtggcattattatctcnatgttttcatattgtcactatta

SEQ ID NO: 664222 - DNA, 563 bp, Homo sapiens
cacatatgaaagtttcactttttaagatgcattcttgtagctcccaccagatcgaagatagtgtctaacagctaacgcctgcacaggcgtgctgcatgctctggtggtaaatggatggacacggctattctaaactttgtgtgatacttttgctactatgggcaattaacttgaaaaaaataagcgatcccaaccctgtgctctgatgtacctcacatgccccttttatgacacctttgaccaaatgccttctatggttgacagagcacgcacaaaactacctgtgatacataaagggtccttacaagcttattatacataccgagattcccttacctaaagggagaggtgaacgcaaagactgcttcgaatggctattgcaggcgattgagttcataccatgccaacctgaagaagtattacacttgcagtagaactgtggagtggtgctgtcattgcaccatgggataaacacctatctctatggacgaccttgaatgacttgcaatatatatgtaaagactactctcttatgctatataaggaagatatacctttaaaca

SEQ ID NO: 664223 - DNA, 159 bp, Homo sapiens
atcacaacaaaacaaaacaaaatactaagaaagcaactagtggacatgaccctctgctaaactaccagctgtctttgcattttcaacacgtctctccgccaacgtcatgttttctaggtccaggatctgattcagtgttctcaccgtgcacatttgtgc

SEQ ID NO: 664224 - DNA, 218 bp, Homo sapiens
acaagagctagcgtctaaatatgcatagccctataatgcaaggggaatcacctcagtagacagcgccgcaatcggcttaattaaggcccctctcctgagttaagtcaggcctgagtgacgttgtaattctcaggtccgcatctgatagtgaagatccgtttatcagacacaccgtccccgggaagttcatataggctgtccagagtcttcagtgacat

SEQ ID NO: 664225 - DNA, 427 bp, Homo sapiens
  misc_feature (1)..(1): n is a, c, g, or t
ntggaggttaatccctattagtatatgaaagtattcagcacctattgagattgtgtccctcacgaagggcctcggcccaagttcgtgggttgggggggtacaaagtgtgccctctccagtggtatttgcgaacccgctcgcgcttaaaatccttgtaggaaaagaagtagctaaagagcacgtagcatgccagcaccttggtaatccccaaaatgctccccttcttcacattaatgcacttgttgaagtaccgatagtaccctctttaacacgctccgaaaatgccactaggactagagtcccgcctcaagatcacagcttgacagctcccacagtttcctctacaaaagtctcgtgtccttctctggctctgggcccgcacactcaacaccctcgtgccgaattcctacagcccggggtatcctac

SEQ ID NO: 664226 - DNA, 117 bp, Homo sapiens
acctcccgtgtgggttggtttcttaagggagctggagggttggggtgccaagaccttagagaatgtgcctggtcctttaagggctggactggtggcaggaacctaagttgcttactc

SEQ ID NO: 664227 - DNA, 118 bp, Homo sapiens
ctcgcggtgagttggctgcgccggagaggatccaaacaggaagctgggaaaatgtggtcagatgtgggcatgcgcaaaggggctacctgtgagagggaggtggggctcaggcaggtta

SEQ ID NO: 664228 - DNA, 402 bp, Homo sapiens
ggtactggtacacagtgcatcagatacgtagtggctgcttaagtgccaccaagtatgggcaaatttgctctacttatatggtggtatccttaacatgatctaccagcgccctgagctctgtatactgacatgtctggacacctatgaagcggcgtcttgagaggttcatttgtggcagagcttcggtatcgcaaggacagctcctagcacggatgagatgatatctattgaccctgaggtcaacattgccttcaatcaggctgctggttctagtcccgtgcagctccaccttggctctaccatccgcttgcatgggctcagcgcgacccggaagtggatctaccacatgactgaagtgagcacagatgatccctgacagtccgcctgctttgcggctgggcg

SEQ ID NO: 664229 - DNA, 426 bp, Homo sapiens
cagcctcccaagtagtcgggaccacaggcgtgcatcactacaccttgctaatttttttctcaaattcatagacagtatgaagtgtaatctcattgtgattttgattttcagccaccaaagactctctccttggttaacttaatgaccagctaatgactggagagattttcttaaatgccttgaaccaatgtgatctgtctcccaccctctgccaagggggaaggtgtgtatgtttgtgtgtgtgtgcgcgctgggtcatgccagagatactcaggcactttacagctttaccctggaattcactttttaagcaaggtcttgaaggtcagtcagagattagggcccttttcagtctttcctgggcatacacataaccttgaatattcgcatgaccttctagattctcaaagtcctctgtggatatct

SEQ ID NO: 664230 - DNA, 122 bp, Homo sapiens
ccggacgcacgctcgggagctgtcatcagccgcaacttcctgccgaccctgatgcgggtgggcgagcagtgtggacatcagccgctttttatattcatgtacattcacctggtgaaaaaaac

SEQ ID NO: 664231 - DNA, 337 bp, Homo sapiens
ggacagcaagaacttgcggatcttttttgtgaactataatgtaaaatctcccattactggaaatgatctatcccctccagtgtctttgaacttaatgttcaagactttcattgggcctggaggaaacatgcctgggtacttgagaccagaacctcacaggggattttcttgaatttcaacgacttttggagttcaccaaggagagttccctttcctcctcccagattggaaattcttagagatatgagatctctctcgactcgtgcactgcatcagtgtcagagactcacatcgcagagtggagcacttagtagctcctgtgagaacacacagagct

SEQ ID NO: 664232 - DNA, 401 bp, Homo sapiens
tcaagcaatcattgtcaatgccaaagtgcctattgaagttataattgtattaaattaaggctaaaaatttggaaattttattttatttttggcggctcgggtaactttagcccttacccaagcaaatgtgggtttttttggttgtttttttggttttgttttttttttttttttcctttttggggacacctgtaaaatatttggaaataggaaatgttgtgttattcttgcccccttgatattcaggggggattgtaaaaaataaatttttgggggatttcaaagattaagattattttgataccattatttccagatttaaaaaatggggttatcccaagtttcgagggggaaactactgcataaaataactaacttggaataaatattttgccccagta

SEQ ID NO: 664233 - DNA, 779 bp, Homo sapiens
  misc_feature (44)..(45): n is a, c, g, or t
  misc_feature (236)..(236): n is a, c, g, or t
  misc_feature (486)..(486): n is a, c, g, or t
  misc_feature (489)..(489): n is a, c, g, or t
  misc_feature (513)..(513): n is a, c, g, or t
  misc_feature (763)..(763): n is a, c, g, or t
ccccaaccccccccgaggggagaggagagaaaaaaaaaaaagannccctcccccccccctcctctccccgtcgccggggggggggggagctttctctctctctcaatataataaagacaaagagatgttgtgtttttttttttttatctccctccccccccccgccccgcccccccccaaccaagagtgtatggggtgtgttgggggtttccccccccccccccccccccgcgggnggggggggggggaggggaattatttttttttccatagtaaaaagaaaagaagggttgttcttttctctccccccacaaaaaaaaaataatttattttttgttgggggaggagaaaaaaaaaacccgccgggggggcggccccgcgccccccccccaccaaaaaaaaaatattatttatatttttttctttttctccccccccccccctctttttttttttttttttgttggagaggaggagacccacccnccnttgttttctctcctcccccccccnacccctctgtttgttggcgaaaaaaaacaaaaaaaaaaggggggccccccaaaataatacccccccccccaaattcccccccggaaaaacgcggcccaaaaaaaaagagggtcttttttttttccccccccccccccctccctctcttttgggggcgtgtttaaaagggtttaaagcttttttggccccccccgcgcggggttccaatattgtgagatcccgggcctctcccggtttgaagcttcgtccngaaaatcccctgcaag

SEQ ID NO: 664234 - DNA, 370 bp, Homo sapiens
cgacaaactacttacatctcagacatctgcattgcaagagccaacacaaacaaagaaaaatgtattgatttacacaggagactgagaaaactagatctcaagtcacacagttacacagagagctctcattcagatgccgggcatatcagctcagctacccagaaagttcagctttaatgaagactgtagttaaagaatgaaagcctgagcaggaaggatttctgacctgggcaaattctcaatgctctgcctgagtcacactggaggatggagataggctcctcattccagcggacagcagctgccacagtcacaagaccaccctccaaacagcaagggtcttacgatgacaacggggactctgaagaga

SEQ ID NO: 664235 - DNA, 514 bp, Homo sapiens
agcatgatatttttacggttcacctatatgcatgtatcaggaatataatcctttttattattgagtagtgtctattgtatgtatataccacagtttatttctcccttcatcctttaatgatatttgggttgtttccacttttggtcttttatgaataatgatgctatgaacatacatatacaagtttttcagtggtatatattttcatttatctggggtatatacctaggagtggaactgctgatcaaatggtcactctgtatttagctttttgaggagctgccgggttattttctaaagtagatgcttcattttatatactcaccagcaacattttggtttttttggtttttttttggcctgatttaaaatcttaactttgaaaaacttctctggtaagtttattgccacttcttaccaggaactctggctctctgtattattcctgaaggattctctttccaacttgggttgaccacttgcaatatctatggtgatgctcaaagaccttggg

SEQ ID NO: 664236 - DNA, 150 bp, Homo sapiens
tttcttttagaataaggaaacttaaaatctactttctattgactgaacaaagtgctagctgcaaattatcttgaaatcaattggctcttttctagcagtgtgtaatcatgtttgctcctgattcccgaatgacccaggagcatagtgtta

SEQ ID NO: 664237 - DNA, 380 bp, Homo sapiens
tgctgggtgtctagaggatccctccagcgccccaagtgcagagtcagaggagaggcggcgtggagctaggcccctcgcaggcagccccaaatcatggacgcacctgtggggagcaccacatctccacctgcggcctcacatctccccactccccttttggtacgtttaacggttgctttgtacgtggtttacgtaactttaaactgtaacagccttaatggaagaccaaatggtttgttatatgtgtatgtacaaagttttctattaacgctgcccgtctcccttataacctggacgtgagctgtcagagcagaagccactaggccagtgcgcgtctgaggctcagaccctgctgtggttggcttgggggccagctggag

SEQ ID NO: 664238 - DNA, 164 bp, Homo sapiens
gacaaaacgtcctggaactcaagctcttctccacagagtgaggacagagcagacagcagagaccatggagtctccctcgtgcccctccccacagatgtgtgcataccctgtgcagaggctcctgctcacagcctcacttctaaccttctggaacccgcccacca

SEQ ID NO: 664239 - DNA, 353 bp, Homo sapiens
gctgaggtgactctacaggatcctaattcaggatgattacttagactctttgttgacccagtgtgagcggcaaaattggactgacattcaggacaacaaatgcagctggctggtggttcagtgtctggcaggggcactccagaacagtaccagatcctgaaggaaaattacgggcagaaggaggctgagaaagtgtgccgggtgaaggcgctatatgaggagctggatctggcagcagtgttcttggaaccatgaggaagacaggtacagcgcacattatggctctcattggacagtacgcaggaacccttgccccaggcggctttctgggggttgggcgcaaaatctaaccg

SEQ ID NO: 664240 - DNA, 624 bp, Homo sapiens
ttaaggtggccagggcaggatgggtcaaagtcagagtggtgttcatggtcctggaggtggcaggaaggatgccagggccaggaaaaggaattatggacctcctgtaccaactagagtggggaaaaggaagaggaaaccaaggggaccagatgctgccagcaaactgccattggggacacttaacattaagtgccggttaaaattactgaagttagagagatttaaggactatcttctaatggaggaggaattcattggaaatcaggaccaaatgaacccattggaggaaaagcaggaggaggaaggatcaaaggtggatgatctgagggggaccccgatgttagtgggaaccttgaaggagatcattgatgccaatcatgccatcgggcttacatctgtggcctaagaacattacgttagcattctttaatttgtagacaaggttttgctgaaacttgcttgttggaccttgcttaaccacaaggtgcatgccgtgaaagggttgcttgcggatgacacggatcccctggtcacaggcgatgaaggtggggcctcccaggggactctatggttttctttaaccccatcctggtttctttactgggttcgcgttcgctcttctcg

SEQ ID NO: 664241 - DNA, 335 bp, Homo sapiens
  misc_feature (318)..(318): n is a, c, g, or t
tgagatgtagtctcaccctgtcgcccaggctggagtgcaatgccgtgatctccgctcactgccacctccgcctctctagttcaagcgattttcctgcctcagcctcccgagtagctgggattccaggcgcccgcaccacgcctggctaattttttgtatttttagtagagacgggattttatcatgttggccaggctggtctcgaactcctgacctcaggtgatctgcccaccttgggcctcccaaagtgctggggattacaggcatgaggcactgtgccggggccccttcctgtaaaatttttaaatgggagaattngggtgcgagatgttggt

SEQ ID NO: 664242 - DNA, 826 bp, Homo sapiens
  misc_feature (82)..(82): n is a, c, g, or t
  misc_feature (84)..(84): n is a, c, g, or t
  misc_feature (119)..(119): n is a, c, g, or t
  misc_feature (141)..(141): n is a, c, g, or t
  misc_feature (143)..(143): n is a, c, g, or t
  misc_feature (149)..(149): n is a, c, g, or t
  misc_feature (164)..(164): n is a, c, g, or t
  misc_feature (175)..(175): n is a, c, g, or t
  misc_feature (199)..(199): n is a, c, g, or t
  misc_feature (210)..(211): n is a, c, g, or t
  misc_feature (224)..(224): n is a, c, g, or t
  misc_feature (228)..(228): n is a, c, g, or t
  misc_feature (232)..(232): n is a, c, g, or t
  misc_feature (270)..(270): n is a, c, g, or t
  misc_feature (275)..(275): n is a, c, g, or t
  misc_feature (340)..(340): n is a, c, g, or t
  misc_feature (379)..(379): n is a, c, g, or t
  misc_feature (382)..(382): n is a, c, g, or t
  misc_feature (418)..(418): n is a, c, g, or t
  misc_feature (432)..(432): n is a, c, g, or t
  misc_feature (436)..(436): n is a, c, g, or t
  misc_feature (491)..(491): n is a, c, g, or t
  misc_feature (530)..(530): n is a, c, g, or t
  misc_feature (555)..(555): n is a, c, g, or t
  misc_feature (697)..(697): n is a, c, g, or t
  misc_feature (791)..(791): n is a, c, g, or t
gaacgggtcctgcgcctcctgacagtcacaaactctacaccgccgcgtgcgcctgcagacgctccgctcgctgccttctctncnggcaggcgatgacttttctccccgtaaaagggaanttgggctgaaggaatcgctttnanatactnaggaacccgcagcgntttgagggacntgaagctgtttttcttcgttttcntttgggttcannttgaacgggaggntttngatncctttttttcagaatggattatttgctcatgattttcnctctnctgtttagtggcttgccaaaggagctccagaaacagcagtattaggcgcagagctcagcgcgganggtgagaacggagggagagaaacccactcccagtccacnctngcggctccgccggtccaagcgctgctcctgctcgtncctgatggataaanagtntgacaaattctgcaacctggacatcattaggagtcaacacatcacgagcacgatntaccgtaaggacttggaagccctaggtccaagagagctntggagaatttacttcccacaaaggnaacagaccgtgagaatagatgccaatgtgctagccaaaaagacaagaagtgctggaatttttgccaagcaggaaaagaactcagggctgaagacattatggagaaagactggaataatcataagaaaggaaaagactgttcnaagcttgggaaaaagtgtatttatcagcagttagtgagaggaagaaaaatcagaagaagttcagaggaacacctaagacaaaccaggtcggagncattgagaaacagcgtcaaatcatcttttcatgat

SEQ ID NO: 664243 - DNA, 351 bp, Homo sapiens
gagagagaatgaacgctgagtgagccaggaagttgtacacacaaaaggaaagatgaacttagatttgtcaatttaaccatctctttttctttctttccatttatttttttggtctttatagggccgcaccctttgtatatggaaattccgtaagaaataactgcccgcggttatgtcttacggcgggctaatgctttgcacacgattttttaccgagtacaacaaaagacgtactccctctttgcaaagagcagggctgaaagaacaccattataaattcgacctgacttaaaaggtcttaagaggaattatatatctctgggtctatttccccgtaagacataaccgcgg

SEQ ID NO: 664244 - DNA, 323 bp, Homo sapiens
tctaggatgatcccgctactccgcctctcttgagcgggaagagcggacggacaggcccgatggtcgtcattactcagccggattcccttgagtccatccaagaatactactcccccagagtgaaccgatgaactgttggaatcttgaaacaatgttttgcgttggcataaccgcatactgcagtacacggagctttgcttcctcacaggagccaggacatgttgggagcttgcttggctcagaccgcattccttccagttcttggccagcctcatccacacaccagcagttccgaagatcaaaatgtgccaaaggagtgctga

SEQ ID NO: 664245 - DNA, 830 bp, Homo sapiens
  misc_feature (739)..(739): n is a, c, g, or t
tgagtcaggaagagctgcaatcaaccgacactggtcgatagtcagcatctctgttcatacacgcggaatcattatcttaacttgattaggatgctagcctcatactacaatatgtacagtcgcatatgatacccagaatatagtattgtgtttgttgatggagcgcccaatatagaatgtcttttgtgagtgaaacaccctagcttagcgaaatcactgaactccttagctgtaaaacagagctaggtggttatgcacgatttagtcatataggcactatctgtagatatattggattgagtagatttgtatcactctaaagcactcatgacttgcactggatggatctatttcctagctgagcctcgtctgacagctgcacacgtttcctctggcttctctcttttaaatcaagggtttttttgcaggagccttcattcttcacatcacatctgggtgccggggcccagcaggactctggattcggatgaccttggttgaggcaatgtaagacatttgtcctgtttccactacagtattcattaaatttttggctgctcggatcagggtgtgtaactgccacaggctgacttgaaaaccttcccttctagggtggggatctagactataacttcattgcgcatttttagtgggggggagtaacattacttctgtccccgtatgccaaccggtctctttctatactaggcgttctggccctcggtccggggagtatcgngagagtctccgattcccggtgccaatatgtggtgttagaaacccccgctcggtggaaagttatctgtagtggcctgtaggggcagagatag

SEQ ID NO: 664246 - DNA, 819 bp, Homo sapiens
agctgacgtgcgtgctccgtgtgaggctcgcacgaaggggagtggcctgggctggcgcgtgtgagctgagcatcgcagggcgggcggacaggcgcggcctctccgccgggtgtaccacctgtcgcggcgcgagacctctggtgaaacgaaaagatgttgtcccgtgttaagagtagtaaccaccacttgtacttatggcatgtcgacatttgcacataataagacaaaaggcaagccacttatgctgaacccaagaacaaacaagggaatggcatttactttacaagaacgacaaatgcttggtcttcaatggacttctacctcccaaaatagatgacacaacgatattcaagccttacgatttcatagaaacttgaacgaaaatgacctatgccctttggaacacatatatctacataattgggaatacaagaaacgacaatgagaaacttgttcactaggaatactgcaagatgacattgacgacgttaatgccaattgtactatacaaccgaccggttggtcttgcctgctcccagtatggacacatctttagaacgacctaagggatcatccatattcggatctcagacagaggtcactgttacgatcacattgtggataacctggccagaaacatcactgttaaggctgtcgtagtgacctgatggagacagaattcttgggtcttgcgagatcttgcgtgtctatggaatggcgaattccagtatgcaacaacgaagtaagtattaccggcttgttccgggaactacggtcgtgataagcatggcctgcctacttgtggtattgactcttggc

SEQ ID NO: 664247 - DNA, 109 bp, Homo sapiens
tgtgtgatacgtggtatctagtgtgtgcatattaccctggagatatggggagctgaccaggagcatttggattcacattttcagtgccttattgaaacccggaagttga

SEQ ID NO: 664248 - DNA, 209 bp, Homo sapiens
acaaattcgagcgatcgcttgtccgtgagtcaataagtacgcacatgtgctctgctacacttttagagtttcctctagagatgcaatttgactccacttcaggagtcccaaagcaaaatgtccatctctaagatgattatttaactgccatagtcattctgtgctatgatgtactgccagatgccagaaagaaggcacagtggactcag

SEQ ID NO: 664249 - DNA, 139 bp, Homo sapiens
tacatgaagggcgtctggagtcactccccgtagcagcgctggggcggcagggagttgggttggggtgggctttgatgcgggaggtgggtggtgtgcttgctagcttgggcatagacagcagcagtggacctgcctccaa

SEQ ID NO: 664250 - DNA, 294 bp, Homo sapiens
agcttcaacaccacaaaaacattgtgactaacattaaaaaggcaagctgtaagatactcaaagcttataaaggacaaattgcacattgttaagatgccgacatcatttgacaagggctggtgttgtgcatatcgcttctttttttatatgacaaggccaccgacaaacagggcaactatatctgcccccagccaaccacatcacaatgcaattctaatgaaacacataaccactaggcaacccctgttagcatacatccattttcaaaattctctaggctaacaacacattcag

SEQ ID NO: 664251 - DNA, 878 bp, Homo sapiens
tgggttcccatttggttatggttaaacttggtgtatggaatgactcattttaagtctctctttctaatatgcacatttctaagcaggtctgcctatatgctctctaaatacggctctagctgcatccacatatttaaataggattggacagtttaaatttccatgaacttttcccatgactaatagaaaatgtgtataaattctcaaatacatggagcttctcctaaagaatgcctttaatacgtgatttctatctgaaaatccatgggtggttcagagaaatacggtgtgttggtagcaatcctttgaaatccattgagactggcttaattggcaagtacaggtttccatattattcccatatgtgatgggcaaaatataaattggacaattgggggatatagtatacacacaatacacacaaaccatatatgtatttcagtacttcaaaatttctacatatcccgggaataggtctgctagcatccataaataactgagagatgtacgattaggagtagaacttcctttggtggctctctcatttttcttacatatccttatggcaatggtataagttgcatcaccaactgtaaaacatttttttcgcagcttacatgaaagttgtcccctttctattaaccacaaaggtggagatttcctagtaaaaccggcatcaaaaaaagctttgcccttggaaaaaacacacaaatcagcaacaacacgataaacgaatagatcagcacaaaaagaggggggggcagaataaaatcactacaggcgacacgaagaacacacacaattcgcaaacggaccaccatagacggaataaaaagaggcacgcgtaacaacgaagagaaaaccacgtgactaagaac

SEQ ID NO: 664252 - DNA, 272 bp, Homo sapiens
ccagcgcgacttgcgaaccaagagaaccatcgtagaatcctcaaccgtgcggaccatcaaccttcgagaaattcgagttgcctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggag

SEQ ID NO: 664253 - DNA, 205 bp, Homo sapiens
ggtcgatctctagcaggatccccctgttcccggggagtgtgtacctatatatacaggacaagtgttgatagtgtgtgtatttatatttacatcatacttttccacatcacacacacacatatattctgagagctaagtgaaaactctaagcagatccttcattatcttgcgttctacttctaatatttctgtcagtccctaatta

SEQ ID NO: 664254 - DNA, 334 bp, Homo sapiens
  misc_feature (34)..(34): n is a, c, g, or t
  misc_feature (56)..(56): n is a, c, g, or t
  misc_feature (79)..(80): n is a, c, g, or t
  misc_feature (98)..(98): n is a, c, g, or t
  misc_feature (116)..(117): n is a, c, g, or t
  misc_feature (127)..(128): n is a, c, g, or t
  misc_feature (150)..(150): n is a, c, g, or t
  misc_feature (164)..(164): n is a, c, g, or t
  misc_feature (166)..(166): n is a, c, g, or t
  misc_feature (173)..(173): n is a, c, g, or t
  misc_feature (188)..(188): n is a, c, g, or t
  misc_feature (194)..(194): n is a, c, g, or t
cggattcgtatctcgccatgagaggctgtattcnactgatgtctgcgattcagggnccaggattccaaaacactgacannaagtgactacttccccanctccaagatatgaaatcnngcaatgtgcnngatccgactcctgcacgtgaangcaccacgctaggnanactatanatacttctggatggnaatacnctgctcgttagacctcctctgtgtccaggaagcagagggaagaaattcagcgatcgcccagggctccattatgccccactgccatcccagcccaaagtgtgctgagaggagaagctgcacgcaagttctggatcttctcc

SEQ ID NO: 664255 - DNA, 644 bp, Homo sapiens
cttgcccgcccaaaggtgcctccggtccctttcccgagggaaagcttaagagcctgtctcttttgtgggtttaggccccctctcacgttctaattccggcggactttgccacccggcggttctccggcaatgcgcgccccaagcgccgtgaccacatctgcgcccgccgcccatggccttctctgttctttctccgaagtcttcgccctggcaattctatactcggcccctccactttctgcaccgagcgcattgaaggtgacccacgttcaccgcgagggaatataagagtccacaatggccgctccacttataagccacgcccgcgtgtataaatttttgagaccctcttttggcctggcttgttttgcccaaggcccctggccacacgtcacaccacttgggagccctcacttctgcccaatgttatggggcccgcgtggaccctggctcccgccacgcctggtgctgcaccccgccacggaggtcctgccccctcccctgctgctgctcccgctgaggagaagaaagtggaaggccaagaaagaagaatccgcaggagtctgatgatgaacactgggctttggtctttttgactaaacctcttttataaccatgttcccattacaaagctgaacctttta

SEQ ID NO: 664256 - DNA, 1348 bp, Homo sapiens
  misc_feature (1030)..(1030): n is a, c, g, or t
cctttgtggtaagaccacaccgggggaggtgggtgacgccccataatgaggatttgggtattgtaacagagtggtgtgatggtagcactttcatcaagataatcgtcccccacggtgtgtgtcttgtgaatctttagttccgggggggtcggtcaattatatggtgttacccaccctgtgttggtatagtgcgtttcaataaacgttagtaaaaagcggtggtttgtgacacccgctgttgtatgtgggtgctgtttggtattgttctacacaccgcgtcatggttgttccgctgcggcccccccccttcgtgttggtggttttttggtgtgtacaccacgctggagagatgctgctgttggtctccacatatgtgtttagtatgatggggggtggtccccccaccaaggtggtgttgttggtgtctctgtcttgtgttctctccacgtggtgttgaggacccacctctgtagggtgctggtccgcacgccgtgaattgtggttcgaccacgactggtgggttgggttgagttgtttcgtgcgaaaatatagtatggttgtggcggtccacttctgcgtggtgtgttgttctctggtgagtagttgttgtactatagatgttgtgagacacatcagcactagtgtgtttttaatattggagagacactgctttgtggtgtcaccgcacagctactactctgcttgtgtatagaaactctgtcgtggagatgcaaacagaatgtgtagagtctcggagaataatctcctctcttgtgtatacctggtgtggtaataaacactgcgtggttgtgtgtgtgtgtatagttgttaaccaccgccgtgtgtggggggagtaaataagagaggtgcactcaccaccacgcggggcgtcacacaatgtgagaggtcggtgtatatgtacatatgtgagacatcatatatagcgcgctgttgatagtgtgtgtgacagatatatataatatatatgagacccctgtgttaatcgtatatgtacacctgcggtggtggngccacaagagggctcgtgagtatatgatcccacactctggtgtgttgtcatttccacgcgatctgcgcggcaacacatgataagggtgtagactctcgagcgctgataaacctgcatgagaattgtcggataaggatctgcggagactctttggtgatcacacatgtgtcacacacacttattttgtaccccacccccagtctctcgacgccaccctgtgtgtgggtgtgtagtggtgtctgtgtgtagtaagatataaaacacaccaaccaccccttccgctgggcggcgccgtggtggttacaaataatacaagaa

SEQ ID NO: 664257 - DNA, 251 bp, Homo sapiens
tcctgacaataggtccgggtctgccaatacagacacgcagtgagccatcctccctcttctttagtcagcggtcgtgtcttgcatgatatatctagcatctggcatcagaaagtccatcgtgcatgtaatgagccttcaccccttgtttcttcagcctccgtcaccaacgaagctgcgtgttcttctacataagcacagttgctatgttacacccaagacattgatcagtgatgcagaaactgcttaccttt

SEQ ID NO: 664258 - DNA, 2109 bp, Homo sapiens
  misc_feature (2058)..(2058): n is a, c, g, or t
attttttttggcagccttatccaagtctggtacaacatagcaaagagaacaggctatgaaataagggatccagatggcaagaaagaaatttagtggattggaaatctctctgattttcctttttgtcatagttactataatagctattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagagggaatttgtgcacagagaggctgctgctggaggccgtggaatgactctcttattccttggtgcttcttcgttgataatcatggttataacgttcaagacatgacaacaacaagtattggagttgaagccaaattaaacaggataccttcacctacactatttggaaatgacatcaacagtgttctcttcacaactcaaaatcagacacccaatcgtttccggttcaagattactgatccaaataaaagaagatatgaagttcctcatcagtatgtaaaagagtttactggacccacagtttctgatacgttgtatgatgtgaaggttgcccaaaacccatttagcatccaagttattaggaaaagcaacggtaaaactttgtttgacaccagcattggtcccttagtgtactctgaccagtacttacagatctcagcccgtcttccaagtgattatatttatggtattggagaacaagttcataagagatttcgtcatgatttatcctggaaaacatggccaatttttactcgagaccaacttcctggtgataataataataatttatacggccatcaaacattctttatgtgtattgaagatacatctggaaagtcattcggtgtttttttaatgaatagcaatgcaatggagatttttatccagcctactccaatagtaacatatagagttaccggtggcattctggatttttacatccttctaggagatacaccagaacaagtagttcaacagtatcaacagcttgttggactaccagcaatgccagcatattggaatcttggattccaactaagtcgctggaattataagtcactagatgtagtgaaagaagtggtaaggagaaaccgggaagctggcataccatttgatacacaggtcactgatattgactacatggaagacaagaaagactttacttatgatcaagttgcgtttaacggactccctcaatttgtgcaagatttgcatgaccatggacagaaatatgtcatcatcttggaccctgcaatttccataggtcgacgtgccaatggaacaacatatgcaacctatgagaggggaaacacacaacatgtgtggataaatgagtcagatggaagtacaccaattattggagaggtatggccaggattaacagtataccctgatttcactaatccaaactgcattgattggtgggcaaatgaatgcagtattttccatcaagaagtgcaatatgatggactttggattgacatgaatgaagtttccagctttattcaaggttcaacaaaaggatgtaatgtaaacaaattgaattatccaccgtttactcctgatattcttgacaaactcatgtattccaaaacaatttgcatggatgctgtgcagaactggggtaaacagtatgatgttcatagcctctatggatacagcatggctatagccacagagcaagctgtacaaaaagtttttcctaataagagaagcttcattcttacccgctcaacatttgctggatctggaagacatgctgctcattggttaggagacaatactgcttcatgggaacaaatggaatggtctataactggaatgctggagttcagtttgtttggaatacctttggttggagcagacatctgtggatttgtggctgaaaccacagaagaactttgcagaagatggatgcaacttggggcattttatccattttccagaaaccntaattctgacggatatgaacatcaggatcctgcattttttgggcagaattc

SEQ ID NO: 664259 - DNA, 2405 bp, Homo sapiens
  misc_feature (2354)..(2354): n is a, c, g, or t
cgtggtacagttgatatatccgtccaaatctgatacttcgtcaggtgctctcgaaacaaaatgtagacatgaatcgcggcgagtacaactgtattcctgcgctatctgtgtcaattttcctaattggtggttgatcctagaaaacctcaccgacagtgtgctgtaccaagttgattgtactgaatgtctgcgttctcggtttcgccgtacctgtattcgttatcagctaactataagtaattgacagatatgccttaacaaggatgcttcacaataccattgggataaaaaacaggtggatatccaacaattttgtgggcaaaaaaggcccgagactttttagtagtccggaaaatagggatccaacatgtcaacaaaacatattcgtggatgggcgaatctatcagaatgtccgttgtgtcatagatggatataatagggattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagagggaatttgtgcacagagaggctgctgctggaggccgtggaatgactctcttattccttggtgcttcttcgttgataatcatggttataacgttcaagacatgacaacaacaagtattggagttgaagccaaattaaacaggataccttcacctacactatttggaaatgacatcaacagtgttctcttcacaactcaaaatcagacacccaatcgtttccggttcaagattactgatccaaataaaagaagatatgaagttcctcatcagtatgtaaaagagtttactggacccacagtttctgatacgttgtatgatgtgaaggttgcccaaaacccatttagcatccaagttattaggaaaagcaacggtaaaactttgtttgacaccagcattggtcccttagtgtactctgaccagtacttacagatctcagcccgtcttccaagtgattatatttatggtattggagaacaagttcataagagatttcgtcatgatttatcctggaaaacatggccaatttttactcgagaccaacttcctggtgataataataataatttatacggccatcaaacattctttatgtgtattgaagatacatctggaaagtcattcggtgtttttttaatgaatagcaatgcaatggagatttttatccagcctactccaatagtaacatatagagttaccggtggcattctggatttttacatccttctaggagatacaccagaacaagtagttcaacagtatcaacagcttgttggactaccagcaatgccagcatattggaatcttggattccaactaagtcgctggaattataagtcactagatgtagtgaaagaagtggtaaggagaaaccgggaagctggcataccatttgatacacaggtcactgatattgactacatggaagacaagaaagactttacttatgatcaagttgcgtttaacggactccctcaatttgtgcaagatttgcatgaccatggacagaaatatgtcatcatcttggaccctgcaatttccataggtcgacgtgccaatggaacaacatatgcaacctatgagaggggaaacacacaacatgtgtggataaatgagtcagatggaagtacaccaattattggagaggtatggccaggattaacagtataccctgatttcactaatccaaactgcattgattggtgggcaaatgaatgcagtattttccatcaagaagtgcaatatgatggactttggattgacatgaatgaagtttccagctttattcaaggttcaacaaaaggatgtaatgtaaacaaattgaattatccaccgtttactcctgatattcttgacaaactcatgtattccaaaacaatttgcatggatgctgtgcagaactggggtaaacagtatgatgttcatagcctctatggatacagcatggctatagccacagagcaagctgtacaaaaagtttttcctaataagagaagcttcattcttacccgctcaacatttgctggatctggaagacatgctgctcattggttaggagacaatactgcttcatgggaacaaatggaatggtctataactggaatgctggagttcagtttgtttggaatacctttggttggagcagacatctgtggatttgtggctgaaaccacagaagaactttgcagaagatggatgcaacttggggcattttatccattttccagaaaccntaattctgacggatatgaacatcaggatcctgcattttttgggcagaattc

SEQ ID NO: 664260 - DNA, 386 bp, Homo sapiens
cacgatgcttatgcctataatcccagcactttgggaggcaaaggtgggtagatcgcttgaggtcaggagttcgagaccagcctggccaaggtggggaaaccccatctctaccaaaaaatacaaaaattagccaggtgtggtggcgcatgcctgtggtcccagctactcgggaggctgaggcaggggaatcgcttgagtgtgggagacggaggttgcagtgagctgagatcacgctgctgcactcctgcctgggcgacagagtgagactccatctaaaaaataaaaataaaaaatccattaatctgcgcaactgagtttatgccaaatcttcaactgggagagattaagacagaagtattaagattaaaagaattctggccgggcat

SEQ ID NO: 664261 - DNA, 438 bp, Homo sapiens
aaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccaaaaggaaggaatcctgcacagagaggccaagaagaatttagacagccttgctgggtttcccctctcagtctattactattagatcataccctttttgtccaatcatatttttacacagtccatagtttgttgaacctaaacataaaaatggacaattcccctgtatcttggggttttcattttgagggctcacatacaattatgatcaaataaatttgtttgctttttttcctgtta

SEQ ID NO: 664262 - DNA, 322 bp, Homo sapiens
cagttgagatgcacccactggatgaggctgaggcagagcaccacatcatactcaggtttttgggcctccaccagactcatctcgatccagcacatagttaccctgagggtgaagagttaggggtgaggtcaagagacgcattcaagaaccactgccgcccccacagtccactctgcagcctcactatagtcctggccacaacctcctctgacatgcctcaaaataactcccaaacggtgccctctggtttttttgggcagcagcaggaggaggacagcagcaggaggaggacagcagcaggaggaggacagcagcaggagga

SEQ ID NO: 664263 - DNA, 280 bp, Homo sapiens
acgtccaattaggtgcatgagtatggtggcctgcatgtattgttagctgtgttaggcgtacggccagggctattggttgaatgatgttggctgatggttccgataataactagtatggggataatgtgtggtgtatggtgtgccttgtggtatgaagtgggctagggcatttttcatcttagagcgaaagcctataatcacttgcgccctgttcataaggggcatggccatggctaaggtaaatagcatagtggtggtaggttaggttgtaacatgagtg

SEQ ID NO: 664264 - DNA, 214 bp, Homo sapiens
tggttgatctagaggatcccagttttaaatgggaagtgtactagtcgttctcagctgctaataaaaacatactcgagactgggtaacttataaaggaaggaggtttaattgactcagtttcacatagctggggaggcctcacaatcatggcagaagatgaaggaagagcaaagggactccttacctggcggcgggggtgggcaagagagaatga

SEQ ID NO: 664265 - DNA, 309 bp, Homo sapiens
cctaagtggaactgcccgtgttagtttgctaaggataacagcctcaagctccatccatgttcctgaaaaagacacgttctcattcttttttatagctgcatagtactccatggtgaatatgtaccacattttctttatccagtctatcactgatgggcatttaggttgatccatgcctttgctattgtgaatagtgctgcagggctggttgttgttgttgttgttttttaattacatttcttttttttttttttttttttttttttggaaaccggaccagtccaattaggggggtacccgaccccaatt

SEQ ID NO: 664266 - DNA, 247 bp, Homo sapiens
gccaccaaagaggtgttgatcttgatcgaaacctggagggcccttcaccagctgcagtggtaaatatctcaaatcaccctatagatatctgatagtccatccggatgtaggggcctccaaggaacaagattgttagctgctccatggtgcataagttagatacacacttggggtagtgaaaagaggcccggtaactcttcctctatctctctctctctctctctctctctctctctctctctctctc

SEQ ID NO: 664267 - DNA, 440 bp, Homo sapiens
  misc_feature (77)..(77): n is a, c, g, or t
ggaattgtgtggtgttatggtcccggcactcacaggccgccacttggcgcactctcagctccccccggctccatttnggtttctctttgcaccacttcggtgtttggcgaattcgagaaccttcgactctccagatggttctcgaaccttctagagagttgtagatctctcgaaaatcttcaatttaaaaaaaatataggcctcatttggccatttgtagagagtaaaaatccgatttgaaactcacattcgtgcatcaacttcttggagctcttgtattcggtttctcgggatttcaactgtctttggtcgcgattttgaagaaaatcctccaaatcgcattgtagatcatcctcttcccgacacacaggtgctaagcttgcattatttagagctattttcaattttatatctattttacggcataacaccacacaatt

SEQ ID NO: 664268 - DNA, 293 bp, Homo sapiens
aatcgagctctgtacctgaacattcgtgtcctaatactctattgatccaataacttgatcaatggaacaaaataccctagggataacagacgcaatcctattctagagtccatatcaacaataggggttatgacctcgatctgggttcaggacatcccgataatgcagccgctattaaaggttcgtttgttcaacgattaaagtcctacgtgatctgagttcagaccggagtaatccaggtcggtttctatctacttcaaattcctccctgtacgaaaggacacgaatgtaca

SEQ ID NO: 664269 - DNA, 157 bp, Homo sapiens
ctgtctaagtttgatccgaactagcgtggtcgatggactgccgtccagttaaggagacaggccacgctttccagtgcatgcgctcactgatttcatcctcaagtttccgcactgtgcccaccataagtctgtgcgacaagcctggcagaaggcagac

SEQ ID NO: 664270 - DNA, 197 bp, Homo sapiens
gtgaaaatcccgacgaaaggaatttaggccggacacagtggttcacatctgtaatcacagcactttgagaggctgagattacaggtgtgagccaccatgcacagcttcccagctaatttactttttcttctttaaagatggatctcgctatgttgaccaggctggtttcaaactcctgggctcaagcgatccgtctg

SEQ ID NO: 664271 - DNA, 783 bp, Homo sapiens
ccatccagtgttccgatgcactgtaccttcttgctagtatcaggtgccttgtatcccacatgcagccatgctgatggatgcccttatcagcaggcttttgcatccctgcagtctggggatgttactccctgatcaggtgatgctctattcttacccatcagtcagatgggacagctagtatcttccgcttcttcctacttcccctctgctgagttacatcccttttgtccagccctattatccctaccctctgatggtactcctctctttagatgtctgccataccccctgagaccctccccgtatggcaggagtatggttcctgctgtacctctttccccaaggatatgggttctggctcgacaatccggagggcccattgatgcactagcccctatttttcttccagtgggatatggcataaacttttagatctcctcttctcccttctcctcccttagcccttggatcaggatctaggggctctgatttttggattctgcaaaagcttggtatgacacctttggataaagcataagttctgatccaggtcacagatcaatctgcaagtaccagattcatctattgcctacactgacacaaatagccctcctcacacatggcacaagctacacacacacacacggaccctcatattcaccccccttgatcaaccacttatgaatatgtatttagctaacatgagtgattttagattttgttttaatcgtgacataaagtataaacataaaattcaacggagggataaataataatacagga

SEQ ID NO: 664272 - DNA, 193 bp, Homo sapiens
aatgggtgcacatgcgctcacattttgggccggcagttttgtgctggcagacactgacgtcgttcgacctgctcagcggtggatgtgggcctgcgacgaggccccaggcttgggtgcgccgtcgatcagcctggccgtgacagatgcagctctcctgcatacgtgcagctgggacacagccatagtatcgcgc

SEQ ID NO: 664273 - DNA, 794 bp, Homo sapiens
atctcctttaaagatcccaatcccatgcatattgatgcgtacctttcaagatcgattggaacctggtattgtgcgtttccaagtccgtgagccgaccatgtcaccagattgatctgtttcaagaaagcaggatggactatcattactccgtccaacaccaaatcagtcccagacgatcatccactctggatgtcgatccaatatggctttccatgaatgtcttcactgcttagatgacaataacgtgttcatggtggatgccaatgtaagttcctaattctaacagagatgtttgcaaaagctgggtatcgactaccattaaagttaacattcgtaatgccaattccctgggaggaggcttccattgctggacctgcgatgtccggcgccgaggcaccttacagtcctacttggactgaacaggcctgatggatgcttgtggctggcctcagatacacctaagaagcttaggggcaaggttcattctcctgctttaaaaagtgcatgaactgtagtgctttaaacagatcatctccttaacaggggtcgtaagcctggtttgcttctattacttttctttgacagtaaagaaccctaacttctgctaggtatgactctgtagtcctaaagttatttactatttgggcttgcaagttataaaatcttggtgaatgtgtaccaagaaagaaattagtcactgagtaacttgtgctagtaattatttaacagtctaactctgttattgaatgttcttttcgaaaaggcagttgaaattgttggtcctaatctgaatg

SEQ ID NO: 664274 - DNA, 175 bp, Homo sapiens
agtcccttccgtatcctatatctaacgtccttttctcttcttttctcttcaaaatttctcttcttcctatttccgctccctgaagcacttggtaaaatctgtccttttatgaaccatatcacctgaacctcttttaggtttatttttttttttttatttttttattttttttttt

SEQ ID NO: 664275 - DNA, 1479 bp, Homo sapiens
agttgcagcagcaccagcaggcaaccccggcacagcagcacgtgcacagccactgcaatgaactcagcatcagcaatgactgcaaaaagccccagcagccacatgtggcaggcaggcatgcacgatgatgcagcctggcaccagccaagctccaattcatcaagccctcccacccacagcagagtcccgtggcaaagcagcctgccagggcaacatggcacgaaagagcatgcatgcagcagctctcaattccaagtcactcagcaacacacggctgctagggcagcatgaggtcacatgatgagatggacacgagtccagacacagacccacccaagtgatccgaacagctccaccccgcgagcatcaaccagctgagataaagttgacgcagctagaccaccaggcgacacaccaaatacacaccagtggaacactctacctcgggacgaactctagcgcaaggacacccatccgaaaacacagggacacacccgagtaagtcggtaacaacaagcgaccagcggtctcatcggaccatcactaggacgatccagacacaataccaactcacacaaaacaggaccgacagcacagacggaattaatacggaacgctccagggaccctagaccaacaaaccagtaacacagcaaaccaagcacgtaacccacgagacagcatgggagcgcctagcacacacgctgccgataaccaaagacacaacaacacgaaaaacaggggagcggcgcaacggcgataatgcgagagccaacgcgggcacgggagcggaagagtcaatgacagtagccacacacgactccaacagacaggcgaggacacggctccccaaacagagcacatagcacagcggcagcgacgaagcggcacaggctcacccacacacaacagagaggaacaattcaataacacaccgaagcgacacgacgacaagcaaaggcagaccccaaagtagaagagcggagagaacgtagggcgaacccatggacatgagtcgaggaacggcgcagcagggcaacggaacacggacacgggaagccagcgccaagtgacgcagaaatcaagaagcaaccgtgagagcgacgagacgccagaggcaagaaaacacagccacagagacagcgcaacactgacaacacacaagggcaacccaaccaacagagacgcaacctccaaagacgacagaagatagcacacaccaggggactacagggaacacaaagaaagaagagtgaaaggagcgaagaactaacgaacgcggaacaccagaaagaacaagaagcaagcaaaaaaaccgaggagacgaacggaaagaaaacgcaacaagaagagaggacagcaagcacgagacgagtcggaagaaagtcaacgacatacgacaagcgaccggagaaacagacaagtagcgcacatgacaaaaagccaagcgacagatcagtagcaggaaagaactcaatct

SEQ ID NO: 664276 - DNA, 166 bp, Homo sapiens
tgccagagacatcctttttgatacttttatggtacaggctgagtggggcgccctcacctccagccagctttctgcggggtgttcagcacttactagctgaaacatgtcctgtggagcttccacctggccagggaggacgggatttgactatccgatgggaggaccc

SEQ ID NO: 664277 - DNA, 317 bp, Homo sapiens
tcggactagttcggatgatagggatagatagtactagggaggacgctcctagtttgttagggacggatcggagacttgtgtaggcgaataggaaatatcattcgggcttgatgtgcgggaggggtgttacaggggttgggtagggtgtcattgtctgggtcgcctaagaggtcttggtgagactacgtgttaactggtcttacaggagagacacggagacgaagtacgccgacggcgtctttgcttggtgtactcacgggtggaaggtgactctatcggaactggggaggtgattcctagggggttgtttgatcccg

SEQ ID NO: 664278 - DNA, 188 bp, Homo sapiens
gtttttttttttggcccccccggcggtttcccccaagttttgtttttggcatttggattttttcccctttgggatttttcttttttggcccttaattttcccccctttggggttggaaaaccctttggggttgggttgggttgggccctttccccccccatttttttttttaaaaccctggggccgga

SEQ ID NO: 664279 - DNA, 381 bp, Homo sapiens
catgaaagaaacaaaacccaattttatgtatgtacgtatgtatgtatgtatgtattttgagatggagtttcattcttgttgcccagactggagtgcaatggttcagtctcagctgactgcaacctccacctcctgggttccagtgattctcctgcctcagcctcccaagtagctgggattacaactgcccgacaccatgtccgactaatttttgtatttttagtagagatggggtttcaccatgttgatggggctggtcttcaactcctgacctccagtgatctgcctgcctgagcctcccaaggcgtgagccaccatgcccagcttcttttggcattttaaagataaagactcattatcttctggcatccattttttctc

SEQ ID NO: 664280 - DNA, 618 bp, Homo sapiens
gtctgagcagctgggaatcgctataggcctgtaggccagtcaccccataggcccataggccctatagtcccttttaccccgcataggccccattggcccataggacccactggcctgagccccccctggctccaccggctctggtggccccactgggccaactgtgtccagcgctgcacctagtgaacaccacgagtcctacatcagaatctggacccaaccagcaggttcattcagcacatggttgcaggccctggttggagcaaatgctccacaggtgccgaatccagaaggtcagatttcagcaacaactggaacagctcaacgcaatgggggttctaaaaccggtgaagcaaatttgcaggccctaattagcaacaggaggcgacatcaatgcaggccattgaaaggctgctgggctcccagccaatcgtaatcacatttctgtacctggacacaaaaatgtatcttatttaacagcctccaggaaacccagggctgcgtttccaactatgccacagaagcagagtttttccttgtgccaagagggtctgatgagaagacctggttgccccttctgagaaaagaggatgcttgtaaggatggctcaattgctct

SEQ ID NO: 664281 - DNA, 177 bp, Homo sapiens
ggtcttggctggtggtttatggcccgggccttctttctacgggggccagggtccaattttccacctggggtttaaaagttaaggaggaccagcctgggaacccctcgagtggggacgccatttctattaccagggcccccttatattttaaggggacaccatatggagattttatgc

SEQ ID NO: 664282 - DNA, 327 bp, Homo sapiens
tttttcccattggtccctgtcatctttgatctactctatatggggacagatgacctctgaagggtaattcatattggggtctctgggaaaggcaaagagcagacaggcactccgagacaggcctgttaagccctctttagggttcattgaatgtgaccagacgaataaggagggttctctgagttaggcctgctggacttccatcagcaacccctctgagatcccttccacatatgcaaacacacacaaagatgaggacagacaggaaggccttccaaatcaggtcccttaaccaaggaggttccaaggattattcccttatttcca

SEQ ID NO: 664283 - DNA, 113 bp, Homo sapiens
gggaaaggacaaaagtaaaaaggcgttattttaaacgggccttcccccgtaatagaagtcatctctcataccgagattatgtggataaaaaaggaaagtaacagggtttgtta

SEQ ID NO: 664284 - DNA, 107 bp, Homo sapiens
caggtcatttgagtatcattaagagtagtgatgggaagattacagtttgagggccaaacgtgcctgcttcctgtttttgtaaataaagttttgttggaacacagcca

SEQ ID NO: 664285 - DNA, 943 bp, Homo sapiens
agcatgattatttatccatggcttctaattatgtgcttgtcttggagcacgaactttctaatggtctgttaattagtctacttgttgttgatctttatggtgaaagttgtcaaaaaaaatgagtaaagtgtacactttagaatagttttatctgttaatctttctataagtctttaaatttacagtgtcatctcaggtagtttacaagtgcatgataattggaacagtctgattagtattgaattcagttgctgagtggaggggaccacactcttgtcttctactcttaagtgcttagtaattaggagtggaaggaaaacagtatatgaccctgtggttaaattagtaaacgttttaattctagggtaagggtagctggtcatcattatctctgttgctttagctttacataaaggtcccataattcgaatcctctatgaatccattaccctgccatgttatccatttaatgttattccattgaatgcatttaatctaagtgaactcttcatgcaccgttttgggaacttaagtggtttaaccattcttcctgtccacatggagaaacctatttgacaagtttctgtccaacgtttacagtttatgcgggtagaattctcccctccccccaataaaggatttccttctttaaccactagtggtattacaccatttaacggggtgatctggcccaaccaagtctttgcacttaacggtgcttttacacctccacaagcaaacccacacacaccgacaacacaacaaacggaagagatacaaaaccaccccgaggcacaaaccacacacgagttataaaaagaaccaattagaataaaaacaaatacgtacatgacacctgaaaaactgccttgtataagaaacactaaggagacaaaacaacacgaaaacacccaagtcacatcagtcaacttaggaaatacaa

SEQ ID NO: 664286 - DNA, 1244 bp, Homo sapiens
taaaaatttaaatcttaaattcccgtttccacgtatttccttctggcttccaaaaggaaaggagttgcgatagctcgtgtggccgtgtacatcgtccacagccccgtgggtcggggcggggtccccggggccgccgcggggggtcacacatgcagccccgggggtgggggcctggcgacggggttaaggtccgggggccggcctatatggctagaggtccgggccgggttgggggcccgccgctataggccgccgctgggctgggcgcagcctcctgggagacaactagaacgcagaccgacaaggccgctcacaggatcacgggcgtgtaaacgcctcagaaggctcgttagagcgcccgggcggccctctcacaaccacacacagaggtgggctctcccacacacggcctttgcggggcaagcgcgctttcgattaaagagcccgcccaagccccgggtgcgacaacagagtcgagatcacacctctcgggtcctctccctggtgccctggtggagatgtagcatgagaaccgccacggctgcagacaccaccgtcgtggcactctctgtgcggcaccccaccccttctctcctccaaacgtcgctacaacgggcagaaaacagcgccgcctacaagaaaacgcccaggacgaggcgccccatcaccctgaggcgactgtcctcccggggcgaacagcgccagcaagcaccgcgacaatcgttcgccccccccgagacggggttcatgacacaacgctgccgtaccaaccatgtgtgttgcacgacagaacaaaccacaacactccaggcgcacggcgtaacacaaccaactcttcagcactctcaagccccgtccacgacaagagtagccccccaaaggaggtcgtcccacaacaacgtaggacgtgagcgtgcaagccacacaccccccggatgatgcacccccgagcaacatgtcggcgcccccaactgagttcgcacaccccggcccgggatactcaaccccgcggcgggcgacaacgacgaaaacctcgacgcctggtccgatcacccccagccgggtgggagcacaatgactaacaacatctgctcccgcgattaacacattctcccgactggtggagagttctgccaccacagcaaggggggagacccctcgttcgcgcaccaccaacgcgtgtcaccagggcgagcactgttcagcaacagctgttctccaggagcgagcgataattcatcgac

SEQ ID NO: 664287 - DNA, 1356 bp, Homo sapiens
  misc_feature (1356)..(1356): n is a, c, g, or t
ggatcctctactcatctcacgacataaccttcgccgaccgctcactacgcgtactctaatcgctgcgggtctactcatcctgtgaagttcccatcaggtcatgagtctcttaggcctatcctgtactttcgatcctccagacgtttgccgacctcaggcgggaaccgtgtcgttccgctagagcggacgcaacggatgcgtactggacgtcgagtaccttcgataggcctgatgcaattgtgttgctcatcctgtgcatatcaatagtggtgactcgtcaggatgatcctggaggctgttgggacaagtagatgtatttgtcctcacttagattcatatcaggtagacgcgcaccgaaagttattgcgcagtatggctcgctcggttgtttgacaccccacaagattgtatgtcgtatcatagcatattcgtttgagccatcaactattccttcatgcgcctgagcattcgcgtgactaccgacgtttcttagccgttatagaggtttgtgaagtgagcgcgggaggcaaggcaaagggaaaaccggagggtgttagaaaaacggtgggtacttaaaaccacgcttatctcgctttggcaccccaatgcgtgcacacatttaacacttcccgcattagaccctgaggtgggatgcccattacactggtgtatgggaaccctgttataacccacatctgtattcatcccctttatacacatcccattaaagccattcgatgttcagactatcccctttcattaaatctataataacacgtgttgggacacaacatccacaaagtaatatccaatatacaaacgaaaaactataacttttaagttccacaacataactgtatatagaacccacacctaccaatttgcacccaatgtttaatgacgcgccagaatatattcagccgaaacacgcggaatgctcctctgttccgttgtacaggttgcattgtgaatttggcgccggtatcggccaattacgaggttcaaaagccagagtgccccaggattgccgccttaagcgattatcgtttccgcggtaactgtcgttaacgtttacccgccgaaagagttaccgcctttaccgcgcggtttgtcctatttgtgtgcgagacattacgaaacgtttaagttaaccgttaaccataaaagtccacgggggacacccgggagacagcgcccctttccgaagtggccaacactcgaaacccgctttattccattttgcgggaaacaccgcccaccaaggaccacggaggacaaagtgggacaagcccaggaacgtgcaacgtccacgcccgaagtattagttcactttaacattatagcgtcaccaaacan

SEQ ID NO: 664288 - DNA, 167 bp, Homo sapiens
ttacatatctgaacacacaatatctagaccctactgcgattagataccccactatgcttagccctaaaccctcatatcagttaaatcaacaaaactgctcgccagaatactactagccacaaacttatatactcaataggacctggtcggtgccttcccatatccct

SEQ ID NO: 664289 - DNA, 783 bp, Homo sapiens
  misc_feature (272)..(272): n is a, c, g, or t
  misc_feature (343)..(343): n is a, c, g, or t
  misc_feature (362)..(362): n is a, c, g, or t
  misc_feature (743)..(743): n is a, c, g, or t
  misc_feature (749)..(749): n is a, c, g, or t
  misc_feature (755)..(756): n is a, c, g, or t
  misc_feature (760)..(761): n is a, c, g, or t
gctgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttgggacgatttgccagctttgangctcaaggtggcatgggccaacatagctgtgggacaaagccaacctggaaatcatgacaaagcgctccaancatatactccgatcaccantgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaaacgtggtgtgtgccctgggactgactgtgggtctggtgggcatcattattgggaacntcttcntcatcnngggnntgcgccaaagcgatgcagcaat

SEQ ID NO: 664290 - DNA, 976 bp, Homo sapiens
ggtctgaaaaccctatccgcgttcatccgtgccttcaggtgtccccgccggatgggttcgtgactcctgtaggccgcgccggagacccttgcgccacctgcgccgcggagaattttctcaatggcgggtcggcctgtgggtcgccctttccgcctactcaggtcctattcactgagtagctctcccatctatccgaccggggacttgggtctggtgtctggagctcccgtcgctctacttggtgtccggacatctacgggggagtccgctcgtgggccctgtcccgcctccagtcatcgaaggaccttaatgactcgtctgggaagtgtctttaccaagagctagtacctgaagccgtatgttggaacctccagtcgcgggcactgcatgtcgccccattggttcagactttctttctactcccgtccagtccaggcatagaggttctgctccagtcaaactacccccttgtaactgatgggcgtgttggtcgcggaagctcccgttgcacccggggaatgccagtgctaacgcgcacgcaaagtttccctgggacgcacgggttgggaagttcgcacgcactcactcttttgaacgaaacttactcgattccccccaagcaaaagggcacaaagggactgccttttcttcgaagcggcacccgggtcaaggggttggaggccagccgttttccttgaattccgcatcacaaggccttcgagatagccccacccggtgtctttgtccccctttccaccgtgcttgggactcccccgggttagaagtcccttggaaccgtttggggaccatcagtaactggttacctcgattagctttgcgtaccggagtaacgttccatgaacccccttctagctacccgtgggctacgagctggcggcttaggtagttgggaaacccacccagacccttgggacttcttttaagcaaagccttgcaccggcgcgacgccctttgg

SEQ ID NO: 664291 - DNA, 1042 bp, Homo sapiens
  misc_feature (272)..(272): n is a, c, g, or t
  misc_feature (343)..(343): n is a, c, g, or t
  misc_feature (362)..(362): n is a, c, g, or t
  misc_feature (948)..(948): n is a, c, g, or t
gctgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttgggacgatttgccagctttgangctcaaggtggcatgggccaacatagctgtgggacaaagccaacctggaaatcatgacaaagcgctccaancatatactccgatcaccantgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaaacgtggtgtgtgccctatgcctaactatggacctgttgggtatcatatttgtttacattttcatcatttaagggagcactttaatagaatcgactctattcatctcaaccactcgcccgcacctaaacacgtacgtccttacttctattacatccccctacttgtttacctttcttctttacaaatccctttttattactttactttctttatctcatattttcttctttcctattttttttctcctttcatttttctcttnctttctctttttttttctttatacttattctcatcttattccctccgtcttcctcttcttctctcgcttttttctgaccaccaaacactatatt

SEQ ID NO: 664292 - DNA, 180 bp, Homo sapiens
agctaggcttctatcttcataagatcatagatacaacatgtgtaagccatagagatcttagctaggcatagaacatcagcagagcccacgagatgttccctcaacaaaagaaagttcgacagctgagctcatagatctcttgacactttccggctgtcgatcattactttccatcattac

SEQ ID NO: 664293 - DNA, 202 bp, Homo sapiens
gtgtgtcgagataaggtgtgtcagggcttgactggacatagtggctcacgcctgtactcccagctactagggaggctgagacaggagaatcgcttgaacccgggaggcgaagaggttgcggtgagccaagatggcaccactacactccagcctgggtaacagggaaactccatctaaaaaaaataaaaaatgaactgttggt

SEQ ID NO: 664294 - DNA, 309 bp, Homo sapiens
  misc_feature (43)..(43): n is a, c, g, or t
  misc_feature (221)..(221): n is a, c, g, or t
  misc_feature (232)..(232): n is a, c, g, or t
  misc_feature (258)..(258): n is a, c, g, or t
  misc_feature (261)..(261): n is a, c, g, or t
gtgcttagggtgacttaactaagaacccaaccggctttggggngtgtaaacagctgtacggtcgatccggattgtcgaccagcgtcgcgggaggtagagggtcgacgctgcttcgttgcctggatcgtcgcggcacggcggtcgatggccgccatggagtccacgctgggcgcgggcatcgtgatagccgaggcgtacgacagtagcgtggactgttggcntctgggatcanccttttctgggctgatcccagacttncgntatccccgggctactacgccctccgcgtgtggggcatctgcggtgttg

SEQ ID NO: 664295 - DNA, 517 bp, Homo sapiens
gagctcggtaccacttgtccacggttggctaaaggtccgaagaaaattgtggcacaactacaggcatggaatggcttcataagacaagcatcaacctcagtgttacacagcaggagagcacacagccctcccattgctcagatgtccttggccactgctttctggaagctgcactcatttaggaatgaacagatgcaactggcagaaaggaggcagaaggcttttcaaaaagcagcaggaaatgaacaagtagagaacgcattcactgagaccctggcaaaggatccaaagcattctgtaaaaggagttcagagcctgggagtcaatttattggatttgcaaaaatcagtaatggatagtttcagtgaaatgaaatatttcttacaagtagatatcacagggcatgcttacacttccccgggacctctcctttcacaaggcactatattcagggtatttgggaaacatttggactaacaggctgacttttactatttaatatagaatcctgcaaaaa

SEQ ID NO: 664296 - DNA, 325 bp, Homo sapiens
attacaggtgttgagccaccatgcctggcctgtcatttacttctaacatgggggtatttttctacctggctccagtgaccaaattgctgaagcctttttgtgaacctaaacctttaggattaacccatccaaaaccaaaaattaagttgataagggaggaatattgcctctccttttttcccttttaagaccaaaacccattaaagtaagccttaaattgaaaacccaggggatggcaaccaatattggatttgcccccttacccttattaggcgcattaccaaaagattttgtgaaggggaggaccaaggagccacgaggtgcc

SEQ ID NO: 664297 - DNA, 461 bp, Homo sapiens
  misc_feature (268)..(268): n is a, c, g, or t
  misc_feature (309)..(309): n is a, c, g, or t
gcgtcgacgttttattatctctcattgttctgtgggttggactgggtttagcaggtggttctgctggtctttcttggggtctcttatgcaactgcagtcagatgaggctgggactgccacattcaagatggctttgcttacatacctggcaccttagtgggggttggtgaaagactgaagactgaaaaaatctccctccctctctctctctcttcctcttactctgtctctctgtctctcccttctttagccgcacttccagttctgnaatcatagattcatgcttgtttttcagcttggtaagattcntggccttttcttcctcttctgcaagatttgtcggtaagtcacttatcctctcctcaaggagttttcgttcttttgatagtttattgttctgatcatccatgaccacgatctcatcctccagtttcttgatcttgctctcagccgtgcctctc

SEQ ID NO: 664298 - DNA, 116 bp, Homo sapiens
aaaattagtaaagggaccatcagtttgacaacctgttcggtgtactccacaaagcctgcctttaactccttagcatagcaaaccaacatctggcaaggcagttgatttttcttcta

SEQ ID NO: 664299 - DNA, 581 bp, Homo sapiens
  misc_feature (77)..(77): n is a, c, g, or t
agcgatcagaggatcccgtaagaactcactcccctcccctcatactccggctcttcgagagggcattcatctactantgagggatccatccccatgacccactcacctcccattagactccacctccaacacggggatcaaatttcagcatgatatttggaggggacaagtgtccaaactatagcagtgtatatatgtgtatatgcacatataaacgttcggttttggtagtcaatgcttattaacattgatgaactactagaactaatgagtgctaaccttgacggatataagatcaatatacaaaaatcaacagtattccaatacccaacaccccaaattagaaaacactattttaaaacagatacagggtcgagtgaggtggctgatgcctgtagtcccagcactctgggagggcgaggcggatggatcacgaggtcaggagattgagaccatcctggctaatacggtgaaaccccgtctctactaaaaatacaaaaatcagccgggcatggtggctggcacctctaatcccagctatttgggaggctaaggtgggagaatggcttgaacctgggagg

SEQ ID NO: 664300 - DNA, 1684 bp, Homo sapiens
  misc_feature (138)..(138): n is a, c, g, or t
aggttataggactcaacaggtctcctctgtgtttgcctcgatggcgcatcacaaggcgctctccacatgtttagacagtcgtgtctgtcgctctcaattgtctagaacgataaacagtgaccgaggacacatgtgggngggcacaacattgtggggagggccacataaaaagcgcgcccgtcgtttgcctggcaggagtgatgtgtgcaacaccctttgttgggtgagaggacgtcctccctttttgtgggggctacttataacagaagtgtggctggctgcatacaaagtgtgtttgaaggcaagtgtgtcatgaaaaaacacagattgtgtgggggcgctggctgccaccaagttggccggcgccgatgtgttgcgctctcacaaagtgtggggcggccctgctcctaataaaaaatagcaacagggtgcgccctcatgctgccacatagtgtgcgtgggccctctccaagtagaaggatgtgtttaattattgtagtcaccctcgggggataatcctaatacgccgtcgaataggtagtaagtagtaagtagtagaaagattggtgttctgcaagaacaatctgcctgccttctacaagttttcttcggaagaggggttcctactactccgtagtgggccgaaaagaaggagggcgtattaatgtatcctctcctgtttctcccgcgaaaagttgttcttgtcctcaaaagcacagtttgaccatcctgttcctagaacaagttgttttgtgagcacccactgagctattcccccaacaattattctgacagcgttgttttgtatccagcgtaccacaaaagatgctcctcagctgaaaatttatctatttctttttttatcacggtaatcatgctgttcctaaagagcactgttcttgtttctgcgcgcaacaagaacccgtggtcgtggttgtcaacagcaccgcggcggcagcaacgggggcgcgtttatcgtctctcgtaaaatgggaaacctcgtcgcggcttctcttctttggaagacttcgggaggacacacatcgcctctgtagaaagatgtgtcggtgctgtctcaacagcgccccgccgagattttcctctcgagagagaaaattgtagagacaccgcgagagagcacgcgcgcgagagagacacacacgcagaacgtcgcgagagagagagagagagatatagggtggcacaacagcgctataacgcggggggtgtctccgcgagactctcgagaggcacctgtgtcaccccctgtggcacacacacaccacacagtgggggcgcacacttgctcacacaccacggcgctctcacgcacgagtggtcgccgccagaggcgcccggtgtgcgttctcacaccgccacagcgcttctctccgcacatctcacacgcccgcgcggtggcacaaaacttcttctccacagaggcgagtttctgccgggtcgaaccgggaagaaggaaaggtgaagtaatgagaggctgcacacacaggggtgcgccccccacaacgtttctctctctcagaccctcacactgggcggcaaagaaggtttccccggaattccaacctcacagaacaaatgtgcccaattgacccatctcgggaaatgaggagagccccccttggacccaatgtttgcttaatgtgcttcactgtgaatttcttta

SEQ ID NO: 664301 - DNA, 1010 bp, Homo sapiens
gattcattccagaaacgtggagctccttgtcgcgctcagatgtcacatctggtccatgccaactctgtgtcgtgtcttttattgtgaccattgccccattcctcttgccctcgaaccataggtgagcagtctctgttgctactttctccagtgtctcccaggtaagtgtgaaacttctctgatttactgaacaaatccagtcagaattactctttgctgttatgtcctcatggcttttggatttgtgacctccgacttatacatattatcacaattctacatgccagcttgtgatgaggtgactactatgtaccaggcattgaggatgcagtagtccacagtgcaaagatcgtctgtcccttatggatggagctgtgtatcgtatgagagagaggacaggcaagagtgacaagaatttgagatagtgatataggctacggagaaagtagataaagtagggacaggggacatatgacatgggagtatggagctagagattcgagatttaatttcagtagatcagggaaggttcctaaagaacatgactttctgagtaaagacctagagaagtgggagaagattctactcagaacattctgacagttcctggggtagaaatgtgccttgtctgctcaagggcaaggacgcgcgtgtccactggtggtggtcgtgcccaaggttgagagacatccagggggctgctttgggtgcctgggctggagccatattcccgggggcaaagggtggttcaagcccccactctcaaggggtttgcacaacgccggcaagtggcactggaagcactgaaacaggtggtgtggcgtacccccggcggaggcgcaatccagggggggtgatcccaacaacgacagtagtagcaatccccccacgaacctgacagaagaaaggggtcataacagaagtaagaggagccgcccaaaaaaaaggcgtcagtgacacgaggcgggtgcgagaatcacaggccgccaccaacaaggcgtcacttcgac

SEQ ID NO: 664302 - DNA, 126 bp, Homo sapiens
aagcacaactgagtacaacactgaatactgtagaaatgcactttgctcagtaatacttgagtagtcgcaattatttgacttatccatttggttgttacaaaagaagattcttaactgtaattcgat

SEQ ID NO: 664303 - DNA, 584 bp, Homo sapiens
gcaactctgcctcccgggttccagcgattctcctgcctcagcctcctgagtagctgggattacagatgtatgctaccacgcccaggtagtttgtgtatttttagtagagacagggtttcactatgtttggccaggctggtctccaactcctggcctcaaagtgatcagcccggcttcagccttcccaaagtgctggggacttacatggcgtgatgccttgacccgccgttaatgtccccatatcctcttgcaagggtctcaccgtctgtgcctcagttccttcattctctggggccgcttcgtcctcctcagggctctctcgtgttctcgagggccctacgccagagtttaatggtgctgcctaatcgttggtatagagtttacaacgtgttcggtagcagcacagtcgcaccctaccgtaaacgcgaaatactaatacgcatgattaggaaaggcattgcactcggaagtgcacacgctaattccgctcgaccacgtctggatcacctttgtcgccttccacagggtcgttagtttgatcctggggcgacactatagtgctgacccggtctcttttaacacat

SEQ ID NO: 664304 - DNA, 494 bp, Homo sapiens
gcgtcgacaattttcctaataaatcccctctcatatagctgtatatatattctgttgtttccacctctctagagaaccctgaccagtacagaaaccttctagactatgacatttgggcttgactgcttcctggctaaataacttagaaggagatttaaccagcattcaactgaattgtagattgggaccggggaaatttaaacatttggattggagaagtctctgcttgttaaagataagtaggggcagggctttaaaaactacaggccagctgcagtggctgatgcctgtaatctcagcactttgggaagccaaggcaggaggattgattgagaccaggagtttgagaccagcctgggccacatatcaagaccctttctgtagtcctcactacttggaggctgaggcagaaggatcacttgtgcccaggagttcaaggttacactattccagcctgagtgacagagtgagatcgtgtctcaaaagaaaaaaaa

SEQ ID NO: 664305 - DNA, 182 bp, Homo sapiens
ggcgctctagaggatccagaccgaagccctactgctgcagagcagcagccacccctacccgaagacgcgaagcctggcctcatggagtcttcagcaaaagaaacttatcactttgagaggagcgccccctgccaaggaggcgcagctccacagaaaacctgggcagagggcttcgcgatggg

SEQ ID NO: 664306 - DNA, 222 bp, Homo sapiens
agactcaagaaacctttggggtgctgttctttggtcacgtgaacccagaggtgcacatgggccccttgggtgtctaaacaaagcggcatgggaagaaagccctaaccccctgcacattactctgctggagaacggggcaactgaccaatcagactctactctgcaccggggtctactgaataggaacattgatcatgatatacattgtacaaataatgcacg

SEQ ID NO: 664307 - DNA, 100 bp, Homo sapiens
tgctggggaggtggtaagaggaagccccctccctcagtgtggcagtgtgccagatagggtgctgctggcatgacaggaggggtcatggcaccatacggtg

SEQ ID NO: 664308 - DNA, 166 bp, Homo sapiens
acacatcagacattcatctctattctccaaagagcacaccatggctgctgtgttcctctaccttctcttactatcctcttattgatacctttatcttatatcttttagacttctcctatattatagagtgaactggcattggacttagctgctggtctcgatcctt

SEQ ID NO: 664309 - DNA, 508 bp, Homo sapiens
  misc_feature (5)..(5): n is a, c, g, or t
  misc_feature (8)..(8): n is a, c, g, or t
  misc_feature (11)..(12): n is a, c, g, or t
  misc_feature (20)..(20): n is a, c, g, or t
  misc_feature (45)..(45): n is a, c, g, or t
  misc_feature (59)..(59): n is a, c, g, or t
  misc_feature (172)..(172): n is a, c, g, or t
  misc_feature (174)..(175): n is a, c, g, or t
tcgtnaantcnngaatgtancgagtaggagggccgctgcggtgancttgaagcctaggngcagggctcctacacctacctctctctgggcttcttttttgatcgggatgacgtggctctggagggcgtaggcacttcttccgcgaattggccgaggagaagcgcgagggcgnanntcatcctcgagtttcagaacgatatcgggggccgtgcactcttccaggatgtgcagaagccatctcaagatgaatggggtaaaacccaggaggccatggaagctgccttggcatggagaagaacctgaatcaggccctcttggatctgcatgccctgggttctgcccgcgcggaccctcatctctgtgacttcctggaaagccactatctggataaggaggtgaaactcatcaagaagatgggcaaccatctgaccaacctccgcaggttggcggggcaaaaccagcgcagacttgcggccccagggtctctgggcgagtatctctttgagcg

SEQ ID NO: 664310 - DNA, 676 bp, Homo sapiens
tgagcatgggtattccgcctgtcttacaagtaggacgttatgtctttacataacatatgcattcagtgctcgccagtggtactgtacagtgataatcagttcctccgggacttttctttttggaggcagcagtcatatctcctcctcggtgccggtctgtgatgctggggcctgtaatggcagtcctcaggcgccctgcattagagttgtgtacctcgttgtactctggagctcccgacaaatgctgtccctcccaggatcctgttggacaggcagtactgctagctttagagtacgtctggacccgctcctagggtccttgtttgtccagagcaagaatttgatctgaataggcccatctctgtactccttattaaggcgatctcaccatgcacagtgagcttaggtgctcccagctcccaaaatggtgccgttttgccccttcccgtaagcaaacgtaaggctccttaaagcctcctggagttatgcgcaccaaggccttggccaacctaaagggttgcgcggttgattcctcgggcaatgtggcctggttaggcttcggagcccccagttaccaaagcgttcccagcagttttgagtcagctctgaggcagctctacctgtgcatggttggttatacatactaaagttagcatctttgtaggaatgcgccttg

SEQ ID NO: 664311 - DNA, 158 bp, Homo sapiens
gcttcctgctgcgcaccaccttcgcaagcacagtgaggccaaacctatgtgtgaatgtgtgccacgtgcttacgcttggctgatgcctgcgcatcatgcctcaccacacgacggcacctttttgcgctcggataaaggcacaagtccgtgcacattca

SEQ ID NO: 664312 - DNA, 163 bp, Homo sapiens
  misc_feature (134)..(134): n is a, c, g, or t
  misc_feature (138)..(138): n is a, c, g, or t
gcgggggtgcctggtccttagatccagtcacttcgtcgcggctaaaacacgggtcggggagaagaaaccggccgttcagtgtgctggttttcttgacggccaggactgagcctaaccccgaggagcggccgctngagnaccaggagcccacccggcgccggcg

SEQ ID NO: 664313 - DNA, 366 bp, Homo sapiens
cacccggagcacttactaaaaatacaaaaattagatgggtgtggtggcgcatgcctgtaatcccagctactcgggaggctgaggcaggagaattgcatgaacctgggaggtggaggttgcagtgaactgagatcatgccagtgaactccagcctgggcaacaagagcaaaactccgtctccaaaaaaaaaaataaacattatatggagcaagcctaagaaggttcatctaaactgtccatctgcccagcccctgacagtttgaagatgagtaaagggctatgagtacaggtccggacaggcctggggagggaacgggaacccacatcgtggttggacaactcccagaagtgagcctggatgcggaa

SEQ ID NO: 664314 - DNA, 417 bp, Homo sapiens
atgctttatcagcatccagtcacctctgaacagttgctgcttagaaattcttccaccagataccctaaatcatctctctcaagttccaagctccacagatctctagggcagggcaaaatgccaccagtctccttgcatagcaagagtgacctttactccagttcccaacaagttcttcatctccatctgagaccacctcagcctggaccttattgtccatatcattatcagcattttggtcagagccattcaacaagtctctagaaagttccaagctttcccacatcttcctgtcctctgagccctcccagtctctaggaagttccaaactttcccacattttcctgtcttcttctgagccctccaaactgttccaacctctgcctgtaagttacttccacatttttgagtatcttt

SEQ ID NO: 664315 - DNA, 1316 bp, Homo sapiens
ccacgcgtcggcagcggcgatgcccaggcccttccagctactgctccaggtctccccacgaggtcctcgaggcagtcaatcatgccccctgccattcctgaggctacatgagtgccagcgtggccacaccatcccgcacgaaccccggacgacaactgctgtagtcccagcttactgaagctaccaccaaggagagccccttggagagtctggcatgaacctggggggcagacacacccgagcactcaagtgccaagagctgacttacccatttcagggcaccctggagacacccaaccgagcatcagatatccattgacatcgaaatacattcgacgggacctggatggtgaggagtcgatggaagcaggatcatgagggagcattcccacgggatcaccaggaaccgatcagagaaccaaccactgactactgacgggacgagacacccattccacgggcacgccctgcctacacccacacagacacagaacgacaagacacacaccgcctacgagggaaatcctgataacctaacacacaacaacgacacacacaacaacgctcgcacttggcacgaaagcaggacggagggcagacgcgagggactcgaccacacagaaaagcacaacagcaacgcgaaggaccacactcacaaaagacgcacaacaagcacccaccctacagaatgcacacacaggccgcaaaacaatgatccacgcggccacacagcagaacacgagcgcacacacacacacaaacaacgcgaagggcaccaaagcctggtaacctacgacaaacgaccaaagaacacctgagcaggaacagcaccccccgagacagaaacgcacatcacacaccatacaagtagaacacagacccaaagggacaacagacagaagacaagaggacaccgggacacacaaagaggaaacgaagggcaacagacaaaagagacgcagaaggaaacaacacacgacgaaaacaaggatccacaccgaaccaaaaatgagaacagcaaacaccaacaaacccatgccaaaagagagggaaacaaggcaaccaagtgaacaacaacacaaggggagccaacccaaagagaacgacgcagcaaacaaaaggagggaagaaggaacaaaaaataaaccagacaacaaagccctgcaagagcaaaaacaagacaaagagacaacacaccaacgagaaaagaaaagcagcaacacaacaacaaacacacaacacgcaaaccacaaaaaaaaaagagcaaccaagaaccagaagaaaaaacaaaacaaaaaacaaaccggagcaaccaa

SEQ ID NO: 664316 - DNA, 200 bp, Homo sapiens
tgaggtctcagtttcctcattggaaaagtggaggcaatcagccgggcgccgtggctcatgcctgtaatcccagcactttgggaggccgaggcgggtggattgcatgagctcacgagtttgagacccgcctgggcaacatggcgaaaccccacctctactacaaatacaaaaaattatatgggcgtggtggcgcacacctg

SEQ ID NO: 664317 - DNA, 525 bp, Homo sapiens
ctcttctcgatgtagccgcctgtggagggagcagagagttccagaggaggctggcctggtggaaggcaggatgggaggtggtcgaggaggagggagcccagcgccctcccccatgggccggcccgctgactcttgccttgataaccaaggcacgcctatagggggcactcagtggcaagcaaccgagcggggtgagcgtgctatacgggaggaggagccggcaggacgtggagtgagtgcatgaggagaatggagcgggcgccatgaggaagggatggcaaggaagccgagttagaccgccagtggtgtagaacaggaaaggctgaacacgagacagcggacacacgccacgagaagagaagaagaagacaatagaaaaccgtgggaggcgtaggacggacagacacccgaaggaaactaacagatcgtaggcaataacgcatgaaacccacataccagcaaggtcctaagggggatacataaacgaaacctccctcacgacccacacgcgaaccccccgaacaa

SEQ ID NO: 664318 - DNA, 709 bp, Homo sapiens
ctgtacacagacatcatcaacatcttcctgtacaggttcagcgtaattgaccgatagctcggattgagctgaggtacagctggttgtgcccgagtcaggtggtgcggatgtgttggatgctgtgcatgggaaggcagtgatagattgtaatttcccgtgtctattgatcaccaggaatcaggcctgagggaaagaggattgcctgcatctccaagcctctccttgttatgtacacatgctaggatacgtgtctcgagtctggaaccgtgtgttggtgccacaaggaattggtgcccatttagttccttccccgatcctcctgtctagatgtggggcaaggcaaacgggccaataggtgtgacacagatgggactagtcatcctttgttcataacatcaatttgtgtgctagtgacgacctcgtgataatagcctattgcacctattcgccaatggggaccttgtggggggcaagcgacctaggtgtccccctgtggagggatcgaagtgcaactatggacagacccgacaccaaaggggtggacaggcgtagcaaccggatcatgtttgcacatacgatggattatcccaatgacttgatcaataatttcatgtcagcttagcgattcgaagaccccaatatgatcttgctcataagcaccaacacacctaatatggaataaatttggtagaaatgcaaacacattaat

SEQ ID NO: 664319 - DNA, 169 bp, Homo sapiens
atcgagggcacccacccatttcgtgcagtctgtgatggagagatagagctcatggtcattgcagacacacgaagtgggtgggtgtatggtcctcctgagattacgtgaaccatgcagtaacgtgggatgatttgagagtctgtagtgatgctgtgtgcatcactgtcat

SEQ ID NO: 664320 - DNA, 451 bp, Homo sapiens
ggcgctcaatggaattcctttctcactgaagattttcccaacttttaatcaatagaagcacagagaaaagaggcaaaacgatcaaagaaatttacgtttttcagacagggcgtcgacttcacaccaacaaaaaagaaaaacaaacgaataagctttcgatcttcattttctttctttcattttaaaggcagactgagacgcttttaaacgcgacgtcataaacctaagtaacttgacttgcaacaacaagttttttaccctcctagacaaagcaggtctctttatcataagcctcgcagcacttttctacaaaagctgcaaaataatccataacaactttaggtcgctctttcgccgctttggctcgtgtttatagagctaaacaggtgtaattcgcttttcgactcgcttttccttctgggaaagtgtgcatatatttgaatgaaggagg

SEQ ID NO: 664321 - DNA, 251 bp, Homo sapiens
ccgcaccttacgaaaggcaacatcatctggcctcaaccattagtatcgctgcaatgacaccatccctgaggacttccaagagtttcaaacccagaatatcgaccggtgcgataattaaaccaaggaagcaatctgtaactagcttttcggaacactaaaaccatatatgttttaacttacaattttctttagacttttaccaacccaaatatatcaaagcgttttatgtgaatgtagcctatcggagaaga

SEQ ID NO: 664322 - DNA, 191 bp, Homo sapiens
  misc_feature (11)..(11): n is a, c, g, or t
  misc_feature (20)..(20): n is a, c, g, or t
  misc_feature (155)..(155): n is a, c, g, or t
gatttcggcanaggcaaatnatttctaatttcacatgctctttattgagacatacctgagactgggtaatttattaagggaagaggtttaattgactcacagttcaatatggctggggagacatcaggaaatttacaatcatggcaaaaaaggangcaaacacatccttcttcacatggcggcaggtgaga

SEQ ID NO: 664323 - DNA, 286 bp, Homo sapiens
  misc_feature (6)..(6): n is a, c, g, or t
  misc_feature (51)..(51): n is a, c, g, or t
  misc_feature (66)..(67): n is a, c, g, or t
  misc_feature (73)..(73): n is a, c, g, or t
  misc_feature (88)..(88): n is a, c, g, or t
  misc_feature (129)..(129): n is a, c, g, or t
  misc_feature (237)..(237): n is a, c, g, or t
  misc_feature (256)..(256): n is a, c, g, or t
  misc_feature (276)..(276): n is a, c, g, or t
aaaaanagggacatcatcttagcaggacacagaggaaactagaagatagtngagcaatatactcannattctnaggggaaattttttncaacctaaaattctgtaccaactcttatgagctggattgtntccctccagtgtttctgtgttgaagccctaacccccagtaactcagatagggccatttaaagaagcaattaagttaaaataagaccattagagttggccataattcantctggtgtccttttaagangaggaaatttggacataggnagggccatgt

SEQ ID NO: 664324 - DNA, 290 bp, Homo sapiens
cgacctagaggatcgcccctggtatcccacccacttcaacccaaatcagctagacaaccccggccatgccctaactgagctcagggctctcacccagcctgaaggtctcaggctcattgcccttagcagcaccaactgcccttccatcttcagaatatccctagctagcttaaccagacacgctggacccttgtagacgttacctgacgcactgtgctagcccaggccgtgacggccctacagccatgcctggcagagctcgctacgctcccacggcaaacgcaataagc

SEQ ID NO: 664325 - DNA, 284 bp, Homo sapiens
aagtttttccccgggttaaagtttttgggttaaaattttgaggccaattgcttgggaaaggtttgctttggttttttgaaatttttttttaaaccaaaaaaaaggcccggaatttttcccgatttttaattttttttccaagaaaaactaaaaaaaaaattcccagttccttttcaatttggggttttaaccccaactaaaatttttttttttttgaagggattcccaattcccgtttttggccccttttaaaaaatttttttcccaaacccagggggggccca

SEQ ID NO: 664326 - DNA, 460 bp, Homo sapiens
  misc_feature (402)..(402): n is a, c, g, or t
agacaaaatcactgctttgggtgacagaaatgttaaactttaccttatgaactggacaaggaaagatgtggacgtctggttttggttaattttttggaggcttaaagaagtgattagatagctagcatgagcatcttgtgactcaccaggatgtcagttcctgcaggtgtaaaactttgttgccattcccagggctcagctggacacacgatgggggccgaggagtggagttgaggccagtggctgctccccaggggatcaggtgcagcaggtttgtttctttcccctgttaatcctgggagaccaaaccttgatttcagctatattttccctctacctttaccagataaccttacctttaccttacataacagccacttttcatatttgtgaagtaactcncccccacaactttttttttctgaaagtaaaacaacttggtgaacattggcttttattc

SEQ ID NO: 664327 - DNA, 145 bp, Homo sapiens
ggagcagagtggttaaggacttacaggaacttaactattctggaataaaggaatgaatcaactgaccttgggccagcaggtttataactaaattgttacttgcctattctacacccatgttaatcagatctcatgtacctgattt

SEQ ID NO: 664328 - DNA, 259 bp, Homo sapiens
tgaactcgattgtctgcacacgagggagctgagccgaagcttcatcaatcagatcatcctctgagtagggctgtcagaaggccccagttcctaccgcattccccttgaggctgctgtctgcttggccagcctctgtccagaaaggaccagagaaagccaggcgggatcgtcgacatgccggggagcaatgtggatggtctggtggactcctgggttttctcccccctgagtccctaataaagcccgtgaaccttggaaa

SEQ ID NO: 664329 - DNA, 530 bp, Homo sapiens
tcgttcgtgcatggcacgcgactatctgagcgctgccccaacagtgtcatctctgtatccgtgtgatacgtacctgtgattgacattagacgccaagttctagtccggccaattactctcgaggtgtcatgcacctcgtagcgatgcgggcattcttttgtcttgaatcttgtactacggagtcgagggcatataaaaagctgaatgatgacaggtagtgtcgtgatcctgtcctcttcaacttgccacaggccagtgatgctccccattcttgcttgataagtcttctgttgaccccatgtacctgagtgacccccacgtacctgagtgtgacaagcactatggtgcttgacctcagtccagctgcttagaccttgtaccttgccacacgcccacgtgctgaccaccttgcgtctagagttttgataaatctatcctttggctgattaatatgagtgagtggtgtcttctgacgccatatcttatctggaacactgtgtcgtgacttcactttcctgtctggagcacac

SEQ ID NO: 664330 - DNA, 235 bp, Homo sapiens
actagtaccctcacttcccgagttgggcggtctgctgaccaccgcttgtggaatacgttgcgtgtgcgaatttcgcttcaaccttctgcgccgcattgcccgcttcggggccctgcacttccacggccagcaagttctgcgaggcccagtcttcatcggtgcgcagttcaaaggcgaaacgcccgtctgtatcggatgtttcgggtttctcgatcttgatgtcctcgattaggct

SEQ ID NO: 664331 - DNA, 141 bp, Homo sapiens
acattaactttattgcttcactttcggtagcttctgatgatgacatgaagtcactggttgtgtagaaggttgattttgagcagaattagaccaagtaattggaaatactgaaggagcaaataaatatgatatgggagtgta

SEQ ID NO: 664332 - DNA, 204 bp, Homo sapiens
  misc_feature (58)..(58): n is a, c, g, or t
  misc_feature (64)..(64): n is a, c, g, or t
  misc_feature (98)..(98): n is a, c, g, or t
  misc_feature (128)..(128): n is a, c, g, or t
  misc_feature (134)..(134): n is a, c, g, or t
tttgggagggatcttgggccctgtggattgagctacttcatgggtgacatggagaggngggctnggccatgtgtgggagggatctgggccctgtgganggagctacttcatgggtgacatggagaggngggctnggccatgtgtgggagggatctgggccctgtggatggagctacttcatgggtgacatgggccgggagcccg

SEQ ID NO: 664333 - DNA, 257 bp, Homo sapiens
  misc_feature (126)..(126): n is a, c, g, or t
gagtgactatattctgggggcgaagctcagagcccttagtagaatggaggcggcctcctgggtggcactggtcagcccccttcactgcatgacgaatggtggaggaaattcccagcaacatattgnccatgccttgcagcagtgtggaggtccaacgaaggagctccccttgtttggctccagctctgaccagactgcgacaccatcaggcgggtgtcatcctccagcagctggaagaagtcctcactgtccactcc

SEQ ID NO: 664334 - DNA, 176 bp, Homo sapiens
gccaggctcagtgatcgccccatgccgccatcatccacgcgcccagaatcaacgtggtgcccatgccctccctcgggccctccttattattggccgccaccccatgatggcacagctgtgctgtccactggcactgtccagtcagcccaatgcccctgtcatcccactccaccccc

SEQ ID NO: 664335 - DNA, 630 bp, Homo sapiens
agctgggattcaggcatgcgccacacacccagctcattttgtatttttagtagagacaggctttcgccatgtaggccaggctggtctcaaactcctggcctcaagttatctgcccaccttggcctcccaacgtgctggaatcacagacatgagctactgcacctggccgtatagacttttttttcctatttttttcagcagctatgaaaatgtacaaggcatcttcaaaaagttcatggaaaatgcttattatgaaaaaatagtgcatgggttttaatttttccttttttttcttttggagacagagtcttgctccatggtccaggctggagtgccatcttggctcacgtgcaacttctgcctcccaggctgaagtgattcttgtgccccagccacccaaattattggtattacaggcacgcaccaccacatctggctaatttttgtattttaagtagaaacaggcttaggccacatgggccagactggtctcaaattcctgggctcaagtgatccacctgtcttggcctcccaaagtgctgggattacagccatgagccactgtgtctcgctggatttcaatttttttcaccaacataaacttatatgaacttgttataatgtctctga

SEQ ID NO: 664336 - DNA, 284 bp, Homo sapiens
gcgaaaagcaatcttggcatgtgtttccttctgataggggccagttgcaagtgccatcctacaaggtcgcgtggagcaagcttgctttgaaaaccctgatcaccttgagttctgagcagggactaggcttgcaggtaagataattggccagggcacccagtccagaaggagcaatggcacctgggcagtccagggcttaaagagcctgctccttttcggtagaggagaggccataactggtgtggtgggtggctttccttaggttggcaagcagccacctccct

SEQ ID NO: 664337 - DNA, 861 bp, Homo sapiens
gccaacttccggcgtccgtcgggcagcagcgggctgtctatcccggtgaggacccgcggccagtgcgggtgctggtttgccattagcggggcctttcctgaggacggcgtacggagtgtgtgggggaatgaaggatggcagcatgccgtgcttaaaagctgtggtagatctcagtggcacactttcaccattgaagatgcagttgtgccaggcgcacgggaagctcttaaaaggttcccgtgtggtcctgtaatcattaggttggtgaccaaatacaacaaagagagcaagcaagacctgtaagaaggtttgagcaacacttgggaattggattatctctgacagattgactttttcacattcttcttgactgtgcaggccagaagtttactaagaggcggaaacaagtcagacccaatggcttgcttaggttgatgcatcgcggcactacctgatttcaacggattaccacacaagttgatcctaaatgctgggggtcatggggatgggcaccaagaacacctttttccattattccaaccattctgaactcaaagccatcccggtttaactcccttggatgggagccacctttcgtgattagcaatccacaaaaggcaggttattaccacggagggaaaggatggttttaaccctgggggggctgtaccaattgtgtggcctgcttaaaaaggtatggccacatgataccaaaagcaacacgtccgtgggcgacacccgaagaaacgttctttgttggcaagcattgcgggccatggcttgtgaaccttgagaggcggcatgattgcggaatattcgcgcgatatagtgggcggcccaaatctcgcagcgggcgctaaa

SEQ ID NO: 664338 - DNA, 370 bp, Homo sapiens
aaaagccagagagaacaaacaaaaatataaagtaaaatttcagacctaagccctaatatatcagtaactacgttaaaagtaaatgatctgtaattgtcctggttgcctaggactgtagggcttcctggaacacaggacattcagtgttaaaactgggaaagacttgggcaaaccaggatgagttggtcactctagttacatttttttaaaatcaaggttctacaaaaatcccttaaaaagtgtttcctgaggccgggcgcagtggctcacacctgtaatcccagcactttgggaggctgaagcaggtggatcacgaggtcaggagatagagaccatcctggctaacacggtgaaaccccacctctactaa

SEQ ID NO: 664339 - DNA, 363 bp, Homo sapiens
cagtccctgctgttgactatatgttgataccatagcagagtgcacagttatctcctttcaggatatcatatctgcagatagatttatgtcgtcttgtccagggcatcatattatttggattgaatgtctctgtttgtaaaactggtcggtgtggacagacgataagctccaccattaccccttaagcttgtggactggggccattcgagtaaggggcttgttacacaccgactcattgtctgatctttcacaataaatagcagacaggtgaagagctttatagagaagtggaacgttggtacccttggatttgcctggttactgattttcttttgttgtctttaagtggaggttcattaagtt

SEQ ID NO: 664340 - DNA, 702 bp, Homo sapiens
cgtgcagcagcgggtccgggactgatgggcagcatgcgggggctggtggcgggcggaagctgaggtgacgaaggcatgcggcggtggcggccgtttccctcacggtggcggaagaccaaggcggcggcggctggaccggggatgctgggcctggcccggtcccctgactctgttgggctgttggcaagaggccagacagtgggtgcctgtgccggctcactggcgccacccctgtaggactcaccacctccaggaggctcactccatcctgaggtgaagaccgcacgtgtgtgtgcccttgtgcctctggaccagcatctacatagactagcatgcgtgcaatggcacagcacaggcctggaagtaggagtcgtgagtgctaggttgtgctagcagcctatgtatggcgtgaccttggtaccctcctgaggggagatggatttgtgcgaagccagagtgaaacattgcacacgttactgagtattgcagtcgacttcccaaacagaggcggcacttcataccaaaagggcctatcgatgaaaggggaatgtaccattgaaaagaaccatcatgtacaacacaatcatttctgttgaaataaacatacatgtcgcaagtagttagaggaagacacaactaaccattattagactgaatagtcctaggcatacacacacatccaagctgaactataaataaagg

SEQ ID NO: 664341 - DNA, 266 bp, Homo sapiens
gaggagcgctaccttccgaagtgctcctacttaaagtgcgtgaagagaggaatccaacctcaatgcgaagattgtttgccaccttgatgttggagttttttaaggacacagaatttcctattatgatttcttccctcttgccataaatttacctgaaccttttttttgctgtttccccaactccaattgccatctgaaactgcctgtttgctgtctaaatatgctgggctgcaaactaactgatcacatgcccttttagctttgaa

SEQ ID NO: 664342 - DNA, 764 bp, Homo sapiens
  misc_feature (299)..(300): n is a, c, g, or t
gcccagagtgagcccaggttgatttcaggcggacaccaattagatgtccacagcaatctccaggagcccaggacaccgggtgacccagagatgcaaaggcttagggagcttgctgcagccattgttcgggccctcagtgctcctcattctggggccctgctccatcgggcgatgtgacaagtcttgcccaggtcttggtcaagcacagtgcgctggggggaaaacccttttcatggcccctgagtattggcaagtgggccctaatatttcgccgtgtgtgcccgtggtcaccctttggnngattccccatcctgttgtgacaaaaagttcgggacccttttttttgtgtcgcaccaaagtggtttatcaccaaaaaaaccttcacacaaaaagtgtttttaacaacccacgttggggggaggtatgtgtggcacccaacccaaaatttgcgggggaaaaaaatggagggggggcggacacaaacaatgtagtgggttcacccccccggtagtggggatagataagaaaaaacagaggggtccaccaccaccccgtaagattttgtggtgggagggcgacaaccaaaaagaagaaaggacaaaagataacgggcaagctgaaagtttgtattttttttggtggcggcagcaccaccaaaaagttattgtcacttgcacacacaagatcccatgtatggatagttttttggttgcagaaaaaaaaccaaaaagacagtcaccaccttctgatgataccgctttgaa

SEQ ID NO: 664343 - DNA, 435 bp, Homo sapiens
aggtccccactgcacacgttacataaaatgtacatgtccaatcttgttattctctttagcattatgaaaataaatgtctccatttgcgactttatcttctctgtccaggaaacattccagatgcagatgcctgggcagccacctgctgagaggcaacaagggcagcagaggtcaagccttgaaaagggtcatattgacccgggattagcgggtaacccatgccaacgtgggtgtggtggtgcgtgtgcaggtgccgctggccgaagggggagtggcgatccctttccctttctgcctcccgttcccgctcagctgtagccttttccacaggagcaggagacttgctgcggtattggtttgtggctggtgacttctctctgctaagtaaatcaatgaccattcattgagaactgatggggaccgaactgtgcatgg

SEQ ID NO: 664344 - DNA, 252 bp, Homo sapiens
cggcatgagttcagttctgaaaaaggaaactggtgcttgccaggaagaaggaagtcttcctcttaagactctagcagattctcttagaccagtggtttgcattttctgatatttttatttttattttttctttttgagacagagtttcactcttgtcacccaggctcgagtgcaatggtgcaatcttggctcactgcaaccttcacagcccggattcaagtgtcctgcctcagcctcccgagtagctggaat

SEQ ID NO: 664345 - DNA, 139 bp, Homo sapiens
accttatactcctcaacgcttatactttctcacttcttcctcaacgctttatactttctcaacgctttatacttcctcaacgctttatacttccgtattgaattccagtataatattaagtatgcatggagaagtataa

SEQ ID NO: 664346 - DNA, 675 bp, Homo sapiens
ctggaggaattccggacgaggggaaatacacatttgctgctcacatggatggaacatacaaagtttgttttagtaaccggatgccaccatgactccaaaaatagtgatggtcaccattgatattggggaggctccaaaaggacaagatatggaaacagaagctcaccagaacaagctagaagaaatgatcaatgagctagcagtggcgatgacagctgtaaagcacgaacaggaatacatggaagtccgcgagagaatacacagagccatcaacgacaacacaaacagcagagtgggcctttggtccttctttgaagcccttgttctaggtgccatgacattgggacagatctactaccctgagagattttttgaagcccgagagatgtttaaaaagcctctttcctgagaccccaatcagaaattaactgttacccaacaacctggccataaaaaggcaatagtttctccatttttattttctgaaccgaccattacaacctatggttccttggggataaaagaaatggggggaaaaagcgccttttaggaaaaataaggggaaaattggcaggcgggtggccaaaatttttttggtggaaggggggcccaataataaaggccctcccaggacccaaaacccgggagaggagaggggggatgggtttttccctc

SEQ ID NO: 664347 - DNA, 331 bp, Homo sapiens
agtgggcctcggggggctgtccctgggcccgggagccaatgtgaacttcttgttttaaccgggatatacaagaacaacaagatgactttatttcttaactgtctccaatcacatgattaacagtatttgcatacctgttgctgcttgcccagcaggacacgggtggcagaccgagcttaggttggaccccccaaggttgagaaggagccctgggctgtgcccagagcagggctggggctcacatgggggggcctgaggaactttaaactggggcccggcccatggggccctcggacggaaaattcttggttggcagtgcaaacaggaaacc

SEQ ID NO: 664348 - DNA, 508 bp, Homo sapiens
tacccatgctggagtgcattgttttttttttttcggattcattcaacatttcttggggcaaaagggggggtgggattaaagtttatggttaggatactgcagggatacaagttaaagggattggctttgggggtaaacaaacctgggtttgggtcccaaccctgccacttggtaactatgggagctccctgggccttttttttttaatttatgaaataggaatttcacttcttacctccaagggttgttgaaagaattaaaggggccttggaacaaaactggggatcaataaatatttactgaacggatgttgtttgtttaaataaagcatgaaaaagagttcttaaaaagggtcctgtgtgtagcgatgtgttggaaaatattaacaactatttttacctttctttttcctcaccatccttaaagccctaaaataaagcccctggcacatttcggggcattgaacagctttaatgggaggcggaatacctagcaaaaaaatacgccg

SEQ ID NO: 664349 - DNA, 521 bp, Homo sapiens
  misc_feature (507)..(507): n is a, c, g, or t
tgtgtcccagctgcttgtgaggctgaggcgggagaatcgcttgatactgggtaggcagaatatgcagtgagccgacgtagtcgtgccactgtactccagactctgggcaacaagagagagactccatctcaaataaaaaaaattaaatttaatttaaaaaaatgaaagaaaacagccctgtgtggatggagtcatggctataatatgtatgtctatcctttcttcttgaggtaaacttacagtggggaattctctgttgaaaatggggtgagctatcctgagtctttcctttaaaaagttgtgttctggagttgggtttgtgtgggtgaggcgcgtaggatcataacagatggtgatgatgaggaaaggcagttcaggccgagagatgtcaggagcgtggaacggcagtggaagagggcagttccaggactgcttgaaggaggtgaggagatgggtgcgattgtggctagagttctgaaagggaggttcctggtgatgactgagagncagattgtggaaga

SEQ ID NO: 664350 - DNA, 547 bp, Homo sapiens
  misc_feature (47)..(47): n is a, c, g, or t
  misc_feature (502)..(502): n is a, c, g, or t
attcgcggccgcgtcgacagggaacacatgttgttctggtcggtcancgccacggcgggcatgttcaggccgctcagggccttgaccagcggcttgatccgaaccaggccgtcgaccagggagtactcagtgtgcaggcgtagatgaacgaatgaagccggcatagtgatcctgtctaatctgtagaaacaacaaggcccggattgtaccgggccttggctaaaacatcagcagcgttaaagttcgccggaccgcccatgactctcataggccagccgtaccggcgcgaaggagcgtcggtgaatcggcgtcggccccagccgctgcaaggcttccaggtgcaccggtgtcggatagcccttatgcccgccgatgccataacccgggtagatcaattcgacagctgccatttcacgatcacggctgaccttggccaggattgacgccgccgcgatcgccggcaccttgctatcgcccttgaccaccgctttcgctggcatcngcaactttcggcaacgggtgccgccgatcatcgccagcttgggct

SEQ ID NO: 664351 - DNA, 349 bp, Homo sapiens
ctggcgcacagcggacgctgacaactgctctgtgcagctgagttgctcttcatgttggatgtctttcccaaatatgaatagaaatgggcatgatatttgtctcccagaggcagttacatttataccctactatccagtttgtttttacatgagttctcataaaactgtgagtttctaagttttggctttttttttttttaaagggactttgcggggtttttgctgccaccaggaaagaagcccctttcccctcccgccatgattcggagccctcctcagccatgtggaactttactggcaccaatttttttttttggcccgtttccacgctgctgttaaagccactcct

SEQ ID NO: 664352 - DNA, 739 bp, Homo sapiens
tcgtctcggagctatggtgtatctcccctcgtcacaatgccttgtcagtaggaacatccattggtctaagattgtggtgtgatcttagtcttgtctagacagttgtgtagaaggttttgatgacctacagagattcaaggcctagagggtactcgagttgttgactggtggtgttgtccttgactgacgcttgattccttaagtgacctagcgttttaataccaatatgcgcacgttctcgtccactcctgtgcgccagcagcggtaatctcttgatggttgtcatgatcccttgtctgcaccttgtcatggtcacagctgtgtccattcctggatttagtcatgatatcgtcattgatggtcatgtccaatccaagccattgctgcctagactgtcatcgttcgaatcaatgttgtcacatgccttaccgtatgtcgtctgtccctgcctgagtttctcctggtcttatgtactgctgcagacacgtccagagtgaagatgggtgactagaggagtatgtgtgggtggggccagctgccgtcactttatagtttacttgctggttttcctaggacagcatggagctgtgtcccttagcctttcagaggctgtggagatcagggccctccgatgcactcccacatcttgcctgagtgttgattgtggaggcactgcagtccaggctcgagtcctcagtgcggggagcaggatgctgctgctgactctgtgcagcgcgaa

SEQ ID NO: 664353 - DNA, 476 bp, Homo sapiens
cgccgattcttgaggataaaaggccgcccctttacttggtccttattgaaacagtataagatccacaaagcagaatttctaaatatgccttgaagaactaaatgaagtgttttgcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaagtatattactatttcttatgccttttaagatactgtttactatgaagacaatgtttttaattacaaatccagaattctgtaggcaaaatgctacagttcatatcttcctttaaccaaactgaagtacataaagaccatgtacatgtattcatcaaacgtttattgaa

SEQ ID NO: 664354 - DNA, 1194 bp, Homo sapiens
gcgcgcctgaggaggaggaggaggcggggtgcgtgccattgctgctgtggtgtgtggcggctgcgggtgtgtgcgcggtgaccggcggtcctgcaggtgtgccggtctctacctgtgtggccttgtgctgcgggtgctgcagcctgctgcccttgtgtgccttgtggtgcttctgtgtcaccctgctgcatgctttgcgcgtttttcccagtgctgcccctggctcgggtgccggccctgagtgggggggctgccgatggcagcggggtcgtgggccgagtgcctgagctccagtgccaaccctttctacgaccgctacctgcgacaaggatccagcttgctgcggcaggtgtcatgacccagcttgcttttgaggtccctgccttggagaaacgcagtgacatttcggaagcagccaggtggggcattcccaggcaaggtgattcttattcaacacttgttgtgcggaccaggaagacaagaattgcctttggggggacaaccaggtcctgtgacacagagcgattcacttaagggacaaggacttctcagtttcacactcttttaacccattggaggatggctacacaacacggaagatataacttgccagcacggcaacattaactaccagatttggcaggcaaatatttttgccacgcaaaagagattaccagttcttacgccaggttattccctgccgagaagaagttttgatctcgacttctggaaaccggggctcaggtaccttgtccaagcatttttctaatgttgcctctgccacagaagggcgaccggggttagctgaaggtatatctggtagccgaaccaaagttgtaaccaggtgttccttgcaagtcttccacttttccgcttgccaacgtatatataagaagttatttccgatgacccccggatggcggaatgctatgacgccaaaggcccatcttgaatttacattatcgacgtatatccttgaacctttagcagggcaccgactaagtgtgccttacgttgctggattaccttgtccgacaccgtggcatttccgacgattttctgcaagtgtttggcctgagtcacacagtggaattcgccagagccaaagattcagcctctcttcattaggcccagctggatccgcaggacaagccctaacgggtataagtggacgcacccttataccccttagac

SEQ ID NO: 664355 - DNA, 464 bp, Homo sapiens
  misc_feature (241)..(241): n is a, c, g, or t
  misc_feature (290)..(290): n is a, c, g, or t
  misc_feature (312)..(313): n is a, c, g, or t
cacgtaggcttaggtcgaggcctgtggttataaggcgcgcgggacatggggctgttgctgcagctgcggcgtgttggccggcgtggagagccgccaggctctatcaaggggttggtgtactccatgcaacttccatgaacgtgaagcagcgtgtacgcgctggtgtgcgaaactgcatgcgctactccgcgcgtgctgagatgtcctggtgatctgactcgagcagcacgtgcgctatccntcgcgatagcgtgaggaagaagctgcggccgcatcctgatgccaatggntgtgtacgctggtagttgaggnnttgatatgtatgcggagaaggctggcgtttccgacagcgggcgtaggtggtgcctgagtgtcgacagtgctcgtgtatgcgagcccgtgcacgcatgtgtcgaatgggctcagaggtgctgagttggctcggctcacggttcagtcgtggg

SEQ ID NO: 664356 - DNA, 492 bp, Homo sapiens
  misc_feature (43)..(43): n is a, c, g, or t
  misc_feature (58)..(58): n is a, c, g, or t
  misc_feature (73)..(73): n is a, c, g, or t
  misc_feature (108)..(108): n is a, c, g, or t
  misc_feature (161)..(161): n is a, c, g, or t
  misc_feature (166)..(166): n is a, c, g, or t
taacccccaccttttttaattggatggaggttaaaaccttaantttacccttaagggnttggtaccaggttangggccctgggaacttccaaccccatttattccacnccccccatggcccctggtttccccccccacttccggaaaattaaaatgccggnttagncatccatataggtccatttcccccccctccctgctgctgtgtgattccttggactttggggtatgagtttttcatccttcatgcagggttctgtcagttcatggtatagtgattcagtgttaaaatggtggtgtctcagctggctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctagcat

SEQ ID NO: 664357 - DNA, 1035 bp, Homo sapiens
  misc_feature (1035)..(1035): n is a, c, g, or t
agtatatcgtcacacctcatatcctccctactatgcctgagaaggaatagtacgtatcgctgttcattatagctactctcataaccctcagcacccactccctcttagccaatatggtgcctatgccatactagtctattgcggccgactgcgaagcagcggtgggcctagccctactagtctcaatctccaacatgtatggcctagactacgtacataagagcctaaacctacgtccaatgctaaaactaatcgtcccaacaattatattacgtaccactgcacatgatcgtttccaagaaaacggacataagtttgaatcaacacaaacacccacaggcgtaattattagcagtcatcccatctactattgtttgaaccagatcaagaacaacctatttagctgttccccaatcttttgctccgagcccctgaaaaccccgcatggctaatactaggctactctgaatcctatctccatcacaatcatgggcaatgcgaaccgccggcttatccaagtgaaccgctatcaggaagaaaagaggtgctagctcgtctatagcgtaatctcgcctacaaatgatcctgatgttatagcgatgacagccggccacagaactagtcatattaagactattcgttcttcgaaaaccacaggttagtccgcatcttggctatcattacccgattgagggaacccagcataaagccttggaagcgaggaagctacttagctattctagaggctaaatacgctctcattctccctaagtcatgtacggattgaaagtcacagaccctagggttgttacccatcgttatactagtgtcggtggcgcgaaatgcagtcgtgccccaggtaatgaaactccagtctgttgtaggaaagctggagccatttgtactaaacactgagcccgcggtggaatgcgcgccttaagagggggtatagcaagtaccgaaaagactccgttgttgtaagaacgtcgcaacgttaggtcgggccgttaacatcaaatccatctcgctgagggn

SEQ ID NO: 664358 - DNA, 660 bp, Homo sapiens
gggaatattatgcttgaggcacagaacgcgtcctacagagcgtttaccaaaatggaattgagagacaatgcgaatattgcacgtgtacactatgtatcaccgatatataaacccatcacgctcttatagtgccaagggactataacaaatcccttgcccgacacatataataagctgagaatgtaatgtgaaattcccacggtcttagccgctgctctattcaagaaagcattggcactaggagacagcaccaggtggctatgaacaactctgagcttaagaaccttgaacagacactggtaatgcctagtaaaggagttgagggcatgactaaacacctaacgtggtacttgaagagaaaccaactcttatggagtacacaaatatatgagctgcggggggtgttgttttgtatttaaataacaaagacactgatggtggaatatttcctttatctcatttgtggggatgcctatgcaaaggttatggaggtctgctacaagcgcggtggcctctttggaggagcaaatggaccttaaactcccggataaaagcaaggccccaaacaaagggctttttgacctgggtgggaagcggaccccccccccttggtgataaacttagaaaggcaatggagaaatagttaattccgggccccgt

SEQ ID NO: 664359 - DNA, 412 bp, Homo sapiens
  misc_feature (48)..(48): n is a, c, g, or t
  misc_feature (50)..(50): n is a, c, g, or t
  misc_feature (71)..(71): n is a, c, g, or t
  misc_feature (75)..(75): n is a, c, g, or t
ggcctgattgtggtatcgagtgtatgactgctcgtgaacacggcatananattaacccctcgaccatcatnatcngacccgacgctcggatatggcagattgtctacaaaaacgtcggagacaacgatcggggcattactcgcctgcaggagttcaactactacgccacgcgcatgctgcaaaaccgccagccaggcgaaaaggtgctggccgtggtcggcaggtctcatatgaacacggcccgcaacgttccaggagtggccgaactcacgggcggaataggagtaggcgtctacccggcaacaacaaccgacaaaagcattgccatcagtggcccttcaatccgccgagacgccggagccagcgtagcgaatagccatacggccggtgattaccagattttccagaaagt

SEQ ID NO: 664360 - DNA, 611 bp, Homo sapiens
  misc_feature (9)..(9): n is a, c, g, or t
  misc_feature (53)..(53): n is a, c, g, or t
  misc_feature (105)..(105): n is a, c, g, or t
  misc_feature (161)..(161): n is a, c, g, or t
  misc_feature (535)..(535): n is a, c, g, or t
  misc_feature (569)..(569): n is a, c, g, or t
  misc_feature (572)..(572): n is a, c, g, or t
  misc_feature (608)..(608): n is a, c, g, or t
cagtgaccnaaggcaattgtgaacacaggccaaaagcttacgtattttgtttngttttcatctgttcctgctgctgtcacaaaacaccgcagactgcgtgatttntaagtaatagagatttatttctcacagttctgaagctggaaagtccaagttcaagnatctccgcttcccagatggcacctcgttgccacatcctccagaggggtaaaatgctgtgtcctcacatggaggaagggaagcccttttataataaggctctaatcctgccaaggcacggggcttatgcccgtaatcccagcactttgggaggctgaggcagacagatcacttgaactcaggaactcaacaccagcctgggcaacatggctaaaacctgtctctacaaaaaatttaaaaattaaccaggtgtggtggtgtacacctgtggtcccagctactcgggaggctgaggagggaggatcacttgaacccaggaggtggaggttgcagtgagccaagattgtgccattgaacaccagcttgggcaacacancaaaatcccatctcaaggccacgcgatggtgtcnacnctcccagcactttgggaggccaaggtgggtggatcnact

SEQ ID NO: 664361 - DNA, 228 bp, Homo sapiens
ccctcaaaacctgtccctggcagccagtgctttctgtatagggccataatggaattttgaagaaatcttggggagggaaggggggttggaacaaatgtttgttccctggaggccagtccagggctcaggcctttagactcattgtaagttgcccctgcccacatgggaccaaagggtgtggttagtcaatgaagggggccagcattaaaggctgttggttaacctcca

SEQ ID NO: 664362 - DNA, 793 bp, Homo sapiens
ttcgtgtttttctatatttgcggatgtgagtactattgtattgaccggtaatcagcttatgacctcttagctcaaattgtaggtgtacacttactagtatcatgttggtagcttctctatcgcaggactgtgttagccgtttctggtatatttctcgggggtatatttgtcgagcctatcggctgttccctgaaattgtatgttagtccacgtgcctttttattggcaatgctcaaattgcgttgggtttcccaggttatctcaggaagcttgatgtcatatgtagtcacctgtacctgggaattcagtggttgcagtgtactgagatcacgccatctgtagttggcttgcacaaatggtgtagtaccccttgtctatttagcgagatttaagagagttacctgaatctggaatcctttaatctttggtttttccttaaactttgtctataagttgccagcatcttgtacatattgtgtcaattatcacattaatgtgttcatttcgtaagtaagtagtactcaattggataatgatcttactgttaaaagtggctctagtttgcagtgcccagcaggacactgacagtcacagctgtgtgactttttgtgggttacgtaatttttgttgagcctccttttttcttctattcaatgaggattatagggcctacctcataggattattatgcattcccctctgttcaatgcacgtaaagtttttatcttggattactaactcaccattaacaaccattgctgagcaccataggattatattttgtttcacgaat

SEQ ID NO: 664363 - DNA, 232 bp, Homo sapiens
atcaattagaatgtcgggtcactaccagtaccctaaagtaccagagatccaatatgtgcctatccataatgacgagttctttaattgtaaagctccataccttccactaggcacacatatcaaaggtcattccggaaagccgaccatgcatcagtatcacattagtgcaaaggcagatttatcacgataaattctttgcaacttctgagggcttcaattaagtcacttaaga

SEQ ID NO: 664364 - DNA, 969 bp, Homo sapiens
  misc_feature (328)..(328): n is a, c, g, or t
atccctgagaatccaaaattccccgtgccacctatcacaccccaaaaaaaaaaaaaaaaacaaaaaaacaaaaacagtgttgcggcccgaccttcgagccccgccgaagaaggcctttcctatagcaccaacttcgctgggcgcgccgcgcggcccccaagatggtgaagtagacacgagcgccaaatagccggtatccaccatagcgaagaaaccgcgggccacgggcaccaagcgcgcgtgggacattcctcacccaacttaacaaaaacgcccgcggcggcacaaccggacgcgttccgtgacaacaacactccagactgggatnctcctggagacgccaccaaacagcgggcacttctataacaaagcggggactctcaaagcgaagacctcgcgaaatatccaacattacgaacgccccgcgacacgggtgtccactataacacacaccactcgcaccacaatcaactaatcaacaacaccacgacccgacacgaaccgacacaacccccccaaacgaaccacacaaccaccaaacaactcacacacaagccgccgctcactaaccacccaatcgcaactcacctcccaaccaaccacacgacacaccgatatacacactccaatcccgacgtacgaatcatcgatcaaccgacgagccactcgtatagctccaacacgcaccgcgcgcgacgactgctgcacgatatagtgctgcactacacgctccaccggcactttacaccgccggtgtagtacaatacgagaagctaagaaacacaggacctgacgcgcaccatcctgaccgttcgtacgcactgtagcgtgcaggagcgtcaggctgcgtagtacggagtcacgtcttacgatagacaggcgtatggtagtttggcgtgccgatcatgcttgtctcagtcactcactgacggccgtcgatgcgtgccagcgtcgcgtatcgctcgtata

SEQ ID NO: 664365 - DNA, 482 bp, Homo sapiens
  misc_feature (446)..(446): n is a, c, g, or t
tagttcattcccctattccccctcagaaaaagcttaacagaaaaagaaaaaaagaggggggggggaggagatggtttggttggttttttggcctaagcggcctcaggcttcttttttctgacctcggttaagaaagctcagaaaaaaaggtggggggggggtctagcaagagagcactcacttcggaatgagtccaggtctcgggcactcaagaaagggacacggaaacccttctcttggcttctaactagaactacggtggtagattacctgggagatacaatggccaaaccaccagtgaagagttcctataagacaggaggggggcaaaggtgattagatggatcggcagccaacggatcaattaaccaataatcattagatggatggctttaggtcaacttagaaggaagctcttagggtcaggagaaaagaccctccttganttatcctagtcaatatttttctgaagactggtaagg

SEQ ID NO: 664366 - DNA, 395 bp, Homo sapiens
actgctcacacagagatgattagcatcacatggtgttttaaacagatcttttgacacttgagttcaccacaatagcaacaggaggtaactacaaaataattatagtagctcagtatgtactacagttaattttatgcagttatgatttaatactgtatctttgtttacatttctctcaaccgtgaatggtgccatgtacagtttgtttgtatgtttttataaattttaactttttataatagatttgtgtgtattttatagtaaatgataaaataggctagtatctatataactttttgaatttttcctatatttctaggctacatggtttgttttttccaaattgccacaaatctcaaaaaaattttccaatatacttacagaaaaaggcctgt

SEQ ID NO: 664367 - DNA, 122 bp, Homo sapiens
gactggcagttcggccagcttggacagcaccccatggacgggtacctctcccacaccgagcgggctccacggcgtgctcccctcatccccgatggagcattgcaccaccgcgctttttcgag

SEQ ID NO: 664368 - DNA, 194 bp, Homo sapiens
agaggctcccccccttttacgcaggcacagaaagacaaatactgcgtgttctcacttatgtgcgaaaactaaaaagcttgagctcgtgagaagcagagagtagaatggtggttaccaagagcaccggggcaggggaggggcagcttcgggtaggacacacgcccatccttggtatacacgttcctgagcagctt

SEQ ID NO: 664369 - DNA, 335 bp, Homo sapiens
ataccccgtgaaagcacaccccatgtgaagtgtgtgtaaaatctggtcaagtaagaccctctcagcacgtgtaaggtgccaaccaagcttaacctgagtgcaggtcagacagctgtgaactagccaatcggatcattcggatgtgaccggtcatatgtagagccgttgttgccgatgagcagtttcaccaggaccctgttaattgcctcagcacctagtgtacctaccactagccacttccagcctcaccgagatgagtcgcagaaagagaatgctctcacacatataggtgtgtgtgtgtgcatgtgcgtgtgcgtgtgcgtgtgcgtgtgtgt

SEQ ID NO: 664370 - DNA, 330 bp, Homo sapiens
accatcatgggcgtgaccttatgcgccgtagagcatgagcacccgctggccaccgtcgcggccaagagcaagccagaggtcgccgcattcatcgaggaatgcaaggccggcggcacgaccgaggccgagctggccatgcaggacaagaagggcgtgcccacgggcctgttcgtcacccacccgatcaccggcgcccaggtcgaggtctgggtcggcaactacgtgctgatgagatatggcgacggcgcagtcatgggcgtgccggcgcatgacgagcgcgacttagggttcgcgaacaaatacggcctgccgataaagcaggtcttcgcc

SEQ ID NO: 664371 - DNA, 181 bp, Homo sapiens
tgctgggattacaggcatgagctactgtgcccagctaacaacaggaatttatttctcacagttctggagtctgggaagttcaagaacaagaaattggtgagggcctgcttcctggttgtcttctcattgcatcctcacatggcagaagggcatagggactctctggggcctcttttataag

SEQ ID NO: 664372 - DNA, 373 bp, Homo sapiens
gaatttagatagaaacttagcaatgctttttgacagcaggtaacttggtgagtctggaagccaggtgagactgctaacctgtctgaaggtgagtgtgtcatttgagaaagacagaaggaaaaggaacattaaatgacttaggttcctgttctactggtctcatcttagtcattatctcatttactttatacagccacctgggaggtaagtgttatttttaccattaggtagaagaggaaaaggaggttaagtaagctgcccaagacctccagttagtatgcagtggagctaagacctgaacctaaacccatatggtttccatcccatgctctcttcttattaaacctatgctaactttcaccaaacttttaag

SEQ ID NO: 664373 - DNA, 84 bp, Homo sapiens
acctctctgtacttctgtgccagagttacgcatctttttttccagttgcagttcttcgggccagggacacggctcaccgtgcta

SEQ ID NO: 664374 - DNA, 1310 bp, Homo sapiens
tgtactgtaggcacatgtatatatcccagtaagcttcttattcttcactttcactttctacacttcttctactgaacctgcttttactaacgggtacctgtcttagctctgtgactaacttaacactactactactacaaagctcttcctgcagagacttactttactactatgaactatacttcttcagcctggctgaatcaaaagctacttctctcctacaaactttcgctcaaacatgctacttctgtactttctcagcaacttgaactgcaagctcatacttagcagcctcacacttaaacactacctctgtgccaagcaccacacagcacttaacactccatcctcttgagaaacttccgctgcaaactgccaaaactctaccgcgcgacaacaactagcgctttctaaagccacgtagccaacaacaacacaaccgacttccacacaactggccctatctgcaaactttcctccagcagcctactggcacaaaaaatgctgaagaaacacctaaacacttggctcctcgcacgaactggtcaaaacgcactcttatttcatcactcatcacagcatttggcatactagtggacccctgattcccataccatagatacgtgatcattatgaaactcaatttatcccatggattaattttcacaagccctctaacacaagcatttttccagaccttatttatacgcttatactaactaccttaaatgccaaaccttgcggggccccaaaggggtaccaggccaacctgggaagcattattctaattacaagaacaacaacactaacttaattatgcgacccacttactacgggctggcacttttcccctttactggtttaaaacttttggaagccctaacctacacaactttagaggccattactctcgagcaaacaacctcggttcccacaaaccaagccaaattatcccggcttatggcaatagagttggattcccattacgaagacgttaacgttctcggctaacctccatggggcaggattgacgctttccctctcaaacacgagttcaaactactctttggccgcacgacaggcaacaacatgcacacactggcacaactttctggggcaacagcacattgggcacacacaacgttttttgtcccccaacactatcccaaaggaaaccacaatcgtgctaaagccttaatttctatgacacaacgtaaacaaccacctgtagggcatcagtcactcaaacgaattcatttggtccggatcaccccccaacttgatcctcacaacaaacttcataaacgacc

SEQ ID NO: 664375 - DNA, 211 bp, Homo sapiens
gcgtcgacctctgcgagaaatacaaggtttggctggccatggcggcacacacctgtagcccccactacttgggaggctgtggtgggaggatcgcttgagcctgggaggttgaggctgcattgagctgtgattgtggcactgcactccagcctgggtcacagagcaaagagaccttgtctcaaggaggaaaaagaggaaagaaaagtcgacg

SEQ ID NO: 664376 - DNA, 277 bp, Homo sapiens
aacatatggtagtacgagctggtgtgaattcggcagaggctctctctaagttgttaaaataacttttcagaacaaaaaaaaaaaaaaaaaaacaaaaaaaaaaaaaaaaaaaaaaaaaaaaaaaaaaaaaaaaaaaaaaaaaacgggggtttttttggggggggggaaaaagggaggaaggggcggggtaggttcgggccccttttttggaagggggaagggggggccctaagggggggtaatgaaacggggtccggttttagggggggaaaggatg

SEQ ID NO: 664377 - DNA, 430 bp, Homo sapiens
  misc_feature (5)..(5): n is a, c, g, or t
  misc_feature (38)..(38): n is a, c, g, or t
  misc_feature (61)..(61): n is a, c, g, or t
  misc_feature (68)..(68): n is a, c, g, or t
  misc_feature (96)..(96): n is a, c, g, or t
  misc_feature (144)..(145): n is a, c, g, or t
  misc_feature (184)..(184): n is a, c, g, or t
  misc_feature (352)..(352): n is a, c, g, or t
  misc_feature (390)..(390): n is a, c, g, or t
  misc_feature (426)..(426): n is a, c, g, or t
gcccnaattaacaaccccttcaaggggcaagaacttgnacaaggacgactttaacttgggnaaacccnaaaaaagcagcggaagatcgattgtaanaacgacgtccatgacccaggcaacagaacttcaagcagaaagtggtannctgctgcggaggttcaaagtgtccgacgaggtgagtgcnccgcgccttctgctcgcggcccccacgcctgcaacagcacctggtcgggaggaggcctctggggtctgtctccgggccacctctggttctgccgctcaccgtctgcacggccccgccagcatcgcacagtctgcgaggcgcagtgacagtgcactgctcccgggctcnaggtacaccgctgggtctctgctgaagtacaagtcgtnaatacactggaagtcggaaagtcattttcagggggntgta

SEQ ID NO: 664378 - DNA, 104 bp, Homo sapiens
acctccactttctcacttgtcactattctttcatttatgttgtgttcgtaccattcaatattttacttgtaatgcctttcaaaattcaagtagctataggtgtg

SEQ ID NO: 664379 - DNA, 354 bp, Homo sapiens
gggggtcagggacccacttgaggaggcagtctgtcccttttcagagcttgaacaccatgctgggagaacaactctctctttaagatgtgacacagggacactaaggtgtgccaaagctggtgtggccatattttctgagatgccctgcccacagaggggggatctaaagaggcgataggccttgctgaaaagtgggggactccacccatttcgagcttccaggcctttttggttaccctggcagcacaaaaccggcttcttaagccttaacaattggggattcccctccacctgccaagctggaacttatgggagggcaatcttaaactggtggccttgcaatgaacaagggtt

SEQ ID NO: 664380 - DNA, 294 bp, Homo sapiens
  misc_feature (253)..(253): n is a, c, g, or t
  misc_feature (288)..(288): n is a, c, g, or t
gagccattattattgaactgactgtcctgccaccattgaattatgtttgcacctttgtccaaaaccagttggccatgcgttatgggggtctccttctacaccttctcttctgttcccttgatctaagcgtctgttcccttgctgttaataacaccccacggtattgattactgtagcttcgtagtaagtctcgaaatcagcagcacaatcccccactttatggacaagatttacattcagcttgtctttaccngcaaaacgcctgctcagatttttagaggaattacngcatct

SEQ ID NO: 664381 - DNA, 108 bp, Homo sapiens
gcaacgcactgcttaagctgaatcttagggaaaaataaagttactatgcaagaaggtagggaacggactcgtctattcagatagaatcgcagtttgtgataagcttgg

SEQ ID NO: 664382 - DNA, 129 bp, Homo sapiens
tctcatcttgaatcctccttgtcctctgcctcctcctcctcttggcgtttcttgtcttcttcttcctccttaagcctctgctcctctgtcctgttgctgaggagtttggcaacgagacgtggggcgtaa

SEQ ID NO: 664383 - DNA, 965 bp, Homo sapiens
  misc_feature (1)..(1): n is a, c, g, or t
  misc_feature (3)..(3): n is a, c, g, or t
ncncagagtagaagagactgcagcgaggaagacacacccctcagatactgtgcgacgggggagccacggcgagtggggcacaaccgggtcccccgtggtgatatccgcctggggcggaaccccaacgtggccccggagcaactttgtgtaaagcagaattcttctcaatagagcgagggccgtttaagtggaagcacgtgggagacgaaactgggcgtcaaccgtgaggaagaatgggcagcgatgttccgttcagaccaaaggggcggcaccaccacacggcagtgtggggggaaagcgccccagcccggacgcacgtcacacggaatggaaccctagaaggggggtcttcaaagagccgccggtcgattccttgggccccccggcgccgaaactgggggcccggaggcttactacctgggaggacggggtttttacgttggtggcccgccaacacgggtttttcttagacagataagtgggtgagaaaggccacaccaccaccgggtgaaaatcttcagtgtgcgttatattatgggcgcataatacccgcctggtggaggtgaaggtctttcccgccactactctgtgcgttctcccagaagacgcgaccagatgtaaccccgtgtttgtctgtccccccccgttgtgtagaaacagaaagttccgaaagttcagccggtgttgtgcacagaacgtcctgtgtgtccgggcagtaataagagaaactaatataaagtggtagaatggagggaaccccatggcagctccgccgcaagttacggaggatggagtgccgtgaaaacgccaccatgcaagctcgttttgaaggagagataccatagtagagcacagttgaacacaccaaaaagtgtgtgtttccatgcattagaccggcagttcctgcctaaaattctttttaaacaccatcccctttttagaaaaaatttctccccaccaaaaca

SEQ ID NO: 664384 - DNA, 133 bp, Homo sapiens
  misc_feature (3)..(3): n is a, c, g, or t
tangctgtgtgacttggacatttagctgcacctcagcttcctcaactggaagacgtttacagggtgtcatataaaaaataaattacagccaggcccagtgtctcaggcctgtaatcccagcacggatcacaag

SEQ ID NO: 664385 - DNA, 373 bp, Homo sapiens
tttagctgcggctgagcatgctggctcatgcctgtaatcacagcactttgggagaccgaggcagcaggatcaccttaggtcagcagttcaggatcatcctggccatcatggtgaagctccctctacactattaacgctacaataacccaggtatggtggcacacgtctgtaatcccagcgacttgggagactaaggtggaacaattgcttgaatccagtatgcacaggttgcagtgagccaagatcacagcattgcactccagcctgggtgacacagtgagactccatctctaaaacaagcattttgtgcattacttcgagacactaagcaaacaatctttaaacattttggactggagccaggcgtgatgac

SEQ ID NO: 664386 - DNA, 228 bp, Homo sapiens
accagacacgtacactagtcgtagttccagatatctaccccacataaattcacatgtatacacaaaaagagaggcaaaaagagccataattaaagtagtgttatacaacagcaaaacatcagaaacaacttcatgtccaccaaagagcaattgttacaggaggctgcagcgccggaggccacctctagaacacacaagcattttcacagccctggcgcatgcttccaa

SEQ ID NO: 664387 - DNA, 482 bp, Homo sapiens
atccttggattgttttttcctgtcatttatgatgtagaggcctcataaagagccgcaaaattttcaaaggtggattacaggaggtggcaaccccgttaaacctggaacggataggcccccaacctcaggcaggttttttttccttgctcccaggaagggcctttttcaaaatgaaaaaaatgtttttttaagatcatattgatgatgcccaaatttgtggtcctttgtatggccttggttttggttcctcctatggccaaaatggccccgggaattctttttaaagggaagccccccccccgttcctgccataaaatagcccttttttttttttttcgggcccccccccggcttgtatataggttttttttttggtttaatcccccgaccaatagacaggccctttccccccccttttttggcccctttttttttttccctttccgttttaagtttgcccgttcctttttccgtttttttta

SEQ ID NO: 664388 - DNA, 2135 bp, Homo sapiens
gaaaagagatgcaccattttcttcttgttctttggataagctaagctcattcccatcttggagctgttgcactggcccttgtgtggctggtccctcctcatcaccagggtcccagctccaatgtcatcttctctgagaagccgtccctgaccaggcttagttgcttcccaccccagcctgacacactccagcccatcacccagtcagtgttatttgcttcatttttacattatggtctaaaattaacttgctagtttactggtttactagtttattatctgtctccttccattatccctctccttccctccttcccttccccttccttccttccttccttccttccttccttccttccttcgagacacagtcgtactctgtcaccccggctggagtgcagtggtgtgatcttgcctcactacaacccctgcctcctgggttttagcgattcttctgcctcagcctcccgagtagctgggactacaggcacccaccacgatgccaggctaatttttgtatttttattggagacagggtttcaccatgttggccaagctggtctcgaactcttgacttcaagtgatccacctgtctcggcctcccaaagtgctgggattacaggcatgagccactgcacctggcccttttattattcatagtaagacacacagggaccacaattgtctcttctactcagtagttggattctgagtgcctagttcagtatttggcaagtaagagttctacatttgatatcctggtttacctgacaacaaagtatctccaaattcattcattcattctttcattcattcgataggtatttactgaacatctaacttatgcccaacactatgctgagagatatgagataaccatgaatagtacaaaagcaatccctgcccttgcagagcaaacagccaaatatcaggagacaggtaacacacaaggaaatgtacaagaaagttgagccagcacttttataagtgctggttctagtactagctttcataagaaagtactggttctagtactagctttcagtactctcttgtgaaattttcaatattcagtcatttcaacctcaaaaatggcaacataattatgtttcaacataattgttgttttaaacaaacaattttgtttcaacataattctcctgaactgggtggaaggctatcaagaaaaagcttagcttcttcttcaggtaactgcaagagacagggttctctagagaaacagaacaaatatacaaagagattcattataaggaattggaagtccaaaatctccagagcctctgtacttgtacaagtctgaaggccgacaggcaggagaattctctctttttggggcaaaggtcagtgttttgttctatccaggctttcagatgattggttgaggctcactcacattagaagggcaatctgtcttactgccattagaatgcaacctgttttacttagcttactgatttcaatgttaatctatttcaagagcaccctcacagaaacacccagaataatgtttgatgaaatatctgggcaccctgtgacccagtcaagttgacacatgacactaaccatcacagtacgcttagggtcttgtcactcggagtgtggcctgtgaaccagcagcatttttatcttctgggagcttgggcacgatctcaggccccacctcctgcttattgattcagaatctgcattttaacaagatccccaggtgatctggatgcaccgtaacatctgagaagcactcaaactatgtgccgcaaacaaacgccaaattcttaggcatttgtgtggcttggagcacatagttggttctttctactgtctaattcattacattttttcagcacattcctgtctataaaatgtttttttgtatgcaccccaatatatgcacatttataagcatatgcatgaacccacgaacaatgattaggtacattatgaagcatacgtaaggacagaaatttcaaaccaagcttgagggtgaaataaatattatttgaaaacctgttgctaattgtgatgacttcatactatcattagttactatctcaatgcataatgtacagtgacgggtgaagtttatcattaataaaaaaaatctggattttaaccatt

SEQ ID NO: 664389 - DNA, 118 bp, Homo sapiens
  misc_feature (42)..(42): n is a, c, g, or t
gacaagtcctacttccccagcatccccaagctgctgcgggantggtgccccaggaccttatccggcagtctcacctgatgactggaagcggtccatcgtcgcctacttcaacaagcac

SEQ ID NO: 664390 - DNA, 206 bp, Homo sapiens
tccaacaagggggcataactttatttatgatagaaacagtacaaatttcaaaccaagctggagttactcctttgagacaccaaaaaaagtggcttccatatgggtacattggtaattccattatcggatttacaatatcattactggtgttcttcagggctcggactgcctttggtttcgacacatttgcttgggacatgaccaat

SEQ ID NO: 664391 - DNA, 1519 bp, Homo sapiens
atcacacagtattgccataaaccgggtcaggttaacctttcattcccttagtgagctgggctgtgggtgcagccaaaatgtatttgtacggatggaatgagacgaaacggatgtgggacatgatgctatgtgaatgaatggtgatggactgtgtcatgaactgcccctgctgaacggaatggatgatgcaccaatgtcccctgtgcttcttgcctatgctctcgctccgagcaaccatcccagcactcgagcggtagatccaacccacatcattctctgcccttctctctgtctcttgatctccctcttccttcctcttctctcccctatcttcccccctcctctcccacttctcctctctttctcctacatctcactctctctcctcttcctaccccttctctctctcttctctccatctctcgccccctccctccttccctcttctcaccttcacttctctctacagcctccatccatctcactatctctaatcacatatattcatgatacctactctattcttattcctctccaccatcactcaccaaaaacttctcaacctccttctctccatctctcacatcctccctctcatccccctcagtaacatatcatcccgccccaccatctccccctcctttactttattccttactcgtattcccatcgcttcctcacccacccaccctccccccatcctctacatcatacctacgttctcttcccctcatctactacccacccgctccatagtcttttctcccacctcaccaccccactccttcctataattcacttcaccaccccacaccacgatcttcccacttcccatcatctgacctccctctcatcacacaactccttccactacctctactctacactcctcactccccctccaccttacactccttcacttccactctctagcttccacaccccttccataaccactcattcatatcacatcctatacacttttctcactccacccttcctctcacctcctccacctccacacactcacctcctacccaccctccctatacccccactccccctctctcccccccctccctatcaccaccccccacctccccctacccactcccctattcccccctcccctacacacacacctacctccctccctcttcccaccccatgactcactcccaccctatatctcactcttctccctaatataacctctatctctccaccccaacctatatcccactctctaccccttcccacctacccattacatcttatactcctatctctttccctcccttcatcctcactccatcccctcctctcctcccctcccatcccctaatcctccatactctctttaccccctcctcccttcctacctcctctctactcatcccctcgctaacatccatcctataccagacccactaccctaccatacctcacatcattccccttctcttcattcattcccgccccttccccctctccctctctcctcctcccaagtaccccc

SEQ ID NO: 664392 - DNA, 244 bp, Homo sapiens
agtaagatacccactgtgccttcctctcttttgtggtcccttctaagcgcaaagtgcctagggctgtgtatctcctggcagcagttctgaggtggccctattttgccaacccagcctggttggagggactgacagggcttctgcccctaggtgtcccctgaacttggcccacaaaaggcctgaggaatataggggactgtgattgtgtgtgtggtgtgtgatgtgtgacagtggacttgtttgt

SEQ ID NO: 664393 - DNA, 104 bp, Homo sapiens
cctcagttcacctgcttcacacttaggcttctgtgcttagctatcttgggggcgtgttattttctttggggctttggatccagtatggggatatgtgtcgatgt

SEQ ID NO: 664394 - DNA, 164 bp, Homo sapiens
gatatttaattacacaaacgtagaagtaaattataaaaagttaaagtactagcacatatacttgttaggaaaatggtctctgtcaattgcccattttcccaattaaattaacctacgatttccttgttttaacgagcttatttttttccataacaagttgtact

SEQ ID NO: 664395 - DNA, 781 bp, Homo sapiens
gtccgtcccaagaagctgtatttgtccttgtcctttatagtcttcaagcttttcagatctgcctacacacctgactcaccttttttggtcccagttttcaaaacacaaatacacaaatcaacataaaatgtagcctaacaatgtttggattaaatccaattcaataatagaaaaagctgagatatattgtaatgggaaaaaaatggtggcttggagtcagacatactaccatctattaatgtggatctaccaaatatctgagttaccgcactgagtgccttatgcacatcaccacaacagccctatcacagaggtttccatataggaactgggcctttgagggcttataaacacgcccaagatacagagctgctaaggggtggttctaaaattgaactccagatctgtctttctgcctgggtgctcttttcaccctgcaacactctctgtcaacagtgaatcttcagatacagtgaatgtttagttacacataatgcattgccctggaatagtactttgaacgtttataaagtctcatttgatttacagaataactctgtgatgtaagtgtacttatccctgtataccgtgagagaaaactaaggcttggtcagattcagtaacttagacaacattaagtaaccttgcattaactatgctacgaacttaatacatggcatcccaagtattcctaaacctcacaaattgtccatgcatgtaataagatcacgaaactcttaagcagcaagttgagcacagaactccaaactgtaatcccgac

SEQ ID NO: 664396 - DNA, 687 bp, Homo sapiens
  misc_feature (354)..(354): n is a, c, g, or t
attgagcaataatgatctgcagtggacacaggaatacgcaaaggcagtggagcttagaaaggggcagaggtgcacaacaaaaatcggaactaactgcatgtacatgatagctgaagccacaaaaatagattgttatccagggtaaatgtataaaacataaatgtatgacataagtaacgctgatggaactggggggaacacttacatttatatagtagaaaaggataaacggctctgagaggaggaggagattttaaaaaaatagggctgtgaaagccaaggaagaacatgatttcaagaaagaagggataatatcaagtgttcaaagagagcaagaactggcatgaatactanaatgaggagactaattttggcacacaggactggtgacctcatcaaagtattagaagagcagatggcattagattaaaaagtgaatggggtattggcccatgaacagatgagtgaatcaatgaagtagaacaaaactggaaggtgaggaatgctataaatccagactattcttttaacaagtatagcagtaaggaaaagagaaaggcaagacataagagtcaaagctgaggaaggaattttagcatagaagagactgaaatattagaaaacaaagggaaaagaaccaccacgggaggagggactgaaacactagaagaggttacataacttagg

SEQ ID NO: 664397 - DNA, 206 bp, Homo sapiens
cgatacgactttttttatttattttatttttacctcatactcaacctcaaattcaaaatatcctttctctcaacactgtctcttttccaaatttactttcttaaacatgaagctttaggaaagctttaggagtcagcagctccttctctttgtccctttgtcactaagtgttgtggattcttctttggcccttctgtcgtcttctc

SEQ ID NO: 664398 - DNA, 184 bp, Homo sapiens
atcatgtctcataaaaaaaacaaaaagaccattaaatccacagtattataggtatggtataggtttaggtataaaacacagggtctcactctgtagctgggagtgcagtgggcactgatctgggctcactggcaaccttcagccttcccagggctataagcaatccatccgggatatagcctcc

SEQ ID NO: 664399 - DNA, 272 bp, Homo sapiens
agtacacatttgacatgaagcccacatgtccccaggaagagcttcactcaaagcttcatggtgcatttcgacagaattttacattccgcttgtaactgttgactgggagcaaatggtgaccaccaataccggtgtttgacgaacaccatgtctccactctggccaacagtgaacagtaccaactaccacacaatttggtagcacatccgtggagaggcaggcgcaagggcttgtcagatgggacgagcttggtgtgtaggatgctagtccag

SEQ ID NO: 664400 - DNA, 778 bp, Homo sapiens
  misc_feature (646)..(646): n is a, c, g, or t
  misc_feature (684)..(684): n is a, c, g, or t
  misc_feature (708)..(708): n is a, c, g, or t
  misc_feature (716)..(716): n is a, c, g, or t
  misc_feature (737)..(737): n is a, c, g, or t
  misc_feature (746)..(746): n is a, c, g, or t
tttttttcctagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagatggcttcctgaagtgactaaacctgaaggaaaagattatgcccttcattggctagtgctggggactcatacgtctgatgagcagaatcatctggtggttgctcgagtaccatattcccaatgatgatgcacagtttgatgcttcccattgtgacagtgacaaaggttgaatttggtggctttggttctgttacnggaaaaattgaatgttaaattaaaatccatccccaaangaaaaattaaccgtgctccttacntgccgcanaatcctccctcattgcttacnaaaacaccntcttctgatgttttggttttttgaacttttcc

SEQ ID NO: 664401 - DNA, 724 bp, Homo sapiens
  misc_feature (592)..(592): n is a, c, g, or t
  misc_feature (630)..(630): n is a, c, g, or t
  misc_feature (654)..(654): n is a, c, g, or t
  misc_feature (662)..(662): n is a, c, g, or t
  misc_feature (683)..(683): n is a, c, g, or t
  misc_feature (692)..(692): n is a, c, g, or t
tttttttcctagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatatcttcagtggcccagtcttaccgttcagatggcttcctgaagtgactaaacctgaaggaaaagattatgcccttcattggctagtgctggggactcatacgtctgatgagcagaatcatctggtggttgctcgagtaccatattcccaatgatgatgcacagtttgatgcttcccattgtgacagtgacaaaggttgaatttggtggctttggttctgttacnggaaaaattgaatgttaaattaaaatccatccccaaangaaaaattaaccgtgctccttacntgccgcanaatcctccctcattgcttacnaaaacaccntcttctgatgttttggttttttgaacttttcc

SEQ ID NO: 664402 - DNA, 556 bp, Homo sapiens
  misc_feature (195)..(195): n is a, c, g, or t
  misc_feature (243)..(243): n is a, c, g, or t
  misc_feature (248)..(248): n is a, c, g, or t
  misc_feature (251)..(251): n is a, c, g, or t
  misc_feature (268)..(268): n is a, c, g, or t
ggcagttactgagaactcataagacgaagtaaaatccctcttcgtcttatgagttctcagtaactgccctgaacacatcctgcaaaaagcccagagaaaggagcgccatggattactacagatatgcagctatctttctggtcacattgtcggtgtttctgcatgttctccattccgctcctgatgtgcaggatngcccagaatgcacgctacaggcccattcttctccagccgggtgccccnacttnagngcatgggctgctgcttntctagagcatatcccattccactaaggtccaagaagacgatgtatggtccaaaagaacggtcacctcagagtccactgtgctcgtgtagctaaaatcatatacacaaggggtcacagtaattggaagggtttccaaagctggagaaccacaacggcgtgccactgaagtaactggttattaatcacaaaatcttaaagtgttttaccaaggtgcggtcttgatgactggctgattttcctggaatggaaaataaagtggtctaggtgtatatggtatggtgagaataa

SEQ ID NO: 664403 - DNA, 795 bp, Homo sapiens
  misc_feature (16)..(17): n is a, c, g, or t
  misc_feature (25)..(25): n is a, c, g, or t
ccagtctggtaccccnncgcgttanggatatcgtcgaccaggcctcgccacagcgtcgggctctcttgagaatccaatccctcgagggagctcccaaaatgggccgcaggagcattgcgtcccccagatttgtgggattctgcacagataccctccttccccacctccatagaggatgatctgggccagctgtctgacctggagccagagccagatgcccaaaattggcgagcatacagtggtgcaatggatgatgctgcgctggtgctcacccagcgggagattgaccggcaagaggtcatcaatgagctgtctctgtgactgaagcttcccagctgcgcaacactccgggtcctggacctgatacttctaccagcgaatgcctgactggagaacctgatgccccgggatggagctggacccggctcttcccgaagctgcctgaactcatacgagattcacaattccatggttgtgaagccatgaagaagctccggggaggcaaggcccacatctatcccacagacgatcacgtgaaactcaatgctgggcaccggcttatgcatggccctgcccgagagggaatacccagcacagtggactggcacacaggacacatgcgcccatagtcagtccaagaggcccgtaagacgctcactcaacgaccgcaagcaaccgccacgggcacgaggtcgaattcccagagtcatacactcgccaggacaggcaggagaggcgcaccctcaggagtcaggagcgcagcagctgacagagacctcaccattctctggaagg

SEQ ID NO: 664404 - DNA, 308 bp, Homo sapiens
  misc_feature (135)..(135): n is a, c, g, or t
cataacaattctttgaagaaaggaagggattaaataatttttttccctaacactttcttgaaggtcaggggctttatctatgaaaaagtagtaaatagttctttgtaccctgtgtgaagcagcagccagctttanagtagtccattcttgctaatggttagaacagtgaatactagtggaattgtttgggcggctttaagtttttctaaacaaaaattcttaaataatagattccaagacctggtacaaggatttcctgggggaccgaaaattcttttaaaagtaaagcttctgtcatccaaaaaaaa

SEQ ID NO: 664405 - DNA, 401 bp, Homo sapiens
gagctctcttggtgggggaaacatatgagtactgatcatctgaagaagaaaatccctccagcagagttttataaggaaacatagttaggtccaaatgaagtttggaagaatgtaatgtattgcagcctttatgaagtggtggaaaagacaagaatgggaagtaacatggagagtttactgcaaaaactagacagagaaaaactggttctggttaaaccttggggcagcacgaggcatactttttcttctccccccttatcagatggttcctcccatatgaatatcagcaggccaagtctcgagtcctacatgcttggtttctatttcaagcacctcacagcatcgttcattcacaaagaggtccaaccaatgcagccccacagagagcacgtcgggtaccg

SEQ ID NO: 664406 - DNA, 152 bp, Homo sapiens
cacactcagtgcaaacagctcatgcaccatgcattccgggcattccagtggccggtcgttttcacacgccaggcaacacagctcatgcacccatgcattccgggcattccagtgggcctgtctgttcttcaccactccaggcacacagcagc

SEQ ID NO: 664407 - DNA, 120 bp, Homo sapiens
aggcctgggtaaagactgataggaaaagaaggcagaaatttgaagaaaatgaacatgaaacaggtaccaagataacaatctcatctttgcaggatttgagcatatacaacccggaaagaa

SEQ ID NO: 664408 - DNA, 739 bp, Homo sapiens
  misc_feature (35)..(35): n is a, c, g, or t
  misc_feature (68)..(68): n is a, c, g, or t
  misc_feature (127)..(127): n is a, c, g, or t
  misc_feature (167)..(167): n is a, c, g, or t
  misc_feature (195)..(195): n is a, c, g, or t
  misc_feature (288)..(288): n is a, c, g, or t
  misc_feature (294)..(294): n is a, c, g, or t
  misc_feature (311)..(311): n is a, c, g, or t
  misc_feature (321)..(321): n is a, c, g, or t
  misc_feature (327)..(327): n is a, c, g, or t
  misc_feature (353)..(354): n is a, c, g, or t
  misc_feature (356)..(356): n is a, c, g, or t
  misc_feature (360)..(360): n is a, c, g, or t
  misc_feature (363)..(363): n is a, c, g, or t
  misc_feature (367)..(367): n is a, c, g, or t
  misc_feature (373)..(373): n is a, c, g, or t
  misc_feature (375)..(375): n is a, c, g, or t
  misc_feature (423)..(423): n is a, c, g, or t
  misc_feature (468)..(468): n is a, c, g, or t
  misc_feature (474)..(474): n is a, c, g, or t
  misc_feature (500)..(500): n is a, c, g, or t
  misc_feature (510)..(510): n is a, c, g, or t
  misc_feature (544)..(544): n is a, c, g, or t
  misc_feature (568)..(568): n is a, c, g, or t
  misc_feature (579)..(579): n is a, c, g, or t
  misc_feature (582)..(582): n is a, c, g, or t
  misc_feature (591)..(591): n is a, c, g, or t
  misc_feature (630)..(630): n is a, c, g, or t
  misc_feature (638)..(638): n is a, c, g, or t
  misc_feature (647)..(647): n is a, c, g, or t
  misc_feature (657)..(657): n is a, c, g, or t
  misc_feature (692)..(692): n is a, c, g, or t
aggcaagagagggtggaggaaattctgcaggaganaggcttcctccagggtctggagaacccagaggnagctcctcctgagtgctgggaaggactctgggcatcttcagcccttcttactctctgangctcaagccagaaattcaggctgcttgcagagtgggtganagagccacggagctggtgtccctgggancctctgcccgtcttctctccactccccagcatggaggaaggtggtgattttgacaactactatggggcagacaaccagtctgagtgtgagtanacagantggaaatcctcgggggncctcatcccngccatntacatgttggtttttctcctgggcannangggnaanggtntggtgntntggaacgtgtttcggagcagccgggagaaagaagggcgcttcagctgnataattctttcattgtctcagcctggggcggtgggctgtacctgnaccttncgctgggtgtacgtctgtccccctgntggggcttanccttatcatcgttatccgggggacctattgtacntgggcccctatatggggaaccctntcctttcgtgncanaggcctcanggcatggctaaccctcaatcctttcggtgcaaacaatgntaacggcncaggcggtnctttctggcnctcaaccggggccttcaaggctcttcgaaccggcntaaccctggggccaattcggtgtaggggccaaggtgtggccaaaatg

SEQ ID NO: 664409 - DNA, 721 bp, Homo sapiens
  misc_feature (35)..(35): n is a, c, g, or t
  misc_feature (68)..(68): n is a, c, g, or t
  misc_feature (127)..(127): n is a, c, g, or t
  misc_feature (167)..(167): n is a, c, g, or t
  misc_feature (195)..(195): n is a, c, g, or t
  misc_feature (288)..(288): n is a, c, g, or t
  misc_feature (294)..(294): n is a, c, g, or t
  misc_feature (311)..(311): n is a, c, g, or t
  misc_feature (321)..(321): n is a, c, g, or t
  misc_feature (327)..(327): n is a, c, g, or t
  misc_feature (353)..(354): n is a, c, g, or t
  misc_feature (356)..(356): n is a, c, g, or t
  misc_feature (360)..(360): n is a, c, g, or t
  misc_feature (363)..(363): n is a, c, g, or t
  misc_feature (367)..(367): n is a, c, g, or t
  misc_feature (373)..(373): n is a, c, g, or t
  misc_feature (375)..(375): n is a, c, g, or t
  misc_feature (413)..(413): n is a, c, g, or t
  misc_feature (460)..(460): n is a, c, g, or t
  misc_feature (478)..(478): n is a, c, g, or t
  misc_feature (488)..(488): n is a, c, g, or t
  misc_feature (513)..(513): n is a, c, g, or t
  misc_feature (535)..(535): n is a, c, g, or t
  misc_feature (574)..(574): n is a, c, g, or t
  misc_feature (638)..(638): n is a, c, g, or t
  misc_feature (652)..(652): n is a, c, g, or t
  misc_feature (680)..(680): n is a, c, g, or t
aggcaagagagggtggaggaaattctgcaggaganaggcttcctccagggtctggagaacccagaggnagctcctcctgagtgctgggaaggactctgggcatcttcagcccttcttactctctgangctcaagccagaaattcaggctgcttgcagagtgggtganagagccacggagctggtgtccctgggancctctgcccgtcttctctccactccccagcatggaggaaggtggtgattttgacaactactatggggcagacaaccagtctgagtgtgagtanacagantggaaatcctcgggggncctcatcccngccatntacatgttggtttttctcctgggcannangggnaanggtntggtgntntggaacgtgtttcggagcagccgggagaagaggcgctnagctgatatcttaattgctagcatggagcgctgcgcctgaaatgaanttagtgcgctgaagctgnaaatgtgggntaaataaaagtaaagggactatgantggccctttgggcaccttcttntgcaagctcagcagctacctcatcttcgtcaaaatgtangccagcgtcttctgcctcaacggcctcagcttagaaagctaaatggcaatcgtgaggccagtgncaatgctcggctgnggctgcgggtaagcggggccgtggccanggcagttctttgggtgctggccgccctcctggccatgcctg

SEQ ID NO: 664410 - DNA, 168 bp, Homo sapiens
ctcccctctcgctcaaccgaacacacagacagaaacaacagacacatggggtctacttaacgggggacaggtggaacggagagacgagaagcagaaaagttaactattgctgtattagggcttaatatcggggtgatgcaaggcgttttgaaacgcgctactctagat

SEQ ID NO: 664411 - DNA, 461 bp, Homo sapiens
aggctctgggcatcagggagctgtggtgtctgcaggcgccctgcccgcccgccctcccttctcttcccctaactccgaagtcatgtgaggcgtgggagtggcaggagccgctcttcccacgagtaagaacctgtgctgcagtggtgtccaagccggactcctgcctccatcgagaacctccatggccttgtggaacctgggatctcagaggcaccagcctgcaaacctcccgtttaaatgcttctttttttattttttatttttattttcttttgagacggagtttggctcttgtcgcccaggctgcagtgcagtggtacatacaatctcggctcactgcaacttctgcctccgagattcaagcgattctcctacctcagcctccccagtagctggaattacaggtgtgagccactgcgcccagccgagcatgactatttttaaagttcatggtgcttcta

SEQ ID NO: 664412 - DNA, 250 bp, Homo sapiens
gcacattgagcccgccaggcaggatgccctcgtgcttgagcccctgttccacgcagtcctgcatggcacgccagagcgccatcaggccgctgcggatttcttcttccgaacgccagaccttctcgttggccagcatcagttcggcgacccgcaggttgtgcttctggcacaggcccagcagttccaccgcactggaaaaatcgtaaggcagctcgctgcggtccaggtccgccacaccgctgtcggcctg

SEQ ID NO: 664413 - DNA, 103 bp, Homo sapiens
aagacgtaaataaaataaaattaaaataaataagtaatgaattgtcagtggtggacctctcgggtgtgactatgcttttcttttagctggggtagtcacagag

SEQ ID NO: 664414 - DNA, 497 bp, Homo sapiens
  misc_feature (253)..(253): n is a, c, g, or t
  misc_feature (259)..(259): n is a, c, g, or t
tcttcttgggcctggcaacgatcttcctgctctgacccttcccgcgggggcaaacctgccctcgctttgcttcttattcccaaactcgacgcaaaaaaaagccagcacagggctggcttcggctttcaggtgtcaatcaattggcttctgcggccgcctccacgtcgtgcgcgatgagcgagacgagagcattttgctggcggtgggagagctgacgaaaacgctgcagcagttcgcgttcgtgcagtgacanctactnaccttaagcttgcgggcaaaaggccatatccctatagaaaggacacccttcgactcagattccgcgctggcctggacgaaggttgccgagcttcgctgcagctgcgggaaatttttccaaccagtccgcaaaaacgcaaatcagtactggcataaagcctttaggcggttcaatatttgtcacagaattgacgccaatgaaatggcaaattgagcatatgcggcctcttgcattcgcg

SEQ ID NO: 664415 - DNA, 319 bp, Homo sapiens
  misc_feature (98)..(98): n is a, c, g, or t
  misc_feature (130)..(131): n is a, c, g, or t
  misc_feature (148)..(149): n is a, c, g, or t
  misc_feature (173)..(174): n is a, c, g, or t
  misc_feature (198)..(198): n is a, c, g, or t
ggcgttgtcagtgggcaggcggtgctctaatactggtgatgctagaggtgatgtttttggtaacaggcggggtaagatttgccgagttcctttttacntttttttaacctttttccttatgatgcatgcnnctgtgttgggtttgacnnagtgagggtaataagtgacttgtnntggttgattgtagcatatctgggnctgttaatctgttcatgttcagtgttttaactctgacgcagtgcttattgcggaggcagacatgttttcattgttacattattactaacattatgttcttctataggtgtgatacgatttg

SEQ ID NO: 664416 - DNA, 444 bp, Homo sapiens
  misc_feature (200)..(200): n is a, c, g, or t
  misc_feature (206)..(206): n is a, c, g, or t
taatgtcgcgcactaggctgggagccactcacacaagctcaaaccctagccttcgtcgcgagcgccgtgctgggcagcctactgataattgcactcatcaagggtcgccgaatcaaattcgatccactccttcgctagccctcccccgccgccccttctccctaccttatgtcgcctgacactcgtaaatagccgaacanctactnaccttaagcttgcgggcaaaaggccatatccctatagaaaggacacccttcgactcagattccgcgctggcctggacgaaggttgccgagcttcgctgcagctgcgggaaatttttccaaccagtccgcaaaaacgcaaatcagtactggcataaagcctttaggcggttcaatatttgtcacagaattgacgccaatgaaatggcaaattgagcatatgcggcctcttgcattcgcg

SEQ ID NO: 664417 - DNA, 330 bp, Homo sapiens
ttaaaaaactcaagtgttggcgggtagcacccgcccgcggctgtaatcccagcactttgggaggccgaggcaggaagatcatgaggtcaagagatcgagaccatcgtggccaacatggtgaaaccccctctctattaaaaatacaaaaattagctgggcgtggtggcgcacacctgtagtcccagcaacttgggaggctgaggcgggagaatcacttgaacccgagaggcagaggttgcagtgagctgagatcacatccctgcactccagccttggtgacagagcgggactgcatctcaaaaaaaaaaattctagtgttgtaagccctca

SEQ ID NO: 664418 - DNA, 231 bp, Homo sapiens
  misc_feature (54)..(54): n is a, c, g, or t
  misc_feature (82)..(82): n is a, c, g, or t
  misc_feature (113)..(114): n is a, c, g, or t
  misc_feature (173)..(173): n is a, c, g, or t
cgcggtcccatagctacatggtacaggctgttgtctgctgctgcactgcaaaantagtccatttcctgtggatggtcaggangtcatgtagtccggcacagtcatgtcagtcnnggcaagtatgtcagtccggcacagtcatcatcagtccacggcacagtcatgtcagtccnggcaagtcatgtcagtccagggcgcatcctctcagcagtcgcacctagccaggccatg

SEQ ID NO: 664419 - DNA, 942 bp, Homo sapiens
tagaaggccatacgattgtgctctgggtgacggggcatccccctccctttttgttctgtttgtttgtttgctacgagtccacattcctgttgtaatccttggttcgcccggttttctgttttcagtaaagtcctcgttacgccaaaaaaaaaaaaaaaaaaaaaaaaaaaacaaaaaaaaaaaaaaaaaaacaaaatttaaaaaaaaaaaaagaaaaaaaaaaaaaaaaaaaaaaaaaaaaaaaaaaaaaagaaaaggaggggggggggcgcagaaaatcttcccgccgagggggcgggcgccacgcccgccccatttttttcgagaggcgggggcccctagggggggcgcgaaaaaaaccagccaagccgcgcaggcccgaacgcactacataactcccaacatccgacggcaggagggacatgacaacccaccgacgccgagtgcacccatgttaagaggacggagccaaccacacccatacaagtcgggcgtcggggcgcaccacaacctacgcgcgaggagccgcaccccacaccccaacgataaacgccacgctgcccccgacggacaaccaaacacccatgacctgctggagcagacgatgacgccaacacacacaccaacgtccacccactacgcgcgcggtcgcacagcacaaaccacgcggcgccgcgtgggaagtacctctaacgagaacaacaactacaccaaccaaggaggggccaccgtgaaaagaacagcgcgcgcagcgccgtacgcatcagcgcagacagcccgacgcgcggaagagccagatctgagagacgacacaagccaacgagaagacaacacaacacgcagccgatcagccaccccacacagcccaccagccgcgcaaccgagacaacgaacgacaaaccacgcacgcgaaacgagagagccccatcgacctacgcgcat

SEQ ID NO: 664420 - DNA, 1897 bp, Homo sapiens
ggagagagagagagaactagtctcgacgttatatttttttattttggggttttaaagtgtgaaaggggagatgaaaatcggtctaattctctcattgggacctgggtcaggtggtctcccgtgtgtcaccagagcgggaaacagaggggaaccccgtgaacaacgtgttggcgggagagaaacgggtgtcctctcagggaccctatattggcagccaaacaacagccactcgtgacataacaggcctcgtgcagacgcccaccccgtataacgcagcggccacaggagcatctacacgcacacaacagcgtgggacacagcggtacgccacaacacagcgacacacacggacaaccaacccatacacacagacgcgcacctcccccgcggggcacgcaccacaaaacactctacaagaacatacgcgtgacacaaccagagcagcccctaatcaaacacacaccgagcacacatcacacgcgtgggcaaaacaccgagggcttcgacgcgccacagcgtcctcctaccgcgacaagacatcacaacgagaaacaacttacctcacccaccgaacacgcgcaccccaccgccgcggcgggcgccacaccacgtactacacgacacagagtggacacagacaacacaaaccaacacaacataacaagagacacaacaacgcggtgggctgttgcgcgtgtggcccgccattcctccactaccaccctccacggcccgggcgacccccaacaacacacccgccggccaacacaacacaccacataacaccacaaccacacacaccacacgcccggcggacagccacacacagacgacgacacacacgccaccctgcgacaccgaccacacaacatcaccgacagacgagcgccacacacctacctcgagagagacaccacacacaacaacacaacacagagcagggacgaccaccacacaacactgcgccaccccacccaccacaagccacacgcccacacaacgcaacagcaacgcgacaacacaccaccacgcaacacctcccactcacgtcaaccacgcccccacaccaccgctccacaccgccaacccagacaacaaatcacgttagcagccagacccacacaccccaaccacggtgcacgcgcccccccaccaaacgcgcatcaacactccccccaccgataccacacacgacacccacaccacacccacccagcccagcgagccccgccgaacactcacacaagcaacacccgccacagcacgagaccagcacacagcgacggcaaacgcactagcccacgcaccgacagacgttccaccgcaaccaccacaacagaccccccaggcaaccaactagcccacgcgccaagcgagtcaccacacacacacagcacaccggcgaagccacacacacaggacgacacacacaaccacaccgctccacacaacataactaggcatgcaccgcggccacgccccaccacgacactgcacacccaccaccgaacaacagcacgaacaaagacacccacgccaaacacaaacgaccagccccgactgcacaaacacaggcgtcgcacacacgagaacacgccgccggagcacaaaccacgcacgacgtacgaacaccaacgaacgcccggccaccgaccacgaacacgcaacgagctaaccaccgccgagccgccgcaagagcacacaccaccacacaaaccacaacacgccacacaacaagacagagacgaaacaccacaacacgacacagaacccaccaagcaacacacactagccaaacaacagcgacacacccaacaccaggcgcccacaccacaacacaccaccaacacacgagcgcacgccccaccgaacagaaccggaacacagtagacaaccg

SEQ ID NO: 664421 - DNA, 493 bp, Homo sapiens
tattaaagggcatattaatgtaaaactataaaggccctgaattattttcttaggtgatttaaatttttctctttaactacaaattgtgtttcaatattaatagaagtcttaaaatattagataaatgaaccctagttattttgaggtagctccttgaaagtaaggcaactccagctacccttttaacctgctaagtggttacgttttgtcttgtttccttaaaaaaaccataaatagtcttattaaggaaataatgaaaaggtttccagaaatagactttctcaccaacagtttaatagccgacatttattgaacgtacacattttaatgagaattaggataaaatattaactgcctctgttatacagagaaagatgacatgcttttcctcatagcccaaacggtacatgctgaaatgacagcagaggatttttgtctgtgttccctgaaccaaagttttatcagtctaaaataaaatttgtgtttttatttt

SEQ ID NO: 664422 - DNA, 715 bp, Homo sapiens
gccggctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagacccacatgggcagtcacggtaagtggggcagtgtccggaccagtggacgcagcagtggccttggaacacgatgtggagactcccggactagctggcagagacgcactggacaccacacccaggacacaacgggggcccatcacacgaaaccgggacattcctgacgtccgcagacggagacagaccctctatatccttgggaggacaaaagcaccagcgtcaagggtgtgcaggtcagaaccgcctgcagacaagatgggagctggatgcccatagaggtaattcgaggacacggcaggtgaaggctagacttcaagaagctgctgaaagacatgtgtcccaggcatgccccggctgattgagacccaagaaccaagactccttcctgagactcactggaggactcagagaggatgatccagaatccacaaagctgctgcaggtgtctgtgcatggaggagaagctccggaatcaggctcctccgagcatatgggacatgaggatggcttgggcacattaacacccaagtgggatccatggagaagaggatctcaaac

SEQ ID NO: 664423 - DNA, 117 bp, Homo sapiens
aaatctctcattgcgaacagtgactatgctgaggcttgcagtttggactgaaagtgggctcaccccctgcttactagctgggtgacttgtgcagtccttcacctctctaagcccaat

SEQ ID NO: 664424 - DNA, 173 bp, Homo sapiens
accctgacggaattgttgagagcatagaataagagtctagttggagatcaggaatagaaagcagaaaaaatcctggagagaaataatattcacaagagactggcacactgagcaattatgcctgtagaaatgcatgcatgaggtcttaacattgacacaatgttaccatcata

SEQ ID NO: 664425 - DNA, 230 bp, Homo sapiens
atcgtgtcttggattgcggaaagaccttatgggtgctgtgaagagcagaaggttgcttgccattcaagctatgaaggaacgggaaatccaggaaagagaaatgatagtgaaactgtaacgccaagctgaagaagaacgaatactgaagcacaaagcagctgttgagggatctttccaggaaggtattgtcaaggccaaactagtcattcgcagtgtccaatattcacgtt

SEQ ID NO: 664426 - DNA, 362 bp, Homo sapiens
ctgcagggtttcaatcctatcagttactcttctcaacatcgcctatcaattatttgctgttttgctctagggttctgatatttaaaagaagatacaagtcaagctgtgagattttgcctgagttttctggatacttgcctcaattttatgctgaatgtctgcttcggataccagctatccagggggggtccccttgcttcgcttgctccctttgcaaatttgagaaacgcttggtatttaccaggggttcataaaatcagacctctgccaggaacttaaactgaatgaaatagcaatccagagactattggatgttctgttgaggcattctctgggtttaagtgttcaaaaattcataacta

SEQ ID NO: 664427 - DNA, 1723 bp, Homo sapiens
  misc_feature (1)..(1): n is a, c, g, or t
natccttacttggttattgagactagccgcaggtgtacacctctgtgtgccccgcccacgttagctggcctcttttttttggggtcgaccactacatattgatagcgtagcgcatgctggttgttcgtacccgacatcaacagccaggcggggtgtggtgtgtctcaccgcgtttctcccggcgaatgttttctctcccccgagcggtgttgttttgctggttagctgccgtaccagctcggactgctagctctcctcatcacgccccctcttgtggcagcccctttttttacacaagggggggcccgccctttctcagtctgtccccgcctctctgttattgtggtggcccccttctctccggctctcgttgtgccccacactacttgttgggtttgtcttctaacaagtgtgttgcgcagctgtgcttgcctacttgtttgggcggcgcgcgtgcgcgctcgtcactaggattgtgtctgtgaggggggcctcgtcttttgtttttgtctccgtccctttccgtcccccgcccgtgttcgtctgccgcttttgtttgttgccccctcaacttgttgttgtgtggggggcgcgccgctgcaggggtgtgtgtttatactacaccgccgctgggtgggttacgttgtgccgccacaatgcttgtggctccttcatggggtgcgcaccagccacacgggagacgccactgcccgacagcgcgttgggtgtcccccccaacataataatggggcccccttctttgcgggatttatcgccggggggtagatgtaaattgtctcctgcagttgtgttatgttttcggcccgtctcgtccacgagagagatgttgtgttgttcttttcttgtttttcggccgcaacgaggaatgatggttttttgtcgtcgagggaggccgcgtctgtgttggagacgcacacggcgtctcctccgaggacgcctgctctgggtggccccctcttttgcccccctcccctctcctcttgtttatgttgggaggggaggcgccacctcttgcggggccgaccactcgcagcatcacagcagagtcgtcttttcactcctctgccctgcgtcttgttagatttgtcccccctcctctcagaggaggtagtgtccccccaccacttctgcgtcttgtagtaacggacaccgctacttctcccctctggtgttttatcacgtctccgtcgacttcttctcgagagagatttattcgctatctccactctcgggagacatgccaacgcgatagagattggttatatatagagagaaaccacacactcgctgttacaccccaatatatatattctcagacccgtcgtcgtttatatgcacacacatatttatactcggggttttcttatatttaccacctctctcttccagagacgcctccaggagtactttctggagtcttccccttgctcaccacatgttctcgcgcgcggcgatttatccggcgtccacacacatattttgtggagcccacacaggcgttctccacggagctttctcaccctccattattggcgtcaacatttcctccacttatttgctttctaccccccaacttataatttccacctttacaaacccaacaatccactttggctttgaaacccccccctgatatactggcatttttttaatattggtttgaatatttttgtatgtttccattttttgatgggggttttta

SEQ ID NO: 664428 - DNA, 285 bp, Homo sapiens
tcggcctgtagacgctgaactatgaggaatgattccatttatatgatgtacctgaagtagtcaaatttatagaaacaaagtagaatggcgactgccaggaactgcggagaggggagaatgggagttatagttcaatatatacaaagtttcagtttgggaagatgaagaagttctggagattaatgctggtgttggttacacaacatcaatgtatttaatgccactaaactgtatactttaaaagggtaaatttttttttttttttttttttggaaagactggttt

SEQ ID NO: 664429 - DNA, 614 bp, Homo sapiens
  misc_feature (160)..(160): n is a, c, g, or t
  misc_feature (323)..(323): n is a, c, g, or t
  misc_feature (365)..(365): n is a, c, g, or t
  misc_feature (389)..(389): n is a, c, g, or t
  misc_feature (398)..(398): n is a, c, g, or t
  misc_feature (430)..(430): n is a, c, g, or t
  misc_feature (439)..(439): n is a, c, g, or t
aataggtttctggctgatgtggagaaagtttttgtgatttggatagatgaaattagttataatatttctttaagtaaaagcttaactttcttttagttctgtgaaggctgagagaggtgaggaagttatagaagaaatgtttgaagctagtagaagttgntttatgaagtttaaggaaagaagctgtctttttattccattaaagtgtaaggtgaagtaggaagtgttgatggagaaggtatagtaagttatccagaagatctagctaagatcattgatgaagatggttacattaaacaacagattttcagtgtagatgaaantgccttttattgaaagaagatgccaccaaggacttttatagntagagaagagaagtcaatgttggnttttaaagntgtaaaggacaagttaactctccctttagggntaattcagntggtgatggtaagcagaagctcatttaccattttaaaaatcctagggcccttaagaattatgctgaatttactctgcctgtgctctataaacggaaaaacaaagcctggatgacagcatatctgtttatagctcagtttactgaatactttaagcccactgttgaaacctgctca

SEQ ID NO: 664430 - DNA, 111 bp, Homo sapiens
ggccggacccgcgcccgcaaaaaaaaaaaccccccccccccccggccggcggagaggaatcggggttcggacgggggccgccagggggaaagggaagggggccaagtggcg

SEQ ID NO: 664431 - DNA, 367 bp, Homo sapiens
tgaagcgtcaggatggagcgatagtcctggaattcacctgattcggaccttagattggtgcacacagatcccctccagtcttctccctctccatcagcagcctgtaacaagtgccttgtgagaaaagctggagaagtgaggggaggcaggttattctctgggaggttgggtgggatgaaggggtaacccctaagaagatgtgaagtgtgggtttgggtaaggaaaaatggcttaacattccccaaccccaaaacaagttcttacagaactaaagaattaagggtaccatcaaattaccttaggcctgaagaaaataaccccgatccttggttgggacagcctccctggttgcccttgacggcttgta

SEQ ID NO: 664432 - DNA, 358 bp, Homo sapiens
  misc_feature (18)..(18): n is a, c, g, or t
  misc_feature (63)..(63): n is a, c, g, or t
  misc_feature (69)..(69): n is a, c, g, or t
  misc_feature (72)..(72): n is a, c, g, or t
  misc_feature (88)..(88): n is a, c, g, or t
  misc_feature (99)..(99): n is a, c, g, or t
  misc_feature (111)..(111): n is a, c, g, or t
  misc_feature (115)..(115): n is a, c, g, or t
  misc_feature (134)..(134): n is a, c, g, or t
  misc_feature (188)..(188): n is a, c, g, or t
  misc_feature (197)..(197): n is a, c, g, or t
  misc_feature (202)..(202): n is a, c, g, or t
  misc_feature (211)..(211): n is a, c, g, or t
  misc_feature (216)..(216): n is a, c, g, or t
  misc_feature (228)..(228): n is a, c, g, or t
  misc_feature (263)..(263): n is a, c, g, or t
  misc_feature (266)..(266): n is a, c, g, or t
  misc_feature (290)..(292): n is a, c, g, or t
  misc_feature (299)..(299): n is a, c, g, or t
  misc_feature (320)..(320): n is a, c, g, or t
  misc_feature (322)..(322): n is a, c, g, or t
  misc_feature (328)..(328): n is a, c, g, or t
  misc_feature (332)..(332): n is a, c, g, or t
  misc_feature (336)..(336): n is a, c, g, or t
gaaaaaaaccaattaganaaaagaaaaaataaaatcaagttttacaagcaagcatcatgaganaaagcngtnaagacgccttttcagntcacaccaganccgacaccagtntctnccccagcccacatgaagangtttttattcaatacaaacagtaacagacgcaacacaatggccatagaatgagnacataagtncattnccctttttnccgcnttctggctatangctctgacaagcctatcattcttttcttaccaggngancagaaatcatctgctaatgccagnnnctttaangctcttaattcagctgggganancttcanttgngggnctttatactagctacttgcttc

SEQ ID NO: 664433 - DNA, 1064 bp, Homo sapiens
  misc_feature (9)..(9): n is a, c, g, or t
  misc_feature (144)..(144): n is a, c, g, or t
  misc_feature (171)..(171): n is a, c, g, or t
  misc_feature (182)..(183): n is a, c, g, or t
  misc_feature (187)..(188): n is a, c, g, or t
  misc_feature (194)..(194): n is a, c, g, or t
  misc_feature (197)..(197): n is a, c, g, or t
  misc_feature (211)..(211): n is a, c, g, or t
  misc_feature (217)..(217): n is a, c, g, or t
  misc_feature (220)..(221): n is a, c, g, or t
  misc_feature (223)..(223): n is a, c, g, or t
  misc_feature (245)..(245): n is a, c, g, or t
  misc_feature (302)..(302): n is a, c, g, or t
  misc_feature (440)..(440): n is a, c, g, or t
  misc_feature (480)..(480): n is a, c, g, or t
  misc_feature (628)..(628): n is a, c, g, or t
  misc_feature (649)..(649): n is a, c, g, or t
  misc_feature (654)..(654): n is a, c, g, or t
  misc_feature (708)..(708): n is a, c, g, or t
  misc_feature (754)..(754): n is a, c, g, or t
  misc_feature (802)..(802): n is a, c, g, or t
tggaaagcnactggtttgtgtgggttacacagatgaaccatattcccatgcacattgatcatgaccggaacatgaactggtttccacccagctccaggcaacatgcaatgtccacaattctgccttcaataactggttcagtgnacacctcaacttccagattgagcaccntctttttcccnngttnnctctanacnattaccacatagtngctccnttnntntagtccttgtgtgccaagcatngcatagagtaccagtccaagcccctgctttcagccttcgcctactttatctttttantaaaggagtctgggcggttctggctagatgcctatcttcaccaataacaacagccaccctgcccagtctggaagaagaggaggaagactctggagccaaggcagaggggagcttgagggacaatgccactatagtttnatactcagagggggttgggtttggggacataaagcctctnactcaaactcctcccttttatcttctagccacagttctaagacccaaagtggggggtggacacagaagtccctaggagggaaggagctgttggggcagggtgtaaattatttcctttttctagtttggcacatgcaggtagttggtgnacagagagaaccaggagggtnacagnagaggagggacctactgaacccagagtcaggaagagatttaacactaaaattcnactcatgccgggcgtggtggcacgcgcctgtaatcccagctacccnggaggctgaggcaggagaatcgcttgaaccggggaggtggaggttgcngtgagctgagatcacgccattgtactccatgcctgggcgacagagcaagactccattgtactccagcctgggcgacagagcaagactccatttcaaaaaacacaaaaaaaatccactcatttaaacggtgagctcagctcacgggtcccatttctcaggtggctccttccatccctcattcgcaaacctcagagggcatacggcgttgaacccttgatgagccagcacttataaccgcagggcacctttactgcttacgcat

SEQ ID NO: 664434 - DNA, 240 bp, Homo sapiens
  misc_feature (30)..(30): n is a, c, g, or t
  misc_feature (47)..(49): n is a, c, g, or t
  misc_feature (51)..(51): n is a, c, g, or t
  misc_feature (100)..(100): n is a, c, g, or t
  misc_feature (104)..(105): n is a, c, g, or t
  misc_feature (108)..(108): n is a, c, g, or t
  misc_feature (123)..(124): n is a, c, g, or t
  misc_feature (129)..(131): n is a, c, g, or t
  misc_feature (159)..(159): n is a, c, g, or t
  misc_feature (207)..(207): n is a, c, g, or t
  misc_feature (219)..(219): n is a, c, g, or t
  misc_feature (239)..(239): n is a, c, g, or t
atcaatagcaaacccactgccatattagtnattctgaatatactaannncntccagctagattgcagtttaataattaaactgtacatactgtgcatatnatgnnttnccatcttatgtaaannatttnnngaacacaagttgggaaatgtggcttctnttcatttcgtttaattaaagctacctcctaaactatagtggctgccantagcagactgtnaaattgtggtttatatactnc

SEQ ID NO: 664435 - DNA, 1227 bp, Homo sapiens
  misc_feature (207)..(207): n is a, c, g, or t
  misc_feature (337)..(337): n is a, c, g, or t
  misc_feature (357)..(357): n is a, c, g, or t
  misc_feature (366)..(366): n is a, c, g, or t
  misc_feature (379)..(379): n is a, c, g, or t
  misc_feature (593)..(593): n is a, c, g, or t
  misc_feature (895)..(895): n is a, c, g, or t
taggatttgaccgagtctttatcggggctcccgttacttcttattctaactccaggtttacggacacaagtgcgtggaaaaccaatttccgtgcccttacccaccgccttcaactttgtttaagaaaaaaacgaggattctaacaccggaggaagtgttcacattctttcggccattctcccacttctccttttcgtgcccttaggncattctcgatttgtgtgtgcccacccgagggggccccactcagagagcacttgagaggctctctgtgtgccacccaagtggacagagcaagacacagagcgtgtgtgtgaaacgctctcaagagagtgtnccctctctcttaatacgagncctctctcnctcttccgagagngtgtcttctctgtgtggccccgaccgagagcgtggcgaaaagccgagactctcgcgcgagaggggggcctctcgaaaaactctcccgcggcgcgcgcccagaaagagtctctcttatatctctcgacgaggcgaggcgcgaccccccggggcccccctgtggagagagcccctgttcaagcgccaaactctttcgccgcgagataaaacgcgcnacaagagagaggcctcttctggggcccccccctgaagagagggcgtgcgcacaaaagcacggcgctctcctcgggagagaacaatgcggcgcgcggagagaggcgcgggaggtatcatcaggacaccccgccggggggagagaagacccttctgtgcgagagagagaccccttgtgaggaaccctcctgtgcagcggcgcggggtgtctccagaggggggccccctgataatagcctcttgttgcgcccgagggggttgcggcctctctataacagggagctttgtgttgcgccttatactnaatccccccgggggtggggggcccagagggggtaattctccccgggatttgtcccccccctattccccaagaacctcttgggcgcctctaaaacgagagagaggtactattctcttcttcggaagcccaagagaagggggcgagaccccccaaaagagaacccgcgaaagagaaatacgggggtgtgtgccgccccatttgtgggcgcccggaccccaagaacctcccggtgagagccccatcaaaaggactttccacttcaaaaacggccaccctcttcttttaaacgcgggagacgcccgtagggcacctctctcctcaaaaaaaacccg

SEQ ID NO: 664436 - DNA, 776 bp, Homo sapiens
  misc_feature (74)..(74): n is a, c, g, or t
  misc_feature (335)..(336): n is a, c, g, or t
  misc_feature (338)..(339): n is a, c, g, or t
  misc_feature (345)..(345): n is a, c, g, or t
  misc_feature (398)..(398): n is a, c, g, or t
  misc_feature (405)..(407): n is a, c, g, or t
  misc_feature (493)..(494): n is a, c, g, or t
  misc_feature (496)..(496): n is a, c, g, or t
  misc_feature (659)..(659): n is a, c, g, or t
  misc_feature (672)..(672): n is a, c, g, or t
  misc_feature (676)..(677): n is a, c, g, or t
  misc_feature (753)..(753): n is a, c, g, or t
atttactttttctaccgagcgcgccatgtgttggtacacggaattccgggcatttatggcccggggccctttcnttcccgaatccgcgggcatatgggcccaatcaaccccccgaaaagggcctccacaagggttttacctataatagagaagaaggcccccccaattggggggaagaggcacccctcgcccacgcggggggggggggttttttttaacaccgggggccaagaaggggccccccctctctctacaaagcagcgggggggtggccccaaaaaaaaaataaaagggggggtgtggaaaaacacaaatctttgttggagggcggcccnnannaataanttaaaaatatttatttttttttgggggggggggggcggcgccgctcttttttntttttgnnncaccccccctcataataaaaaaaaaagaaaaacccgggggcgttgcctccccctcctggggaagaaaaaaaaaaaaaaaaaaaagnncnccgcggcccccccccccccctttataaaataaaaaacaaacacccccccccccccccctcttttttttaataaaaaaaaaaaaagacccccccccccccccccctcaaaaaaaaaaaaaaaaaataccccccgccccccccccggggggagcaattttatttntctcccctccccncccnntttctttttttttttataataaaaaaaaaaaaaaaaaaaaaaaaaaaaaaaaacccccgcgccgcgcccccccccncataataaaaaaaaataaaaaaa

SEQ ID NO: 664437 - DNA, 327 bp, Homo sapiens
ttttcccccccccccccccggccaccaaatggtttttttttttgggggcagccccccccccccaggttttcagggctcccccaaagttttcccctttttttttccccaacaatggaattttttaaagccccccaaacaaaccccttaggcctcccggcccccgggtgggggaatttccccctttgtttttttggaaaacctttttccaaaaggcttcccccccaaggccagaagggaagtccccccctcccgggtggcggatggggccgtgggcaagggcccctcccaaacccccccattttaaccccccttttttttttggggtta

SEQ ID NO: 664438 - DNA, 419 bp, Homo sapiens
cggagcacaaagacggtttttttttaactaagaaataccataaccccgggtgggggtgtatgcgatgttagaaatacccgcccagtctgagcgagatggcaatacccttgctactctagaaaatagataaaacctcgtcgagcgagcaggtgcctactagcttctcaaagagtaaggaggaatatgaaggaaaacctgttgagacctataggtggaggatgaaaagcgactggaccaggtgattgctgtttgcccaggatggaatcttattacacctttcaatttgcccacagaacgccgtaaataactcttgtaaagtgcacctgtagtccaacggggtacagttctgtgaactctaggataaaacccttgttagagagtattcttcagccctattaggcccgcagacccactttccc

SEQ ID NO: 664439 - DNA, 213 bp, Homo sapiens
  misc_feature (205)..(205): n is a, c, g, or t
cagaggaccagatcttcaggtttctgcgatgcagcccagacagtgctggactgacagagactggggtggaggcggctgagcctcgccatctctgtgtgccgcacctgttggtctattgaaggtgcagcagccctttcctcttcgtgccctgggaccagcagcacaagttcccttgtcttcatggggcgagtatatgaccccaggncctgatga

SEQ ID NO: 664440 - DNA, 455 bp, Homo sapiens
aatcaacttaagtgaagtagctaaccttacctaccatattatcgatacataagcagagcgcattgaatgcatgcttcttgagctccgcacagttcaaggcacactatgacttcatgtgggttcaatgtgagcttctctaccactgttgacgcatactgcattcaagatgtactcatatgaacttcaatcatttcattggagcggacaggtgaaaatattgagtatgaccatttacaccacactgggagacaacgtggtaacacctattcatgctctgaccagttgattgttatgtagtgaccgtaccatatgattcaccctcttaacatataccactcattggcagttaatatgctggtgtgagaccataaccacggtttggggagaccgttttaatgaaccataacgaaatactgtacccgttatatgaaaaccgcactcagcattcatctccc

SEQ ID NO: 664441 - DNA, 329 bp, Homo sapiens
  misc_feature (268)..(268): n is a, c, g, or t
caatggtttagagatccttgaatgcaaatacagggtggcagtaactgaggtgattgatctgaaagctgaaattaagggccttaagggagaaatataattaaatctgtggaaactacactgatgagagggccaggtatgagagtaaaatccagatgtatgatgagcaggtgacagagccttagagaggaccaccacgggagagtggtagagaagatggcccacatgggagaggggagtcgcaaaagatgaccagcatagccagcgaaantcacagtaaccttaatacggcccaggatgagttgagtcacattcagtgaggagttagctca

SEQ ID NO: 664442 - DNA, 768 bp, Homo sapiens
aacaacttaggacggtgggatcctcttttcgctggtcttctaatcttcagctgtcatcttcgagaaatggtaggcggccaagtgataacgtttctgccataggcatactaactgggttcgaatacatttatgatacgccataactgtgctcacagtgccaccatgtcaatggcactccctgacgctgggttgtggtctctctccaatgtacaagacggaaaagcatacatcaccgcatacggaagacacgtttcttcagcgcttgactttactgactttgacatacttccaaacaagtgtcatgagtacttcgaagttagctgactcagcatttctggtgtccttggtgggttgagcgccaagtgtcaatattcagcgacaaacaagttggcgttggagcgtgtttagttatagatagtgtacagtggtgagctttccgtaacaaacgttgtattctacagagtgggctcttgtatcgttgtctgagagaaaagcctttgtagcttaacatgggcgctaggactgtccaaggtgtgagaagcagcgaattaccctcatgtgaggtgactaagaggtgttgttgttttcgccttagaccagttgtcgtgttgtgaactgttgcgagtctcaacatttagacaggttaaacttcactgcttgcttggggggcagagaactgtttggatgcttcgaggacaacatttttttatcccgcttcccatttttcctaataaatcctcccccttaaatttctctaccaagggcagg

SEQ ID NO: 664443 - DNA, 369 bp, Homo sapiens
cccgcagagagagagaatatacccaccaggacaagatcctgcatggaagcatagcagcaactattcgtccgcaggagcgtttaacaacgtacacgcgtccgctcttaacagggcagaagaacttccagacctccgaccagagcagcgagatgtgtacaccctaactgcacgcatgtcgctggctagtgagggcacagactcactcacacatgcgtgcatatgcacacacacagactcagacctccttacagcaggcatagagctacatcccagtgtcttgtccactaactatagggctccaaagctaagggagcgacgcagcagagacgggaaagatctaactgacggaaaaagctcctcctcgcccca

SEQ ID NO: 664444 - DNA, 352 bp, Homo sapiens
agagagagagagatgagagagagagagagagagagagagaggtaacatagctctaattattaaattacttttgcagcagagtaccatatctgtttcatatctgcagagatctgttttcaatgcagttttattctacttcttattctgatttaagatgggatgatagttttgacaaaattgaacttattttaatttctgtgtctgattttttcatttactgtaggagctgttggtggtgatgacttgaatttttttttttaatggggaaaaaaaacctcatgagcatctgctatgactctagaatgttagtcactgaagcaaattagtgtagttgtagatgttgcaagtaata

SEQ ID NO: 664445 - DNA, 201 bp, Homo sapiens
ccagggttttccccggggccctttttgggggccccccccccttttaaaaaatcccttgggggggggacccggggaattttaaaacccccccggttttttttcgggtttttggggggggggggggggggggggccccaaattaacattttttggggtcccccgggtttaattttttttttttttaaaatttttaccccccca

SEQ ID NO: 664446 - DNA, 360 bp, Homo sapiens
cgagggttcaaagtcctgtatgctgatcaagtgggcgcggtaatttacacgctagctccagatgatacggactgatacttgacgatttggctacaaggcagtgattgtaattttgaccgcttccccctatcatgggcggtagattacctattgcaaaggaacttttatgtcagataattggccacccgatcccaaccaaacctcacaggcaaagccacctgttcatccagataattcggaaaacttggcagccaatacgccatacgcagggcaagaatgggcacttgctagaaaaaaccctcattggcagccttggtggagcagcgcggtgcaagacgccttgggtataccctttaagct

SEQ ID NO: 664447 - DNA, 447 bp, Homo sapiens
aatcttccttgtaagtagacgcgtctcgatataacaaggttgctaagattaacaggaagaacagatctatccgtgacatgatgaatagaaggacgtagaacgatatacaaatggggttcagtattatctgtggtttcagacaactaccggaggtcttggaatgtatccctcaaggatgggggtgagtactctattatcataaacaggaaatgagggagcccaagagatgctgtgctgagggacacacacttggacggaaacaaactggggaaaaaatcctcctggtactgaacagcttaggctagtcttccttcaaattgagctcacctcacacaactgtcacttacacatgtatggggagcaatcacattatcctaaagcctcatttaaatctaccattctcacttaattctctgagtttcttaccagccttctctgaggagagag

SEQ ID NO: 664448 - DNA, 202 bp, Homo sapiens
atagacggtgcctcagcctgccgagccgcagtttccgtggtgtgagtgagtccgggcccgtgtccctcttgctgccgccatggctgcacgttgagcgccgaagacaaggcggcagttgagcgaagaagtatgatcgccccgcacttatgggaggacggggaaaaagcggccaaagaagttaagctgctgctactcgctcctg

SEQ ID NO: 664449 - DNA, 111 bp, Homo sapiens
tctccagcagttgtttcaagcctcatgcctcagcagtccacttcgggaggtgggggcactccacactggggggccctgcagctccagggctggtgctctagcagtatccgc

SEQ ID NO: 664450 - DNA, 114 bp, Homo sapiens
tgtgagcagcacccacaacccggaggtgagcatctgacctcccggaggcagtaccagtacccccaggcgagcatctgaactcatggagcagcacccacgcccccaggtgagcat

SEQ ID NO: 664451 - DNA, 132 bp, Homo sapiens
accatgacccaagcatgcatgcatgcctgtatgttgacgtgtattcaccaatgctgtgcatgcctccctgtacaagttccgtcagacacgtgagcaccgagctgacctacaaatatcgttaagctggagcct

SEQ ID NO: 664452 - DNA, 170 bp, Homo sapiens
actttctgtacggtacgggcacgcagataccaggtggcctcccctttctccgcgcctgagggtaactgaaataggacaaccgaatcaggaacgaaccccaggactgcagccatccaggttttgcgattatgtttactcacaaaacaaagctcatcatgcgtttgaaaaaa

SEQ ID NO: 664453 - DNA, 253 bp, Homo sapiens
catcatgggatcctgtttgttgctctcagcctattatgcactggttttcctttctgattctgggcaggccacgtgtcctctctgggcctgagtttcttcactataaagtgtaagtgctgatctggattatcactgaggttcctttaatctcttgaaagtctatagggtctctgataatttacgagaaagtcttcctttgcttatctcaaatccagggaccgcattatgttccagaaccccttttattgggttc

SEQ ID NO: 664454 - DNA, 442 bp, Homo sapiens
ttaagggcctactagatactgggtctgatgtttctattatttcctctaatttatggccttcctcctggcgtaaacatccaactaacatataactagcagggattggaaaagctgatgaagttcaccagagcacatttatcttgccttgcactggccctgagggtcaaaagggtaaaattcagccttatatcatgccaatctccactaatatttggggtagagatttgctgacacagtggggggctgaaattaatattccacataactcttacagtgctcccagtcaaaatataatggaaaacatggggtttgttcccggactcggtctcagtccaagacatgaaggaattactaaacctcttcaagttactgtagaagagggctggtttaggtcatccttttcaatgacagccactgctatgcctccctacaatgaaaatct

SEQ ID NO: 664455 - DNA, 119 bp, Homo sapiens
gtcagtcgctgtctatctaacagcatactgatcacacttcgtatagtatctcggactatgctattgtccatatcacagggatgatagcattaaggactcgtggatgcgtacgagctcga

SEQ ID NO: 664456 - DNA, 608 bp, Homo sapiens
atcgagggcctgctcagaatgatctgccaccgtcggctcccaaagtgctgttattacaagcagtgagccactgcaaccagatcagtcgtttctatatctgatacagtatctgtcataggaccataacatttactaaataaatggaaaatactgtttactgaagtgtctttcctttataactgataccctgcagaacccctaagtattatttagcattacataaggttgctctttataaaatatttactgaaagagtaaggactcaagtaggtcaagtggcgacagttttatgtgtagcatatggcagtgccattaactgaatgacctgtcttgaatcgacagagcatctgtctttattcccattgctgccataccagatgaagaacaaagcacatcacagattgagaatatttttatttttaattcaaaaataaaagccagagaggcaacttaccatgttatcccaactttgacttcttatagcatactctttactgtactgtgctctgtgttgtgtaacaataattgatttgacggccatttgcattcactttgaaatgtcaaatgtaaacaaaatttacgtgtaatacttatactatattgtaaat

SEQ ID NO: 664457 - DNA, 305 bp, Homo sapiens
tgctggggttacaggcgtgagccaccgcgcccagcctagactatggattttattcaccaggcagtggggagcccttaacggtcttagagcagagagaagttctaggaaaattaacgtgctcctacgtatgtagaattgattagagtagaagaggctaaggagaaaaacgatttcttccgtttttttttttttgggcgacagcttctggtggtggcccgggggggggtgcgggggtccacccgcggcccagggcggcctcaacactcaggggcggaggaattcttccaacctcgagttccgtgtga

SEQ ID NO: 664458 - DNA, 112 bp, Homo sapiens
cagtatggtttcctaataaaaagttttcaccaaaatgtagtccaaatgcaatgttaattgtatccattgtgtaatacaaatacaaaatacaatgttcccttttgttcttata

SEQ ID NO: 664459 - DNA, 303 bp, Homo sapiens
gctcgtaccctcacacgcacttgtgaggtggaggtagaggcgggcggatcacaaggtcaggagattgagaccttcctagctgttgaaaccccatctctactaaaaatacaaaaaattagccaggcgtggtagcacgcgcctgtagtcccagctactcgggaagctgaggcaggagaatggtgtgaaccggagaggcagagctcgcagtgagctgagattatacccatgcacttcagcctgggtgaatgagcgagactccatctcacaaaaaaagtaaacaaagactcttagctggctaattcg

SEQ ID NO: 664460 - DNA, 448 bp, Homo sapiens
aaattcgcggccgcgtcgactgaatactccaaacttgttcttgcgttagtcggtgaatggatcagtgtgctttctttcagtattgttttattataggtgccgccaataaatgatttgtcaaatacataaattagattgaactttgcttcctggccttcaccaatgtcctaggcagtcctggagttgaccctgggcttggaatttcgtaagaatgttactcatttagaggaaatgccccaatgttgacagtaatcgggcatctcacagtttgctggataggagctagtaatctcagggctaattctaaatagtaaactcagaattctcattctagtcaggtatggcagactacattgcatattagaagaaagttggtgagttcttctgacaaatggagattccctacagacacttaaaaagagcagtcaagtcactcccagacacagga

SEQ ID NO: 664461 - DNA, 368 bp, Homo sapiens
aggagagagagagagaccagcctgaccaacatggagaaaccctgtctttactaaaaatgtaaaattagccaggcatggtggcacatgcatgtaattccagctacttgggaggctgaggtaggagaatcgtttgaacccggaggcggaggttgcggtgagccgagatcgcaccattgcactctagcctgggcaatgagagcaaaactctgcctcagaaaaaaaaaaaatcagtgtttaattctgggatctgagcaaagttatgcctcttccctggaggtgaacacgttacagcgtttagtattattattcgccgtgggcaaggggtcttcacaacacattattttacctggcgaatatgttcaaatgtt

SEQ ID NO: 664462 - DNA, 362 bp, Homo sapiens
tttttttttgagacggagtcgctctctgtcacccaggctggagtgcagtggtacaatctcggctcactgcagccgccacctcctgggttcaagcaattctcctgcctcagcctcccaagtagctaggattacaggcgcccatcatcatgcccagctactttttgtatttttagtagagacagggtttcaccatgttggccaggctggtcttgacctgacctcaagtgatccgcccacctcggcctcccaaattgctgggattacaggcgtgacgaccgcgcccagcctatttatatattttttagagcaaacccgtggcctgcaggccccaggacggctttgaatgaggccaacacaaattg

SEQ ID NO: 664463 - DNA, 271 bp, Homo sapiens
  misc_feature (124)..(124): n is a, c, g, or t
aaagcatggccacgcatggtggctcacacctgtaaaaccagcactttgggaggccaaagcagggcagatcacccaatgtcaagagtttgagaccagcctggccaacatggtgaaaccccgtctntactatacaaatattagctggacgtggcggtgtgcgcctgtagtcccagctactcaggaggctgagtttttattttttatagagataggagtctcactgtgttgccctggctgccctcctcctgggctcaagagtctcgtgcccgtt

SEQ ID NO: 664464 - DNA, 666 bp, Homo sapiens
ccgctgggtccccttccacactgtggaagctttgttcttttgctctttgcaataaatcttgctactgctcaatcttagggatacatgcgtggtggtatgagctgtaacactcaccaggaagcgcactgcagcttcattcctagaagccatgggagaccagtgagcccgcacgggaggaacggaacaacatccagatgtgcgcggccttaagagctagtaacactcaccggcgagaaggtctggcagcttcactcctgtagccagcgagaccacgaacccacgcagaagggaagaaactcgcgaacaacatccaaacagtcagaaggaaccaaactccgggacgcaccaccttaagacgctgtaacacgtcgagtcgcaaggagtccgcatgttgtccatgtcttgaagatcagtgagaccaagaaccctatcaatttcctggacactatttttggcgagccagatggggaacatattcgcctattcaccaagcggtgaagaaccatcacctatagctgagcggcgaagaccatcgacctatcaccaagcaaatcgaaggccatcaagctacagatgggcttacaaatggaacccaaaatgagttcaactaacaacttctaccaagggcccctggaccgacccaactggcacttcccctggcctaga

SEQ ID NO: 664465 - DNA, 1271 bp, Homo sapiens
  misc_feature (398)..(399): n is a, c, g, or t
  misc_feature (1224)..(1224): n is a, c, g, or t
atagtctttaatacacaatcagcaaagcttacaatccactcaagagacttactattttgtcactgttgaaaatgggctaaatgatgtaaattgaatgtggctgtcaactaaaacaaaattcagtatagaattagtattcatccagtcatggacatacctgtagcatagttttctcttgagacataataggccgtttcctactgtaaaaacttacagccagcttcatacaataaagtaaattttttcctgtgttttggcaggctcccgtcatacatgtgtattggtggtgctgttaccaaaatgatcattgttactatggtggcatacagcttcatggagcagaaagtttctacttggtatttaattaataaaatgttgaggaatggctgaaacagttnntaatgaagtatttttacattgctggtattgtgttttcagcatattggtagtttataatacagacttcttgttgtcaaagatcttcccgcttaaaaattatattccttttctcacgtgtttattagagaagaacaaatgataaaaattagcattttaatgatatatttatgtgtagaaatagggggagaaaaaaaggccaactgaggtaatctaggtgaaaaagtttgttttcagtttagctacatggtttaaccagaattagaagaagaacttcatttccaaccaaagaacaggccgcacagccaccattttggggtcttgagcagagagagaaaacaaataggtggtttgtgagaactctgaattatgtagaaaaccagcttttctacataataaataagctttgccttatttattaaagttaggatttctttgcagttcttaaatgtacatttaaattatatcaagttgactttagaagaaaaaaattataagcagcctacctctatcatgtatctttgttgttaaccagagtttttaaaatggaaaaaaatttctgtaatttatttttggttctatgagattataattaaaccccaaattatatatttaaaaaacaaaaaccaaaagatttttagtcattattatagtaactgaaattaagtagagttacttttttttaaaattatttttaaaaataattactactttggaaataaattggctgggcatggtggctcacacctgtaatcccagcactttgggaggctgagatgggaggatcacttgagccttgcaggtcaaggatgcggtgagctgtgaccntgctactgcaccccagcctgggtggcagagcgagaccctgtctcaca

SEQ ID NO: 664466 - DNA, 221 bp, Homo sapiens
ttgcttaccaaaagtaaacccaggtcctggaccagatgcaggggaggtacatatccatgagtgaagaccagtgtcttcctcacatgggtgggtcacacaattgtgacctcagttttagggccaagatctgtgttggtttcttagaatgatagacttttcctccaggggaccacagcaggtgaagctcaagagcgcatggatctgctgtggtcccctggaga

SEQ ID NO: 664467 - DNA, 409 bp, Homo sapiens
  misc_feature (142)..(142): n is a, c, g, or t
  misc_feature (189)..(189): n is a, c, g, or t
  misc_feature (295)..(295): n is a, c, g, or t
cccttcgacgtcgcggcggagatccccgccctcacggcggaactcggcgggcgggcgggcgccgtcgtcagcttcaccggcctgtcccgcgacgaggacgggcgcgtgcccgccctcgagctcgagcattatcccggcatgnccgagcccgagattggcctcgtgctcgacgagcccgcccggcgctgnccgctccagggcgcggtggcgatccaccgccacggcctggtgcggccgggcgagggcatcgtgctggtgctcgccgcctccgcccaccgcaccgccgccttcgagnccgcgagcttcctgatggactacctcaagacccgcgcgccgttctggaagcgcgagcaccgggccgacggcaccctgggcggctgggtcgaggcgatggagcacgacgcggccg

SEQ ID NO: 664468 - DNA, 641 bp, Homo sapiens
  misc_feature (1)..(1): n is a, c, g, or t
  misc_feature (235)..(235): n is a, c, g, or t
  misc_feature (238)..(238): n is a, c, g, or t
  misc_feature (243)..(245): n is a, c, g, or t
  misc_feature (247)..(247): n is a, c, g, or t
  misc_feature (249)..(251): n is a, c, g, or t
  misc_feature (264)..(264): n is a, c, g, or t
  misc_feature (598)..(598): n is a, c, g, or t
  misc_feature (623)..(623): n is a, c, g, or t
ncctggccggatcagtcttttattatcagttgtcaaatatctttctaaatggttgtagaaatgtatgtcattcattttaatattagggaagggtgagcaaaatattacataaatattaaaaatattaataaaaatcaaattatctgaatagttattaaaaaacaaatttttatttgtattaatattttccatggcggtcgtaaatagagaatgggctgctagccatttaagtgantgntaacnnntntnnnatctaatttattnccagtttgccttcaaagttgttagaaactgcttttgactgtattgagacctttctaaattgtctttcatagatcagacacccttcactgggggggttgcccattaagtctttggaagagattaaaagtcttttccagagatggtctgtccgaagatcaagttctccatcgcttaacagtgggaaagagccatcttctggagttccaaacgcctttgtgagcagactccctctctttagtcgaatgaaaccagcttcacctgtggaggaagaggtctcccaggtgtgtgagagcccccagtgctccagtagctcagcttgctgctttactccacnctgctttataaaaactgaaatgtanatttctctttctatggca

SEQ ID NO: 664469 - DNA, 406 bp, Homo sapiens
  misc_feature (63)..(63): n is a, c, g, or t
  misc_feature (105)..(105): n is a, c, g, or t
  misc_feature (113)..(113): n is a, c, g, or t
tctgcggggggcctgtcccatctcagatctgctctgtgggccaggcatggtgtctcacgctgntcatccaggcactttgggccgggcgcggtgggtcacgctgtngatccagncactttgggaggccgaggcgagcggaccataaggtcaggagatccagaccatcctggccagcatggtgaaaccccttctctactaagagtgcagaattggctgggtgtgttggtgcatgcctgtggtcccagctgcttgggaggctgaggcaggagaatcgcttgaaccttcaaccgggaaggtggaggttgcagtgagccgggattgcgccattgcactccagccggggcaacgagcgaaactgcgtctcaaaaacaaaaacaaacaaaacaaaacaaaacaaaaaactctg

SEQ ID NO: 664470 - DNA, 616 bp, Homo sapiens
  misc_feature (573)..(573): n is a, c, g, or t
  misc_feature (598)..(598): n is a, c, g, or t
ctggccgatctgtttttattttttggggaaaactttttcatttattgagcatttctgaatgagaaaatttttccatccaattaattggccttccatgattaatgtgaatttctcagtttagtcactgatagaagttaagatttaagagaaaccagggtacaaataagaaaaagttctatgaaaatagaaattcaaatccacattatgatattgataactcttcttgatgaagctactttgcttactggtccatttaaaagaaaattcaaagtaacaaacttgtagaatctttctaaattgtctttcatagatcagacacccttcactgggggggttgcccattaagtctttggaagagattaaaagtcttttccagagatggtctgtccgaagatcaagttctccatcgcttaacagtgggaaagagccatcttctggagttccaaacgcctttgtgagcagactccctctctttagtcgaatgaaaccagcttcacctgtggaggaagaggtctcccaggtgtgtgagagcccccagtgctccagtagctcagcttgctgctttactccacnctgctttataaaaactgaaatgtanatttctctttctatggca

SEQ ID NO: 664471 - DNA, 432 bp, Homo sapiens
gttttttttttacccagggctctggaaggacaccaaactgttttgcttgttaccttccctccgttttctcctcgcctttcacagtcccctcctgcctggtcctgtccagccaggtttaccacccaccccacccctttttttcgggtccctgcccctccagattgcctggtgatatattttgtttccctttgtgtttccttttcaggtttgagggtctttctttgcaggtttctgaagacggaagatctccgttccgctcccagcgggtgcagtgtaaattccccttccccctggggaaaagcactaccctgttttggggggtttaggggtgtttttgtttttcaggtgttttggttttttgttttttttttttcctttgccttttttcccttttatttggagggaatgggaggaaaaaaaacacaaaaaaaa

SEQ ID NO: 664472 - DNA, 379 bp, Homo sapiens
agagcccccagctgcaggacagttcataatgggcctttgggaaataagccctcaaatcatcttgctgggagctcttttactctaggaagtggagaaggagccagtgaagtgcctcattccagacaggctgctttcagtagccccattgtaagtatgaatgcatgactagagtcttgcacatccacaatgtatgatgagagagcagccttgtaattatgatagagtcaaactctgttgtcttttctaccttagaagagactacatgattgcagctcagcaagatcaccacacataattagaagtataaacaaacaatatcacactagtcgacttttaaaaaataactcaatgttgagaggtagtatgccatttgtggaaa

SEQ ID NO: 664473 - DNA, 301 bp, Homo sapiens
  misc_feature (80)..(80): n is a, c, g, or t
gctcgacggcagaaggccagcagcgtcggtgcaaatcgggtttcagacgttgtttgatcacgctccgttgctgcatatcncgctcggtccacagggcaaacacatcgacggcgaactgggtgacgttgcccgtcatcagcgtggtcggcggggtgcctttcatatgctggcgggaaatggcgctctgaatcgccatggcgtgaccccggtcatgccggtgatcagcgccgtcgtgctgtcgccgtcgataaaggggccccagaaaatcgccaggaaagcgaaggcggccagtatcagggta

SEQ ID NO: 664474 - DNA, 1121 bp, Homo sapiens
agagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccaggcttttagacaattagtcagattacacctcggctctttatgccactagatgagaccatccaaaatccaccaatggaaactttgtacattatcgactttttcattgcattggcaatttgcaacacagtagtggtttctgctcctaaccaaccccgacaaaagatcagacacccttcactgggggggttgcccattaagtctttggaagagattaaaagtcttttccagagatggtctgtccgaagatcaagttctccatcgcttaacagtgggaaagagccatcttctggagttccaaacgcctttgtgagcagactccctctctttagtcgaatgaaaccagcttcacctgtggaggaagaggtctcccaggtgtgtgagagcccccagtgctccagtagctcagcttgctgcacagaaacagagaaacaacacggtgatgcaggcctcctgaatggcaaggcagagtccctccctggacagccattggcctgcaacctgtgttatgaggccgagagcccagacgaagcggccttagtgtatgccgccagggcttaccaatgcactttacggtctcggacaccagagcaggtcatggtggactttgctgctttgggaccattaacatttcaactcctacacatcctgccctttgactcagtaagaaaaagaatgtctgttgtggtccgacaccctctttccaatcaagttgtggtgtatacgaaaggcgctgattctgtgatcatggagttactgtcggtggcttccccaggtaagtttatacaaaagtgaaatagtagtgatttgaaaagctcggagattaaaagaccatacttgatggctttataaaggcaaagaaacagctatttggggactaatcacatttggtgaagtagggggaagctgcctaggatttgatgggaaagcaagtaagttttggggctaccca

SEQ ID NO: 664475 - DNA, 128 bp, Homo sapiens
tagactaacatttcgtgtagtgagttgtcggtctacctgggttaggtctacctggaggtctacctgggttaggtctacctggaggtctacctgggttaggtctacctggaggtctacctgggttaggt

SEQ ID NO: 664476 - DNA, 1083 bp, Homo sapiens
agagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccaggcttttagacaattagtcagattacacctcggctctttatgccactagatgagaccatccaaaatccaccaatggaaactttgtacattatcgactttttcattgcattggcaatttgcaacacagtagtggtttctgctcctaaccaaccccgacaaaagatcagacacccttcactgggggggttgcccattaagtctttggaagagattaaaagtcttttccagagatggtctgtccgaagatcaagttctccatcgcttaacagtgggaaagagccatcttctggagttccaaacgcctttgtgagcagactccctctctttagtcgaatgaaaccagcttcacctgtggaggaagaggtctcccaggtgtgtgagagcccccagtgctccagtagctcagcttgctgcacagaaacagagaaacaacacggtgatgcaggcctcctgaatggcaaggcagagtccctccctggacagccattggcctgcaacctgtgttatgaggccgagagcccagacgaagcggccttagtgtatgccgccagggcttaccaatgcactttacggtctcggacaccagagcaggtcatggtggactttgctgctttgggaccattaacatttcaactcctacacatcctgccctttgactcagtaagaaaaagaatgtctgttgtggtccgacaccctctttccaatcaagttgtggtgtatacgaaaggcgctgattctgtgatcatggagttactgtcggtggcttccccagattgagcaagtctggagaaacaacagatgatagtaagggagaaaacccagaagcacttggatgactatgccaaacaaggccttcgtactttatgtatagcaaagaaggtcatgagtgacactgatctataggagtggtg

SEQ ID NO: 664477 - DNA, 690 bp, Homo sapiens
gcgctcggagcctacgctgcccatgctgctacctgaaacccagagtcctgctgccctggatgtccccgctgcccctggagccctgatgcaccctgggaagtccctgatgcctcgctgcccctgtgatgtgccctgagcctgctgcctgcctgcaccctggatacccctgctgtcccctgctgatgcttgcctgatgtgcctgccctgcctgcctgcccctgctggacatgtacctgccttcctccccgtctgtcctgctgcacatggcctgccccctgaccttgtttccaccaacctccatgtgatgtgatgtgcacacctgctgctcatcttgcctctgacttacttcactggatcctgtgtgattgacctgacttgctggccacaactttcttgcctgctgatgttgcatcctgtgctgcttgctttgtggtgccatgccctgatggtgccctgtactgctgttgcccctgatgttgcctgctgatgcttgtcccctgcagatgtgaaccttgctggcccaacctgccctgcttgcttaatgacttgtgcctgatgactggctgctggctgccttgcaacccctgcctggtctgccggtgtccactggcatgggtcctgttgttgccacctgctgcacctgctgatgccaccttggccctggccttcttgtgtgcgactgatgcttgc

SEQ ID NO: 664478 - DNA, 210 bp, Homo sapiens
tgcatgaagttatcttcttcggtgaccactatccgagacccaaccctgcatgcccagttccagtgattactcggaacctacagagggtgacaaaggagcttctgggaaaaggtgagagaaggaatagcggaaagtggaagaggaaatcgttgaagcgttagtactagaagctgaggaagagggaggttctcccatggaccacagggctgc

SEQ ID NO: 664479 - DNA, 192 bp, Homo sapiens
gagccacaccggagatgctgggtgagatgggagggacagactggggagcaggaagcagatccagagccaaagcactgcgaaataacagcagaagccccaggccatcaatgcgcatgggagctcatcacatgcacacacacacacagacatgtacacactcaagcatgtgcacacacaattgattgcaccagg

SEQ ID NO: 664480 - DNA, 492 bp, Homo sapiens
gtgatttgtttgctttattgatgaggcctgccgtatttctaagatgtttctgtgtcatctccaagacaatattcagaatgaatctccaatatatgtgtacgttctttttgtactaatttgtgccttttgtaaaatttgagagttcatttactcatgtttaaaatgtaaggaaggctgtatagagcttctatattacagtagagtctgacttttaaatataaaagcaaataattttctgtctgtattctgtctctttctcagttgccacaactgagtgtctgtacctctcttatctgctagggatacattccaagatgaccagtggattcctgaaaccggtgatagtactgaaccttctgtacactgtgttttttcctatacactacgtacctatgataaagcttaattcataaagcttaatttaaaatttattaaagattaatttaaaattaagcacagcaagggattaacaactgttaataaaatagaaca

SEQ ID NO: 664481 - DNA, 210 bp, Homo sapiens
  misc_feature (8)..(8): n is a, c, g, or t
  misc_feature (26)..(26): n is a, c, g, or t
ccaggggnacaaggcagggtcagagnttgaggtaagtttcagagcaagagtgaaagtttattaaaaaagtgttagagcaggaacgaaaggaaataaagtacacttggaggagggccaggtgggcatcttgagagagcaagtacacggttttgacctttgacttggggtttatatcttggcatgcttctgggggctgcgtcccttctcccc

SEQ ID NO: 664482 - DNA, 365 bp, Homo sapiens
cctggcttatgagagtgatctctgatactgctcacagtcttccaattcattcaaaaatggctcttctccaacacctaacttctttaaaggaaactggacaaaaacagatgaagaaaaacttcagtgcacctaggctcttgaaacagacctttttttagactttcgttttccttttaaagttaaatctgcagtatacacaaccttagaaagaatattcattcagccatttaacagtttttttacaaaaatgccctccccttgcctaaatttgcttgtgcttaattcctgctgtacccttgctcctgttctttgatgttcagcatcagttatttgcacagtgcaaccatttaaatctaggcatcacc

SEQ ID NO: 664483 - DNA, 262 bp, Homo sapiens
acttagaaagccgtgtttactttttggatattgaggcctcttcaagtttcaggtttgaacacgtgggttgtgggcggtgcggctagactctggttcactggcaagaactgggtgtgtctagtacagaggagtgatataagagtaatttaagtttaagtgctcccaacatgaacattatccccgtagcatcaggttaaattctagggtttgcaagggcccaagcagacatttgcacaagagaactttgggcctttgttcaaat

SEQ ID NO: 664484 - DNA, 127 bp, Homo sapiens
atcttcttcttacgtagctccgtacgactgtctcgggcttttaccattgctgctatcgattatggttgaaggggcatacaaatttctggtgtgttcttcgtaccggaactcgattgaggaccagagt

SEQ ID NO: 664485 - DNA, 902 bp, Homo sapiens
  misc_feature (902)..(902): n is a, c, g, or t
ctgacgctattcgcgctcgtgtgcaggcccggctctggctcctggtcccgtgtgcgagggttaactgctgatggccccggcctcgtgtccccgtgactagtgcctgtgaccccgggtgccatgaatgcatgtgatgtggctcgtggctggctgcctgcagtgctgctggacaatggctgaaacctgcctgcccgggctggagtgagaacaagaacccccacctgctgccgggccccccaaggattgttggatgattgaaatgatgtgatgtgcaagctgactgggtggcagggtcaactgtgggtgatgggcatgactggcaagaacggcgtgctgagcgagcgcgggctttgagagcacatacccaagacggaggatgccttgagaacatcgatggtcacgccttttgtgaagtgacaattcaaggtgatgcaccgttgaaaaccatgctaagagaaaaatgcggtgtttcacttggcaaatgggatgcctgaaggatttacgggtgccttgcagtgtcccccttgcagggaattgccttgctcctattcccgaccgattcaactggccctgccttcaggcccacatagttgttaccttggctattaaaggcggctttggttggcagccgcgtgctctccttttcgatctttttcgaacattatatttggcgcccctatcggaaaagaactttttttttggctacgcaccgttttccgttgtgagcacaaacgcccacattggggaaccagcaggagagggcttgatttttagcagtgcttcccctgtcgccccggcacggtggtataaagtggcttggcggtctgacagccgccttccttggcctttgaacggtttggaacggcgcttactcttccaaacttccttcggtggttcatctn

SEQ ID NO: 664486 - DNA, 746 bp, Homo sapiens
agcggaggtgggagaggcatgctagcggctggcgagttcacgtggatgaaagcagaagactcatctaaagttagtggtggaacacctatcaaaatttgaagatccaaatcagtaggttcctttaaacagcgaaacccgaatgaggtactagaaacacgagaaataagattcgggaacaaaatcgatatgacttgaaaacagcaggaccacaatctcagttgcttgctggaatcgtggtggataagccaccttctactatgcaatgtgaagatgatgatcatggcccagcagctcctcctaacccatttagtcatctcacagaaggagaacttgcaagagtataagaggacaaatcgggaacgttacaccaaaagggctaagaagagaaaacctagtggaggcggtatcaccaaggagctactatctccatggcaagtgcctgtcatggtagtaaatggcaaggatgatatgcatgatgttgaagatgagcttgctaagcgaagtgagtaggttaagcacaagtacaagcatagaagaaacatcgagattactatgaagtcttccagagtataatcgaggaaggtctgtcgacctgaaggctaccccttaaaatcgccattcaagaaaaagaagaaattcgggactccttcttttctgaaaaagaagttgaaaaagggtaaagattgagcttagataaagggttgtgatagtaatattataacgaggtgaattgaaaaaataaaaga

SEQ ID NO: 664487 - DNA, 435 bp, Homo sapiens
agatatgatgctgcttgaggtggatgcatcggtgcgactacagttgcgtgccagcatggctggctaagctctttagtgttgtggagaggagatcttacttgcgtcgaccagtctggtgttaaactgctggcctcaagtgatcttcctgccttggtctctcgcgaattgctgggatttacaggcgtgagccactgtacccgccctaaaacatgtcaagtcgtagcgatttttatatataagatctactctaggcacttgtttaaaaaactccgtgttcagccaccaccctgcaaaaatcatatcaacaaatttgtttataatttaaagcattgcaaacattcggaagttacatttctagacaagaactgacaaaaccactctgctctgaattttataccagtcgtaattaacataatgattaccgaaaatatgact

SEQ ID NO: 664488 - DNA, 1028 bp, Homo sapiens
ctattctctacaaagcacaaagacataggaacactatacctattattcggcgcatgagctgggagtcctaggcacagctctaagcctccttattcgagccgagcatgggccagccaggcaagcttctaggtaacgaccacatctacaacgttatcgtcacagcccatgcattagtaataatcttcttcatagtaatacccatcataatcggaggcgttagggcaacgtgacttagttccccgtaataatcggtgcccccgactatggcgtttccccgcagtaaagcaagcataagcgttctgactcattaccgtcgcctcgtcgtccgtactccatgcatcgcaatcatgcatactagatgagagggccaggagacagagaacagcgttgacacaggtcatacccatcccgttagacagggaactacatcccaccctggagcctccgtagacctaaccatcttctccttacaactagacaggtgtctcctctatcttaggggccatcaatttcatcacgaagcaattatcaatgatagaaagccccgtgacagtaacccaagtaccaaagcgcccctcttacgtcgtgatccgtgcctaagtcacagcagtcctacattctcactatctctcccagtcctagctggtggaatcactatactactaacagacgcaactcaacaccaacttcttcgacacagcggaggaggagaaccgatcatatacaacaactattctgatatccggacaacacgaaggataatcataatctacaggctcggaaaatctccatatgggacctacctcgtccggcaacaagaccatggatacatagaacggcagagcaagagctcaagggacacaagggaccaggatagacaccaagagtaacgagcataacaataaacgaacaaattacacggaaaaacagaacccaagcgacagaaagagcaaaaacagaacaaaaactcgcaagagcgacacaaccaggccgatctacaacaaacacaaaaaagcacagacacaggt

SEQ ID NO: 664489 - DNA, 151 bp, Homo sapiens
aaaagagagagaagattgaaaagaagatgaaggtgaaattaggaagaagcttgaaaagagaaagaagatttaaagaagaggaagaaggaaaagaggaagagtagatctaagaagatgtagtaaaccatgaggagccacagagtattttttt

SEQ ID NO: 664490 - DNA, 465 bp, Homo sapiens
  misc_feature (181)..(181): n is a, c, g, or t
atgtgctggtatacagtgtatcaattagtggtacgtaaggcctagagttacagtggaataatctcagtcagatgattgttattattcattaatattatttcatttttaggtcattttgtctttgcctaaattttagtaagacactcttcagggatcacagtgatactaaataggtaaaatngcctacagagagaacgggaagtcgagtatacatgtatacacacactagcattctcaaggggccatctgtattatgcatatccttgtttttcattacagaagactatggagaagaagttagtgagacagcagacgaaacaactggaacctcgacctgtaaggatgaaaggctgatatatcataaccttctgaatgagttcagtcgcctggaagaaagatatgatgacctcagggacgagatgacccttatgggggtgagtcgaacactctcgtgagtcgatcagt

SEQ ID NO: 664491 - DNA, 119 bp, Homo sapiens
  misc_feature (6)..(6): n is a, c, g, or t
accggntagagcggtctctactaacataatacccattattttacagtgtttgcagcctgcgaagctgcactgggcctatcactactagtaatagtatccaacacatacggtaccgatta

SEQ ID NO: 664492 - DNA, 1000 bp, Homo sapiens
gtagacagaacatcagggagaaagactatctcttgtatatttcataaacatagcattagtagtccaaattcagaattcttcttaagtctcagatactttacactttttctctcttaagcagcagacagaatgcaagtaaatagtatatataagcaccaaaaggatctatacgatgaaaagtgggtgctttaacagttaatatctgatttttacatttatttacatattatattaactggtagcacaagtgaattatagatagggcacatttattatagacaagttgtcatatctcttcaagtattattgcttattataaacataatattactatgtagatttgatctaactctattgctaattatcaaataggagatcatggacttcgaaagaaactaccattattgatttataaacaccactttacatgagtcagtttaccatatgtcttaaacagaaataaccaagcacaacaaggcaaagagccacaataaacaggtattatgattactttaacactgtataaccttgaaaagctagttaacctgaaattatcaggaagtaattaaccttactatggaactatctacactgctgtgtatcatgtctagataacgtgcacaataaacgtagtaatatggctgatacatcaggacaagtgagtaagagaccagggaaaaagaccaaagatgggaagatccgacacaacagaaaaccaagcagaagagagacaagaaagaacacaaaaaacaaaacgaggtaacaacagcaagacaaacgaaagagacaaatagaaagagaaccagatagtctgagaagtactgaccgtattagtcgagcgatcaagaatgaggcgcagagcggggaatcggcgagagaaatacaatgctaaaagttgatcagaagaacaacgaaggaggaaataggatgaagttaatcttcgtaaaacaccggagggatggcgtgaatgatgcgacggaatgccatcagtaggcgaacg

SEQ ID NO: 664493 - DNA, 582 bp, Homo sapiens
gaggctcctggagcccgacgcagagcagagcgctggtcgggagcaatgcaggtagccggcatctgatggattccttacaaagtagtgctggaggggccagctaccttggtgcttccggctgcaagggggcaaaggacttcaatgtgcgccctctccatttcccggctcactcctgggggcaaagcggcgcaggccggacatggcctgctgggtgactgggtgctgagcatcagaaggcgagaatgcgggtagacctcacacacatctgaagctcagaacaagatccgggcctgcgggggagcgcctcaagacgtgggagatccagcagggagccacagcgacgtgtgccagatgaccaacaccctgcaccgacagagtacggaggcatgggccgcggaaccgtccacgggccggatggaaccgagtgcatgaggcaacagaaacaagagccagagcacgtgcaacagaaccacgctgacaccaataactgcaaaacacccccaaaaacaacagaacaccagaacaagaacaggaaaaacacaggagaacaacagaacggcggcaaacgcaaccagacagaag

SEQ ID NO: 664494 - DNA, 246 bp, Homo sapiens
  misc_feature (81)..(81): n is a, c, g, or t
  misc_feature (122)..(122): n is a, c, g, or t
  misc_feature (147)..(147): n is a, c, g, or t
  misc_feature (201)..(201): n is a, c, g, or t
cccagagtaaagaaatcttatgtatcaatcatgaaatccaagaagacgtcctatcaattggtagtctgtcctttggactgnctggcgtgagtatttttagggtacctattgcatgattatgncgggagcacagttataagcaaattntctccattccctgaagaggatgagaggagaggtttttgcccttagcctgcaggnaataatacctcgcataggaagcttatgatcatggatccctgtgag

SEQ ID NO: 664495 - DNA, 979 bp, Homo sapiens
ggcagtctgtctgagggcggcgaagtggtggctcattttaagatgaggcttctgtgcttctcctagtggcggcgtctgagatggtccggagcgaggcctcggacaaatctgggcgggtgccccacgcatgagacttacccgatgcagaaacgccacgggcgcccgcgtgctacacagtccagaagtgcggtgtctcccgtgacgggtacatacgagcggagctgttaggagagagttacactgcggggttaactacacccccaggggatcaccacagaaacaagtccgcacatcgcaaggaagcaccaacattcagccatccctcatcaaaacacaaaattaatatacgaccccaagcacttcagccattccatttcccgtgtgtacaaggttcattaccacacacttcagcttccgtcaaacacaaggcgcctcacacatcacctcttcgtctggggcccacacgggacactaccctctctgtgtccttcaccttcttcgtgccaattgcacataggtctctcccttcaagcaccactcccggggaccacggtgggagcggaccacaactacagaccaactcacaccggggctcacactgcgcccacttcgtacttgagactgcggatctcacacttccccttggaaagcacaacaaagtgcactcctggcccagaaacccccacggctgcgtcaacttgtttccaaaccagagtggtgtgggcatttttttacgatcgcattaacacttttcccacacctcttgacttggatcacccccttggtccggtgcgggacataaacaggctactgggacaattcctgtggggctccaactcgtgtcagcaatccaccctgtggcacaacacacatctctggatcaccaaaacttctcttctgcaccaatcggcacattggaaccgcctccacattggtcgccatatggcgccttccacatcacacaaccacatgcgaatca

SEQ ID NO: 664496 - DNA, 547 bp, Homo sapiens
tggctatgtaccatggtgagtgctgtcacataacccagtgtgcttaaatatgggaggtgactataaaatggatgaatacagcaagttgagctttcctcagtggcctcacaagtaaccgtaccctgtgtattacttattttcatgtaatacgagatatatagaatactagtagtgagggacaggctgggagataggaccaatacttatgagttcttccttcaggccccagccagctaagttgtcttttgttcaatgagtcaaatttctccacaatagatgttgcttttcgggctaccattaccttaattttaaaccaaaaatactgaatacggatgttggttattgtttgaatatgcaggtatttctgtgttaccttgaaatcactggcagtacatttcagttttgtgctgcgttaaaaattgttgttaattagatacaacttattgataactatgtatgtcttgtcacatctctacaggatttagggtatgatgattttaggtgtctcagtggttatgtgatttagtgagtaaaataatgaacagta

SEQ ID NO: 664497 - DNA, 1528 bp, Homo sapiens
  misc_feature (979)..(979): n is a, c, g, or t
  misc_feature (1153)..(1153): n is a, c, g, or t
ccgcaccatcgaattgtggtggtacccgccagttttctcccttcactgctttttttctggccactcattgtttgtcccgggtgcgtgtttgttacatcgtcgtgtggttgtcacaagtgaagctccactttctcatcggagggatcacttgggtactgagtatgcgttcgtggcagtcctctgccgcgggtggttaatacttcttctcccacctcgttaattgtgttggggcgaatactaagccgctcaggagggggttggttcttttctctaacaagaaggggggggtaaatgtgtggtgcccaagttgtgtgggctttttgtgaaccccgctggagttgggccgcccacctttgggggttccgaaggcgtttcttacactatatcactcccgtattgccgtgttgtggttgttcgtcgtgggtccctcttgtagttgggtcctctccacgtgatgcgcccctgtgctcgttgtctatgccgccgccgttggggtcgccatagccgcccgggttgtgcgaccctatggcccccattgccccctttttgggcgcccgccgccaagcgggctttgttttgtgggaatcgtcacttctctctggggggccgtgttattacactgctgggggacaacgcttggtcgataatagggttttgggggacacgaccacccacggcgcgataatagaaatggatgtttctgtatcggcctgcgtccatctctgggtagaaacactgggggcgtcgtgggttttttgactcacagacgactctggtgtgtcttatcaagtgtgggggcgacacacgccctccggagggtcctctctggggcttgccgcccactgtcaacatgtgtggggcgccgccccacaccccgcactgctcacacagggggagataataattagggagagcgagacatattcttgtggatactcttggagagggccccccctcggggagaccctcacagcagttngtgctcacacaaagaggggtggaagacacacagttgtccctcttgtctctcggtgagtggtgaacatctctctttgtcacacagctgtgtctctctcgtgatagagaataaaatgtgggagatgtcctccgtcagcaggagactctctccgcacaccctgcgggcgttttgggnggtgtcacacagagaacacacggcccacgccgacagcagagagtttataggggccctctctaggggcgacactctggggcgtctgtgtggtggtgccactcttgagaaccgccgagtctctctctgggcctctctggcgcctctcatacttgtgcgtcgttcgttcttgcgtctttttggcgctcttctcacggtgttgcacaccgctggtctctccacccgcctccacgctcacgcgtggtctctgcaccgcacaccacctccaccccctctcaccccttctcaccttttctccccacctatcgtgccgcacccctccacggccctgtgttggtatagagcctacctgtatgtccattaccccccctggagcca

SEQ ID NO: 664498 - DNA, 957 bp, Homo sapiens
gtaccatctcagttctaggaatactagtatatcgctcacaggctcatatcctccctactatgcctagaaggaatacctactatcggctgttcattatagctagcctctcataagccctcaacacccactccctcttagccaatatgtgcctatgacagttactagtcttgccgcctgcgaaggcgcgggggcctagccctagtagtctcaatctccaagcacatatgggctagactacgtacataacgctaaaccctactccaatgctaaaacgtaatcgtcccaaacaataatattacatagcactgagatgacttgccagagaaaagacgtaatgtgaatcaacacaagcacccacagcctaattattagcatcatcgccctagtattttgtgaaccaaatcaggaacaacctatttagctgttccccaagctttgcctcggagcccacttaaaacccccctcctaatactaagctacctgactacctacccctcacaatcatggacaagccaggcaagttatccagtgaaccacttatcacgagaaaaagtctacctctctatactaatctccctacaaatctccttaattataacatacacagcacagaactaatcatatttatatctatcttcgaaacacacttatccccacgtggtatcaacacccggaagaaggcacaagacaggaacggctgaacgcaggacatactttccaagcagacccacaagatgggtccgttccctaaggtcgacagttgaagtcaaaaagcctaggtccacagatctcatgcctcgtggcacaagaaagtctgggcaaatcgatgggccaccacagtaagcgaacccaggcactggtcagcgtcagcccggaagtagcgggcaacagggaaccaccacgcagaacagcgctggagagggccggctgacaacaccccacccaccccaaacagga

SEQ ID NO: 664499 - DNA, 300 bp, Homo sapiens
  misc_feature (14)..(16): n is a, c, g, or t
  misc_feature (23)..(23): n is a, c, g, or t
  misc_feature (84)..(84): n is a, c, g, or t
  misc_feature (266)..(266): n is a, c, g, or t
ctcgtgcaatttcnnncagcttnacattctggattctcctcttgagtaaaaggactcagccaactatgaagttttttgtttttnctttaatcttggctctcatgctttccatgactggagctgattcacatgcaaagagacatcatgggtataaaagaaaattccatgaaaagcatcattcacatcgaggctatagatcaaattatctgtatgacaattgatatcttcagtaatcatggggcatgattatggaggtttgactggcnaattcgctttgggctcgtgtattctcatttgtca

SEQ ID NO: 664500 - DNA, 409 bp, Homo sapiens
gagtaacgtacgagcggtgccagtgtccctgcttagaaaggatttttaaatcgggtgcgtttttgcctgcgctccaacaacatccattggttgtactaaatcttttcacgcccgatattgtagcatcctagtgcgacgacgtgtaagagcagcaggtatcatcaagtgggcttctctgggcttgcagccaaaactaattgcagtactcaaaatacgaatcgacgtcttgtttgtattgcaatttagcctcagagtgcaccgaaaggccgtgctcagttactcacagataaatggccatatcgacgtccttgtcgcatagcaaagaccagtatcaacttgattcaaaattgtacaaaccacctctgcttcgaacgattgaaattatgtcgaatttctcctcgaatgatat

SEQ ID NO: 664501 - DNA, 202 bp, Homo sapiens
  misc_feature (117)..(117): n is a, c, g, or t
gcacaatcagttgtactttacatttaaagatcacttgagtgatggccgcctttccctcctacccgctcctttcccacatgccttccaagggtagcttggtactgtagggctgcagantgagcccatggttgtgtgtacgtgccctcaccttctcatgccacctgaggtcactttatgggtcttgtcctcagagggtcggagt

SEQ ID NO: 664502 - DNA, 562 bp, Homo sapiens
  misc_feature (537)..(537): n is a, c, g, or t
actgcatcaacgccgctggctagatggtagtctatttgaaagataaatcctgtgccataacagtgactgaccaatcgtgctctagggacatgggagagatcgccaggaaacatgagtaatataatcaagtcactcagtacaggggacctacagacagcatagacgtatgtctcagaagagtacgaatgatctatacgagcgatgtcgacaagaatcgtgccttcgatatgggaggatctgcccgttgtcaagtcgaagatggaagcatcccggtttccgaagaagttctcagccttacaggcgtcggaaggatatttccgaaaaaaataccttgcctcttgctcaactaccactggttaaatcacagcacacttcaaatcccagtactgataactcagagcaggttttgggatgacaggacaaagaatttgaactaatgcaaaaataagtagcaaatattaggaagagcatttgtataaagtctttatgtacaaatgaaaacatactcatggctgtaatcccagcattttgggaggncaaggtgggcggcgttggatgcagt

SEQ ID NO: 664503 - DNA, 140 bp, Homo sapiens
gaactgtacgttgtttgttatgattgaaactaatgatagagagagaaacagtataaaggctaaaattgggacgaccagacatctgatagagagtgcctaagagatcaagataccctgcagcaagatattacttcaagagt

SEQ ID NO: 664504 - DNA, 149 bp, Homo sapiens
tgggttaactattatgtgggtttgtcccctaaagtacttttaaaataaagactggtttgtttatttatttatttatttatttatttatttatttatttatttatttatttagagatggagtctcgctctgttgcccagtgtggagagag

SEQ ID NO: 664505 - DNA, 1347 bp, Homo sapiens
  misc_feature (453)..(453): n is a, c, g, or t
aatggatccagctggactggcatatcacgccgctgctgctcaactactgccagtgtgcatagctggtgtgtcgaggagctactacgtaggtgctggaccgagctgctcttccagtcctcgaacataggtacgacgacaacgtcaaggccgtacttcaagcggggcaaggcccgacgcggccgtgctggaatggcccaggatggcctcaggctggcatcatttgtcctaagagtggctgcgagctgggacccgaggctcgctggccgccttggtggtgagcctgagagctggcgggaccctgggaggccaccggcatccgggcaggaatggactgaagatggaccaaagcccgggttccggcgggagatctatctcccaatggacatggagcactttggcccttgcctttaaccgtggcctaaggcccaactgtctagccagacttggccaatnaccccctcctatgcccccggtgccatggcagttcgattggcatatgcctggtgctataatataacagggcccttttactatcaatcgtcgtcagaacaagagcgaaacgcacaaacggggcgcgcgcccgagatacactaggaacataaatacgggtattggcgggggggcacccaacgcgttgttttcacacgccgtcatagcccagagtctttaaacttgggcttcccacacgcgagggtgcccccatagatggactgggaggcccacggtcacataaattaggcgccttgggagacccctgtgtggcgcggacgcaatctatccaaaaactctggtccgcttgaacctggggagaacacacccttagagtatagagccctcgggggagatatcgccattgcgggcgacagggggaaacccttattaacataacccgagacggccggaggcaacccccttaagcttgtgccgacaagatcctttaaccccttaaatagtaggaaatttaagaaccgcctatgtagagggggttaccacattatgtcacaccccttttttgcgaccaccctggatcaaccaggggggcgaaaccacccaggaaccgggcgcatataatccccggccccccgctcattcaacacaacgtcttgggggcaaacccgggaggtagtagccttcacagcccaacattttatcacggcgcgcaaccactaactaactagtcagcgatacacccacattccacccacaccataggagagagatcacttccccacaccgagagcacagtctccccccaacgacaaccaaacaaggtcgagagcgtgcccaccattcacaacccctacctcctgcggccccaaacactctcctcgcgcgcccctcccgccg

SEQ ID NO: 664506 - DNA, 697 bp, Homo sapiens
gggaagccaactggctcgtggcaggtccaggagcacgagacgggggaccctcgcatgaagcccaagcaatgtgagccgagacctgggccttgcagcggacctgcccggtggggcttggaaggagcagctgcacagatccctaggctgtgttactgccagccggaactgcgtggtcatctctgatgtgctgagcagggtggacaagcatgggccaccggctggaccatggctggtcacctggatgattgagaaaggccctgtggggtgggaccatgttgcctgtgtcccatctgacgcatgccgagaaggctggtggagtgactgcttgctgtccaggagcccaggcatgaggccagagccatgagctgtgggctcaaaccgagctgtcccggtgggtgccataaggccggacaatgccaatgcccaatccggggacctgaatactgcatggctggctccgatcctcccggatggcgactggcgggaccttgtgccctctatgcatgaggggtcagctggccccgagggattggggtcgatcattggccttaaccccctggcttgatgtccaggtgaacgaaactcctgtggcgccctggatgccctagctcctgccaggctgctggggggagctctgcaggtggtccacagccaggcagcttagacaggcagcctgggcctccagaggagtcctagc

SEQ ID NO: 664507 - DNA, 230 bp, Homo sapiens
aacgtcgaccgggggactgtacacatgtatcatagagtcatactgatgctctgaacctcaagaggatgtgaaaatgacttgcgtgtagttaccccaagatgaagatttattgaagcagttatgctccacgcaacctggcactacattatgtgctaggttctactattttcccacttaattagaatgtaacacattgtgccaaaataataaaaacaaaaaatcctgggaaa

SEQ ID NO: 664508 - DNA, 99 bp, Homo sapiens
aaaagcagcccagcccaaaggggggctttgttggccttttttggggctttgttttatgtttcttaccccccataaaaacaatgttggctccactgtgga

SEQ ID NO: 664509 - DNA, 690 bp, Homo sapiens
ggggtaccgggatgtggcggctaacgcggcgctccagcttgagggggggttgacggccttctggcgggtggcggtggttgaaggcgcatgagcttgcttggcccgtgtcgcttctcgtcccaatgaaccgtgacgcgacgagtgagggcacgagggtcgctgtcgaggggctgatcgtcttccacgtagcacgtcgtcggtgacgtgacgccggcgagtgtccgggacgtcgttcccgccagacccctccggtttcccctttcctgggacgcctcgagggcggctggcggccaccgtagacagggagcgctaccgttcccggacatagcgataacctactgtcgtgactgttgtctgtctagtgccggattgggaatctcgtgaatttggcacaagactgaagcaagaagctgtatcccgcgggctgcacaccaatgccagacaagctgtccaatgttggtgttggcttccatgggacataaaacttgcattggccaagaagcttatccttgatgcagatattacaagatgccgggacgaaatagagcggcagctagagagagaaaaagacgtagaacaatgaagaaagttgcagaagactagcatggaatgaagacatgaagacaagacactgaataactaattaaggaagcattgaggaaaaaaaccaaataaaacaagaataacaca

SEQ ID NO: 664510 - DNA, 886 bp, Homo sapiens
ggccgctcgcccctcttttccatgtatccgtccaggatcccatgacagattctgtgtcacgtctccttacgatagttggagcggtgctgaactgtcagcaccatctgtaccgggtcccaacgtcgatgcctgtgctgcagaccccccaggtcagaacgatggggcccacaggctgcccccaccgctcaggggccacactcggcgaaggggagcctggagaaggggtccccagaggataaggaagcgcagagggagccccctgctggatcctggccactgagtgctcgcgcagcaggtgcacctggccagcgtggcgccggtgctgcctccgagtccgccagatcaccacactgccccgggtaaatctccaaaaatcttgccagatattctgtaagaaaatcggggacacccctatggtctagaatccaactaagatctgggacgaagtgcggcctgaagtgtgagctcttggccaagtgtgagttcttcaacgcgggcgggagcgtgaaggaccggatcaggctgcggatgattgaggatgctgaagcgcgacgggacgctgaagcccgggacacgatgatcgaggccgacatccgggcaacaccgggatcgggctggtccctggctgcggcagtgaggggctatcgggtgcatcatcgtgatgccagagaagatgagctccgagaaggtggacgtgctgcgggcactggggccgagatgtggaggacgccacaatgccaggttcgattcccggaggtcacatgggggtggctgtgggcgaagaaggaaaccccatctaacatcacaaagcgacgcaggcggaaccctggcataccccggtctaaaccgccggtgggacggacgcggccaggcgggccccgatagc

SEQ ID NO: 664511 - DNA, 196 bp, Homo sapiens
cgttggcttctcttctgatcctggaattgtttctaagtcactgaagacagaggacaagggtaccactcggagttgcctcttaagactgttttccgtccataggagccacctatggccactccctgcagcagggggaactgttcgtggttcctgcaggacgtcacagattgtgttcaccatctcgtcgatcagtgtc

SEQ ID NO: 664512 - DNA, 864 bp, Homo sapiens
caagagagggagcttgagtggtttggggacactgtgttgccgcgcgcgcatgggtggttacacatccgtgttgggggacacctttcttccgggttgcttgttcgcctgttcgcgcgggtcccccgttccacggacttgtgtttctttttagcagccccgcagtctcctcaaaatgtgggcgcggcagattctgctcttttggaaggagtatctccgccgtctccggggtggtacttcccccaaaagcgcaatgcggcgcgtcccaggaacgttgttctctcgcgcccccccaatatggccgatggcgaccttcacaggggtcgctgtctcaccagagccaatacgttctgggtgttcatgccgagtgtttccaagacaggacccggtttggtagttcaaagtaaccaggcagcagccccttgttggatttggggccgagaaggtcctaaaagggctgtttccgaaagcaccacaatcggcgtgggcggcggaaaaagggtagccccagagacagtgtttttgttcccgcacaacagcccgacgccaaacattgggggctattgataagcaaccattcttattggggcaactactgcgtttgttgtatgttacaagagcgcggcaccacccgaccctaactggggtttgcccagacaagttacatattgccaccatgagtgaattaccacaatgagaccaaccagggcaccataaatttcttgtgtaacaaacgagccccacagaacattggggggtcaaagataaaccgcccacccattgtttttgacgcaggtataaccaagctttcccctggtgtctcctgttcaatactacaccattgccaccccaccccgttcttctcta

SEQ ID NO: 664513 - DNA, 628 bp, Homo sapiens
gggaagaaattccagacacaccatgtttaagagctgtaaaggggggccaggcgcagtggctcactcctgtaatcccagcacttgggaggccgaggcaggtggatcacgaggtcaggagatggagaccatcctggctaacacggtgaaacccgtctctactaaaatacaaaaatagccaggcgtggtggcgggtgcctgtagtcccggctacttgggaggctgaggcaggagaataacttgaacctgggaggcggagcttgcagtgagtggcatcgcgccactgaaatccagcctgggcgacagggcgagactgtctcaaaaaaaaaaacaaaaaaaaaaaaaaaccaaagaaaacaaaggccgagacaaaaagggtgttataggaaacaggcacagatgtgcccacaacacgattaagaggaacccacgatgacaatgtagacacacgacttgcaaatctgtggcggctccctcataaggcggctgctcataacaaataacaagaatcagctccgatcaggcggtcgtgatagaactgccgatccacgcatgtcgtcctctgttgcgctaacgtgtgagctggtattgttcgtcgatagagggctccagtgtggttgttgtcgtgtct

SEQ ID NO: 664514 - DNA, 1366 bp, Homo sapiens
  misc_feature (652)..(652): n is a, c, g, or t
  misc_feature (1282)..(1282): n is a, c, g, or t
gggagtccccatcccattttcatcctgagcccaacaggccctgtgcattggcctcttgtcccttgggacacgttgtagcccacaggtgaggggcaggacctgaaggtattggccgtgttcaacagatcagtcatcatgggtgctttttgtcaacatgcttgttggattgatttggggatgtttggcccgagatgagaggtctgaggacaagagactgtgaggtgtgcgtgaggccctgcctgagccatcccttttcctttctggccccagcctaggtggctggcgcagtggaatatctatatatttgggcgatttagcggggctccggcggcaggccacgagaagtgctcttgggagtcttcgcggtggccgctggttcattcttagattcctatcttgatctcgaaagcacaagtgtcgaagtacggggagcgcaagacggtcatgggacacatgcctccttaggaaggaacgcatgaagttctgcgaagacgtcgtgctcgatgtggaacgtggagtgaccgcacgttccagtactgttactctgtcctaggcatctggccactcttcgcaatcagctgctctctcctggaagagctaaggtggaaggggcctgtgcattggcgggaagctctggtagctgagcatgggnccactgcagctactgaactacttcgcgctggtgggctagagaagactatgatgggggccgggtaaccttcgtgtaaagccacggagcgccgcacacaggaacgcatggcaagggactgtggggcaccttggtcctattagcggtggggctaccattctcggtagtaaatcaacggatccaaggaaagaaagcggatctttattccacagagtcccattcctgaaagttccccgctgtggaaacatgagggcggcatttcaaagatggcttaagcagatttggtgggcactttatgacaccttttatccttgccgaggtaggtcccaaaaggtaagcctcaaagtgaacagtatcaaacgagcagagaaaccggggcccctagaatacggtctttcagaaacggaaacagcgttgggggatctccactatcccccaagggtaacatttggcacgatccttgggagccacacagtggccagcggttcctagagaggagggttcccagtccccaagggggggaacaccctatagagctgtttgattgcggctaacaacgtatacattggccccaatagttaccacgcccgtccaagggacccaattagaaccattctgtggaaggagcgcctnagcacacaaaagaccggtggggacacacccacaaaggtctgtaccacccgatcaaaagcccttgtttgtttttaacatcagagg

SEQ ID NO: 664515 - DNA, 212 bp, Homo sapiens
catcactaaagccaaccatattctggctgaagacgcggaagtagtagccattgccaatgatgagctctggcaccacgcaggtcgcgccggttatgctccaagacggtgaccactcctggggcaggtaggaaggtaggcatctctgggctaggccttcctgatgccgagagcctctcctgggtccttgatcttccaccctactatggaggatt

SEQ ID NO: 664516 - DNA, 1589 bp, Homo sapiens
  misc_feature (339)..(339): n is a, c, g, or t
  misc_feature (385)..(385): n is a, c, g, or t
  misc_feature (430)..(430): n is a, c, g, or t
  misc_feature (457)..(457): n is a, c, g, or t
  misc_feature (526)..(526): n is a, c, g, or t
  misc_feature (1064)..(1064): n is a, c, g, or t
  misc_feature (1113)..(1113): n is a, c, g, or t
  misc_feature (1137)..(1137): n is a, c, g, or t
  misc_feature (1139)..(1139): n is a, c, g, or t
  misc_feature (1301)..(1301): n is a, c, g, or t
  misc_feature (1335)..(1335): n is a, c, g, or t
  misc_feature (1498)..(1498): n is a, c, g, or t
tcgatagccaaaatcgaaagcgactaagacattcagcgatactgacccgctggcatcttggcgccactgcgcttgaagaagactcgaccgaacactctcctcactctatattcggccatcgtcaacgcagtaggcgaagactccatagtgtaagacgagcttgacgcgcccttctcgacaatggcatggtaccatgcgctctccacagataataacatcgtcgtccaaatctacatagaggcaacaagagaactgcggcgaaaaacagttacttgagacatagtaaccaccatcacgatcctatggcagtcctgagtgcgacgtctgtgggctcgcacncaatgctgagttgaagttccacatgccaatgatctgttgcatctgnaccaggttgtgatgcttgctaggggactagtaaatcttgcagaanctcgtggtcggagacgtctggatctcnataggccatagacccttggcactgctatcgattggtgcacattgcctcctccgctctcgggcgtagcantcattcgaggcagagaggactctccagcgataaagaccagaacttgcaaagttgggcgattagttttggttggcgactatgtggagaccgtgagctggcactagggggaggcacaaagtgttttttggaattacgttaggatttgcgaagtactggcaacatccgtttctctcggtgttgcagaggcaaaaggacaacaagtaccgaggctagagttttagaaggctaagctcaacttagttgaattgttttcgcatgggctcaactcgaaactcttcaatggaatcacatactgtgtggccgcctaaacgtaaacataccaatatgaatttggggtggcaaacaaagtagctgagggagtggactctcgagcaacataccgtatgtgttctggtccacgtctgtagcatacctaatacggtactaagcgatgcgcatggggacgcaccgactcgttttgttcaaatgctctttcctgtgtattgtcttgcataggtcgcgactccgatgcagtacccaattactagccctaatggcncctcgttggactactatcctcaaacctcgagtaaattcgattccctcgntccgaatacagcgtgaaatcgaancngccctaaaggtgtatgacttcgagtagtggcccacggaagtgtaacacctgttatggagccgaaatgcccaacaggattgtatcccggtcctcgctcatgctggcgcccttgaaaccgtgttcgcccgccaccgtcggctcaatccccggaacatcgcgcangagccctttgcgcagtgttacctacatctttctnctcgtttcacctgtactgtgtacctcgcagccaactctggtggcgggcggccggcgccatcctcttccacgaaaccatcctcctggtcgacgcgcgtctccaacagacgcaccgctcctactcaacacacgccatgctcctgtccgacgctccatcgctgccnccacacctgcgctcgcgcttttgtgctcaacacgcacgcccaccgaccaattcgctcgtctgctccaccgctcctcatcacactcgttcgc

SEQ ID NO: 664517 - DNA, 438 bp, Homo sapiens
  misc_feature (24)..(24): n is a, c, g, or t
  misc_feature (419)..(419): n is a, c, g, or t
  misc_feature (437)..(438): n is a, c, g, or t
cctttaattttccaagccggtttnaaaccctatatttttttttaatcctagaaggccttcctaatttgttttgaatagaatatgccataactacttaatagaatgcttgcccctatcagtatagttaatagaatgttaatacttactgctgagcgtggtggctcacacctgtaatcccagcactttgagaggccgaggcaggtggatcacgaggtcagatcgagaccattctggctaacggggtttagtaggaatcccatctctactaaaaacacaaaaaatttgcccaggcgtggtcgcgagtgcctgtagtcccagctgctcaggaggctgagacaggagaatggtgtgaaccctggaagcagagcttccagtgagccaagatcacgccactgcaccccagcctgggcaacaggagncggtccgtctcaaaaaann

SEQ ID NO: 664518 - DNA, 424 bp, Homo sapiens
acggaggagataatagtgaagatccgctgggaggctgacagccaggctcatgcacctggtggagggagaatgtgtgtgtgtcttagcttaaaacagtcacagttcttgtctatatagatgaacaaatatttcttgatcattctgtaagaccaggaggttggtaagagtgactaaccagcctaacttaaatacacatgtataaagatgtccactgagaaagatgctctgtagagaatctgctaccgaagttggctcacgaatttgtgttaagtgtcattaaccaagattaggacgtcagtggcttaaatcctttgaatcctttccagggactgcaagattattggataaagagtagcatgaatcttgtgctctaatattacacagtaagttcacagaagggatgtaagtcaaagacttgttacat

SEQ ID NO: 664519 - DNA, 131 bp, Homo sapiens
tgttatcccaggctgggagtgcgggggagcaaatctctgctcactgcaccctctacctcccgggttcagacgattctccggcttcagcctgctgcgtagctgggataacaggggcctgcaaccatgcccgg

SEQ ID NO: 664520 - DNA, 326 bp, Homo sapiens
atccttccctcactcacggcaggaactcgtatcccgcatatttaagaactcttaaaattcaacaacaaaaagacatactcaatttaaaaatgggccatggatttgaatagaagatatacaagtgaccaatatgcgcatgaaaatgctggatatcattagccatcagggaaatgctaagcaaaatccacagagtgggctggggtgtgccaaaataaaataggccatagcaagtgttagatagaggatgtggagaaattggagccctcatacactgcgagttggaacatattatggtgcatcagctttactaagcattttggcagttc

SEQ ID NO: 664521 - DNA, 285 bp, Homo sapiens
tgacccgtgtctctgctggctgtggagccccccttggttgtcagggtcgcagggcagtgctggaaacgtctgtgcccatccacgaagcgcaaggcgcaggctggcggtcgctccacacagcctggagggtctgcctcctctgctcccacgccttctctgctcagcagttgcggcgcaccacatgtggtctggcgtgagtcttgcgttgtggggccatagctttaggagtcctgtgagaatgagatcgcagttctcaccatgctcccaataatgagggaaacattg

SEQ ID NO: 664522 - DNA, 274 bp, Homo sapiens
gtcagtattgaagcaagcagcaaagtttgtacgcctgcgtgtatctgctcaacaggcatgcttattcatcgacaagcgtggcatcactgtcgtgctggccgaaatccgcgccgctggcaagatctaaggagctctatcatgcgtgaattgattcgaatgatctctagcgcctggtactggtcacttctacactaccgacaagaacaagcgtactaccccggacaagctcgccaagaattttgtgcgacccgcgcgatcgcacagcacgtgatct

SEQ ID NO: 664523 - DNA, 373 bp, Homo sapiens
gagtatcaatcatggcagaaggcaaggagaagcaggcaccttcactaggtggcataagggagttgagtgcagcaggggaaatgccagatgcttataaacacatcatatctcatgtagaactcactcactatcacaagaacagcatagggtgaaacaaccccatgattcagtcatctccaactggttccggccctgacacatgggggattatggggagtataaatacgaggtgagatttgggtggggacacaggcacagcatattaacctgagagttcaaccagcacatttctttaatcttagcacgcctttatctatgtagcttcaagtgagaagctcctccatatgttattagtcaactctaccccgcggat

SEQ ID NO: 664524 - DNA, 414 bp, Homo sapiens
  misc_feature (108)..(108): n is a, c, g, or t
  misc_feature (132)..(132): n is a, c, g, or t
ggaattccgccattgaaaatctatatacaatttttgactcttcaaaaacgtaactactaatagcctactgttgatcagaagccttactgataacatagttcacacatnttctgtatgttttatgtgttacgnatgtattattacaataaagtaagcttgagaaaagaaattgttattaagaatatggtaagagccaggtgtgatggtctgcgcctgtaatcccagctacctgggaggctgaggcggaaggattgcttgggcctgagaggttgaggctgtagtgtttgtgccactgcactccagtctgggcgacaagagttagaccctgtctcaaaacacaaacaaacaaaaaattgtaagaaaaacatttatcacaggaataagggctatccttcatgtatagagatctttgaa

SEQ ID NO: 664525 - DNA, 218 bp, Homo sapiens
agtgactctaagatcccctgttgtgtgtgagtgtggtattcgttaagttgggtgtgtggtgtgttgaggaatgtgtggggtgtgtgccatgtgtgctgggtgtgtatggtgtcttgtgtcatgtgtgtcgtgtgtttgtctgcgttgtggacttgagtaatctcaggcctcaggtgcaggtcacagggccggtcccagggctggctgctcagaaccgc

SEQ ID NO: 664526 - DNA, 495 bp, Homo sapiens
tgtggagagggtctcaggtggggcctttctcactccaaggctctgggactcttggagctctggtaggagcaggggagaccaaccctacctcggatgcaggggcagcatccgatgaccccgataatgaccacaagaaagaggcagcacctctagggcaggaaagtgctgggggtcagaggcatgggtgccattccaggctgagccaggcgggctgtgtgagcctgcgtgagtcacttaacctctgaacctagtgcttcacgtgcaaaagagggaagcttccctcatcctcctccagccgtcacccgctgcctcccttctctctgcagcaaaatggctccgaagcgtggtctacacttcttttctctgattctttacttaaattggcacttattaggctgagcgcaggggctcaggcctgtaatcccagcacttgggggggccgaggcgggcagatcacttgaggttaggagttcaagaccgggctggccaaaatgg

SEQ ID NO: 664527 - DNA, 109 bp, Homo sapiens
ccctttcctccagcccagagtccttcctctgcggacggcacacaagaatcagtatccccacagacatacggaccatatatcaccaagccacaaagctggaatgacaaca

SEQ ID NO: 664528 - DNA, 446 bp, Homo sapiens
actcgattcctggccagaaagaagcatgtgaccgcccccgtctgcaaggatcgcggcagggcgggcggggcaggtgccgcagcctccgcgcgcaaaacccgccggcggggcccgggtcgcaccgtcccctcttgggccgagcacatgaaacccacctcgtccctccgtccccctccccaggggctgcaatgaggacgctgggagtttgaatggaaacgaaggccgggcaggggggtccgcgcgggcgtgggttttttatccaagtcggtgacctcttggttaagtcagccctgcggtttcaacgcccaatccccccaaaaaagcctgtgggggtccacgtctccttgtgtcttccggggatccggcggagaatgtggcggggccgggcaggggggtcccagtcccacgccgggtgcgtcgtgccccgagtctccccagaaggcggc

SEQ ID NO: 664529 - DNA, 105 bp, Homo sapiens
tagcagagcagctccctcgctgcgatctattgaaaggccatctcttaatttttgaaataatcttaaactgcgcaatccagattctcgctctccatttttgtcgac

SEQ ID NO: 664530 - DNA, 403 bp, Homo sapiens
cccttatctgaaatgcttgggtcagaagtgtttttgtatgttggattttttcagactttggaatatttgcatatatttaatatctttgggatcagacccaaatctaaacacagaaatcatttatgtttcctatacacgttatacacatggcctgaagatttttttccttctctttttttttgagacagagtctctgtcgcccaggctccgtctcaaaaaacaaaacaaaacaaaacaaaacaaattagctgggcatggtggcacacagctatagtcccagctacttggggagctgtggcagaaggatcgcttgaatctgggagggtgaggctgcaatgagccaaggttgtcccactgtactccagcctgggtgacaaaaggaaaacttcgtctcaacaacaaa

SEQ ID NO: 664531 - DNA, 261 bp, Homo sapiens
  misc_feature (155)..(155): n is a, c, g, or t
  misc_feature (226)..(226): n is a, c, g, or t
gctggcgcccagtaagagagagagagagccaaagctgtccgttttgcagatggacaggaaggagccaggacacagctcagcttgctcacgcccagagagagaaaaagttaagctgctgaccctgaaggcaagggagagcaggctgcacagctgtntgtggaagccacgggctcaagcagccaaggcaggtggacagtgtgagagagctagtgtaagcttgttgatnagagctgttgctgaataaaaccatattcacctgcc

SEQ ID NO: 664532 - DNA, 88 bp, Homo sapiens
  misc_feature (84)..(85): n is a, c, g, or t
ggcacgaggatctcctgacaggagctgaccctgaagctgcctgggaaccaacggaagccgaagccagagctagagcatctaatnngaa

SEQ ID NO: 664533 - DNA, 153 bp, Homo sapiens
agtcttaaattttagggggatcaatttcacccccgggctcttttttacaagaaaaccaaataaaaaaattttttttgcaggatttaaatttaaactattttgctaagaggggcccttggttttttttaaatgccttaaaaagggggggcccca

SEQ ID NO: 664534 - DNA, 241 bp, Homo sapiens
tgtcccgctgactctagaggacccctataggcgctaggtagtacagagcgctgacggacgtggtaatgctgcgataagcctagataagttgcaatcgaacgtaagagtctagtgataccgaatggagcaatctattaagatggagtcttactacgaaagagggaaccacgtgaacttgaaacatctaagtacacgtgagacacacgaaagtaaaaacgatacccaaatgtacgcggatgag

SEQ ID NO: 664535 - DNA, 258 bp, Homo sapiens
gcgcttattgaagcgccaatggccaatagagacacgactcacaagactgcggctttctcctctggatggcagaagacgtatctcactcggcttgcttcagtccaggaggcatcacgccaaaggaagctctatgccacaggacgaaatgtgcagactggctgattctcacgtttttctacagcattctacttacatgggctctatctaatggcgacatacgctagagcacaacacagccgacacagctgctttagctta

SEQ ID NO: 664536 - DNA, 401 bp, Homo sapiens
tacatgctctcattgcattttgaatataataattacagagggggacagcatctcgagactccctaggccgggcgcggtggttcatgcctataatcctagcactttaagcggccgaggcaggcggctcatgatgtctagagatcgagcacatcatgcaccacaccatggtgcaaccccgtctctactaaaaatacaaacacatacagctgggcctggtggcgcgtgtctgtcctcccagcatattatggtgacgcgtgtacgtcaatcccagatcacttgggaggcaagaatcgcttagacccagggagttggcagtgttgccgtgcagctgcagcatcgcgccattgctatccagcctggcgcacacagtgacatccgtctcagtacacactgccggtggg

SEQ ID NO: 664537 - DNA, 344 bp, Homo sapiens
  misc_feature (12)..(12): n is a, c, g, or t
catccattcagntgaaagccccttaactgatttggttggaccattaaaaaaaaaatatgtgtacagaagaactttagctgcaatttggcttttttaagtgttatttgttattaaaatgtaatcataattgtgctggtgagatggctcagttggtaaaggtccttgccactaagcctgacagcctgaatataatcccaggggcctacacactggaaggggagaactctacaggctgttgtctgacctgtgtgtgtgtagctccctcccacacaaatacggaaatataagaaaatgaaatcataaatgtttttcctaccttcttagaaccaattaaatacaccaga

SEQ ID NO: 664538 - DNA, 238 bp, Homo sapiens
tctgcgctggtaacgcccctcggcgccaagccgggtatggaaccggctgcccgagaatgtagcgcaaacagatcatcgacatggcgctggagtgaaagcgaactctcgccccgcgagttggccaccaaatttaccgatgagaagcagtactttgtctgcgaggccacggtttatcgcctgctcaaggcacaggatctgatcgccagcccagcctatatcgtcatcaaggcccgcgacg

SEQ ID NO: 664539 - DNA, 503 bp, Homo sapiens
  misc_feature (372)..(372): n is a, c, g, or t
  misc_feature (475)..(475): n is a, c, g, or t
  misc_feature (501)..(501): n is a, c, g, or t
ggattacttcatgctcgtcctcggaaacccaagcggcacaggaaagtccaaaaaggaagcaaagacgagcatccgaagtctcacccaaaaataactactgctgcgtattatagcgtattataattggggaaacagcattccaaacttctctccatgcacaggccgggcgcggtggctcatacctgtaatcccagcattttgggaggccaaggtggacggatcacctgaggtcaaaagttcgagaccagcctggccaaaatggtgaaaccccgtctctactcaaaatacaaaattaggccatacgcggtggctcacgcctgtaatcccagcactttgggaggccgaggcaggtggatcacctgaggtcagganttcaggaccagcctgaccaacgtggttgaaaccccgtctctacttaaaaatacaaaaattaactggggcgtggtggcgggcacctgtagttcccagctactcnggagttctgaaggccggagagtctcntg

SEQ ID NO: 664540 - DNA, 774 bp, Homo sapiens
ctgtaatctcagcctccggagtggctgggcctacaggtgcccgccaccacacccggctgattttttgtgtttttagtggagatggggtttcgccgtgttggccaggatggtctcaatctcctgacctcatgatccacccaccttgcacctgtagtcccagcactttgggaggccgaggcgggtggatcacctgaggtcaggagttcgagaccagcctggccagcatggcggaatcctgtctctactaaaaatgcaaaaattggctggacatggtggcgggcacctgtaattccggctacttgggaggctgaggtgggagaatctcttgaacctggggggctgctgtgagccgagatagttccattgcacttcagcctgggtgacagagtaggactctgtctcaaaagaaaaaaaaaaaaaaaaaacacaatcctgggacaaattcaaacaaggtctccagggaaaatctgggtccatggggctaccaattttggaagaccattgggtctgggtagatacacttttcattaatatacttactccatcactctttctatatttaagaagtttactagtagcaaagtgtatgcgggagttcacgggagaaccttattaaaagtgcagcttctgaattcagtgagctggggtggggcctgagaagtctgcatttctcccaggctccctgggtgcttgccaggggtgctgctctgagtaaccagggggctggggaactgctctggagccgtccattataatcccaatctgaccaactga

SEQ ID NO: 664541 - DNA, 375 bp, Homo sapiens
  misc_feature (36)..(36): n is a, c, g, or t
  misc_feature (103)..(105): n is a, c, g, or t
  misc_feature (118)..(118): n is a, c, g, or t
  misc_feature (129)..(129): n is a, c, g, or t
  misc_feature (142)..(142): n is a, c, g, or t
  misc_feature (151)..(151): n is a, c, g, or t
  misc_feature (164)..(164): n is a, c, g, or t
  misc_feature (193)..(193): n is a, c, g, or t
ggggggggggggggggggcggggttggtgctgtggngggggggggggggcgggcgtgggtgaagggttttggggaggtttggggggaggggtggcggggcggnnncgcgggggtgttntggtggggaanggcgggtgtgggntgggaaganggtgtcgtgggtnaaaagggggtttgggggggcggggcgggncgccttgtggcggggcgaatggccccgtaggatatttcgcccaacacaagggggggcactcaccccccacattagcaacataacccctcattcacacggggaaacccccccagggtcaaacccctatcccccattctcctcctatccctcaaccccgacatcattaccgggtttttttctta

SEQ ID NO: 664542 - DNA, 552 bp, Homo sapiens
agacggagtcttgctctgttgcccaggctagagagtgcagtggcgcgatcttggctcaatgcaacctctgcctcctgggttcaagcaattctcctgcctcagcctcctgagtaactgggattacaggtgcccatcaccatgcccggctaagtttttacttttagtagagacggggtttcaccacgttggccaggctggtctcaaagtgagacctagtctacaaaaactaaaaatatatatatatataaaatatatatataacatttgataatatatatatgatatatgtatcatatatacgatacatatatcatacatatatcatatataatatatatcatacatatatgtatgatatatatatcatgtatatgtatgatatgagatatatatgatatatatgagatatgtatgatatatacatatgtatgatatatacatatgatatgtgtgatatatacatatcagatatatatgatatatatctcagccaaccatgacagcacctgcctacagtcccagctattcgggatgttaaggcagaagaatcac

SEQ ID NO: 664543 - DNA, 321 bp, Homo sapiens
tacactgtcgtgtctgcacacacacatcgcgcacacacacacacacacacacacacacacacgccacagagttttacatggacgggtctctgagtggagtttattaggaactctaggagagacaggacataggtcttttcaattttctttagtagagctcacatgagactgcttatactgagtgtgtcacagagaacactgagagagaggtatacgggggataagcagcacgctctggtgtagctatgtctcgtaagatggctgtttatagtgatatctcccaatagcgctccattgcacagtctagacacatgtgtccgt

SEQ ID NO: 664544 - DNA, 461 bp, Homo sapiens
ggactttcaatacatgatcaaaatcttcacgtttggctttatgcagttttctaatcttcactaacttctgtgaatcagtttcagcacagaacttcagcggtgtatccttctgtttcttcaggtcatatatggatgtttcatatactcctgtccagtttctccaacagcttggctttctgtgccagaggtaaacataaatgcttcctctttttatcagttaccctgaggggtatctgcaggccattttgtcattttcagcaatatctttacaccacacagcaaagagagtaagcaaccaaacacagttgagtcatgcatgcaggtcttggctccatgtggggcattgtgggaaacctgccatcagcatgcctggcctgcacatatgccattttactatcctttgtgtgtgtgcttgcttgcgtgggggaaactgggtgtatgtggcaaagatatatggcagc

SEQ ID NO: 664545 - DNA, 159 bp, Homo sapiens
aaacaaaccgcgaagcagtagaagtaacatttgcagatttccgatggggtcctctatccatatttcaaatcctaatggagacaaacaaaagtgatggtcagtatttctttgaattctacaaggacttcaagcacatgtcttgatgagttattaaagagg

SEQ ID NO: 664546 - DNA, 406 bp, Homo sapiens
acataacacttccttctaggtccagtcatcgcatgtgaccacagtcatgtatgatctgcttcaactgacagctgtagtcaaagtcccataggtctgtattctagtgttggagactgaagaaacacttaacatccttcagaataactctgcctcagggcaattttggtttcaagtccatctttggaatgacacagaataatcaatctaagttttcacaggttacaaaagtaatattttcgatttctggtctcacctcaaaaaccttgccatttcccatgatagaataccaagaaatgcagggccaagcacggtatattttttttcttccatttggaactagtaaaaacgatgccattagaaagtactttgcaaattaaaatatacacacatggttaggtctacctgg

SEQ ID NO: 664547 - DNA, 120 bp, Homo sapiens
cgtactattctttccattcttttcctttttatctatattacttcttatttacggtaaatataccctttccatataatgcctatgactaggagcatacaaacaacagttggggtctgcttc

SEQ ID NO: 664548 - DNA, 83 bp, Homo sapiens
ttttttaaaaaaattcccggtttttgggggaatttgggccccttccccggggaaattggaaaaaatgttttttttaaagccca

SEQ ID NO: 664549 - DNA, 201 bp, Homo sapiens
tgaggtagtagtttgtgctgttaattgtcagttcagtgttttaatctgacgcaggacttatgcggaggagaatgtaacatgtactagatacctaacatatagtctcttctatcagggtgatagctggttgtcacaagatagaacctacagtacaacataaaatcggcaacacagaaccctctaaattacccatgaaaatta

SEQ ID NO: 664550 - DNA, 1420 bp, Homo sapiens
  misc_feature (256)..(256): n is a, c, g, or t
ctgttgggggtctgggtatggtgtattgtacacatgggtgggtaccgaacaacgttcgtcgctgtattatttggggggggcgcgtatacttatatatgctggcttcgtacacaggttgtttgtctcctcacgccgatgctgtgtgccgcgccgcgggtgtgtccgcaccgtgtgttgtgctgcccgtccacaccagcagcgtggggtctagcaccggttctgcggggggtggttatccccccttgttgatggcacncaccatgtgcggttgttctagttgtacatgtagtcggcccgcggtggttgttttgcttgcgcggcgggacggcgttcggccagccaatgcttatgtctcaacaaagataaagaaaaatagggagggggaccacaacatcttgtgagttcgacaagacaagtccactcctcgtctcgttttgtagacagcacttaatagtttgcagcatgattattacacgtgcgagtaggttgattgcgtcacacgccacacagcagggttgctggataaacgccacacaagtaaattttgttgagtgttatcaacaaaatgatcgcgggagagaagactaaaggatgaacgcaacactgtttgtgtgagggttgtggtgatccacacccaactattgttgtctcaatctgaccacacagacacgcgttctatcaatgcgtgtgactcgcccctcgcgtggcaacaacataatccgtggtggtggtgcacacactacaccaccaggggctttctgcttcttcatagactcacaactcccaccttgtgtcttcagcattagggagactcacgaggatgagcagcgcattggccgcacaagagatgagtggggaagcaccaccacgagtgcacacatattctgtttgtgtgactcaactccgggcgccacagaggagtgtctaattcacggtgttgactcacacgcgtctcgtccacacactgatagtgccccactggagatgtgttggtgggaagcgttgttggatagcgcgcacaggcgttttttttggcggaggcctcctctcttggggcgccgccctctatacatctcgccgggcaagtcgtgtggcaccggctgcatctgtcgcgcgcacacacgttgcgcccctctgttgtccccccgaaaggcgggttttacggggcactctttttaccctgcggagggaaacagttctccaacgacccccttggtggccacgccctggtatactcttgagagtcaggaaaataatttgtaaacccacgtataaaatcggccacgcttttgttgaactacacagaagactagtattactaccacaattgtcacatcccgttcctttaccaaaggattttccccaaggggtttcaaatcagggtcccagagggcccaattaaagaggtttttttttttga

SEQ ID NO: 664551 - DNA, 398 bp, Homo sapiens
gcactggcaccaaagtctgtcagcccagcctgcccacctgaatggtgggggtggaggtctgagaactctgtgtatcttgttcagcagaggatcagtttatatctgtctagtaatacttaacttagggagtccacctgaatatccatctaacaaagatgtctgtcatcgggtgggtcagtcaggtggtcactctggttgcactggttctatcaggctgttggctggtctctctctctctggctcggggactccctatgtgccacctgctggacctgtatctctggaggcctttgggtgtttgtccatgtcggtgctccctctgtctgtctgcctatctggcggtctctgtatctgcctgcctggggttggactgagtccgctgtggttatgcctgcctg

SEQ ID NO: 664552 - DNA, 192 bp, Homo sapiens
  misc_feature (11)..(11): n is a, c, g, or t
gctaattgttngtatggttagtagagacggggttgcaccatgttagccaggatgatcttgatctcctgacctggtgatcggcccggctgcggcctcccaagagtgcgtgagattacaggcgtgagccaccgcggccggccttgtttgtaatctttactatatctttctaagatagtgtgggacatgtgcaag

SEQ ID NO: 664553 - DNA, 1241 bp, Homo sapiens
  misc_feature (1241)..(1241): n is a, c, g, or t
agcgggcgggtccgcagtcggtgcgccctgctcagccatcgccagcgagccgccgatatccgagtcgcgtccggtcgaggtactatgggcagccgcggcttctgcccaccgcccgcgtgccgactgtcgaagttattacaaaaggacaaatgtgcccaacggatgcacatagtagtttccttctcgattgctcatcaaggacaatgcgtataattatattggaagatatgcatctaagggcgagtgatatcctatgcttcgcgcagtactaaacagccatgttctcactggaccctactggcgaccccactatcgtcgattcatggtatagggctcgtcgttgcgtagcatgcgtgtgaatacgaactatgtgtatccctcatgacactaatgcacgcatatacaaaccgaccctgcccagacacgcgttctgatagtaggcagcggaccatattacagtgcatttacaaatgagttgaactaatttgatacaaaagcagatatgtgtgagtaaaatatattgggcttttgaacacacaatggcgtgtgggcacggcgatggtaccctgtgctatgggtccccagggccctttattccctatgtgtatgcgtaaggacagtaccttctacgcatatattcatttataccttgcctccattatggttcgtataagcccaaaacctttatattctgcgcgtagttactcagaccgcgcttaacgttccaggaggacaggcatagaattgtcccgatcgccctccggggagatacatagacactataagacgttatgtgcggagaacctatattgtatcttgaccccgtgtggacacagaaacccccgttgtggaaggaacctagccgacccaaggtactcttctttcaccgcgggtttatatagggttgaagcggaacggtccttttacagacagggaaaaatcatagtatggcgctacacccgtaaatggtgcgaatgtgcccccaaccgggcggaattaagacggttagcggatcggttgttttcgtttggccattgtattgcgagaccagaagggaggctcgaacgcggtgaattagagggggggggccttcccaagggcaacctattgaaggtccagaggaggaaatcaatcgcaagtggcttggcgcaaaaatcttttaattcattttgcgaaaaccgaaaccatatttccgaacagaattggcccgggaaggggcgacccaagaagtttaccttccn

SEQ ID NO: 664554 - DNA, 940 bp, Homo sapiens
gaagttctggaaggcagtggggtttgagattggacccaggtcaagatagaacatgaaggtgggatgaggacatgaacagaacatggccaagaaggatctgggggagcagccaggacgaggcggagctgatccgagaggacatccatggaggctctgcacaatttaccgcgtcgggccgcggggagcgcagggcggcggcgctcagggccacgtcaggaggagttgcagcgcgaaccgctctgcccgacgctgagaccaaccgtccctggcagcgccgaccgttcgagtacctgcgcagtgatcagcaccggtagagcggtggcgcgggccgcggacgaccccgaggcagaagacccgattcccgaggccagaggaggcgctagacggcctgagcacggtaggggacctacgaagtcagacgctgagtcggaccaccctcggatcctggtgtccccgtgggtcctgacctggccggttctagtcatggcggaagctgggaagtggatcactcctgaaccaacgtgttcagaggacgtagacgagcttcgtactcgacgtgctgcgcataacgtcgggcgagaggctggccaggggatgctcggatgcaacagagtgaactgcgggcccgcaggaagcctgggcgctcgggcgtggtggtggaggtgctttgcgtgacagcttgcaggtgcccaatggcggccctcgagcaggggcgaagtacagccgacgttgctgcaggaaggatcaacgtacgcccttcagcctgctggcctgggttgcggcgggcaaacaatcgccgaaccccatcctcatccgagaagacttgttgcaccttccctttctcggggcctcgggcagcataattggtgaacacggccaggggagggccggtagtttcgacgatccagtgtgcgtgatagctgcatctagaccatcggcg

SEQ ID NO: 664555 - DNA, 523 bp, Homo sapiens
  misc_feature (1)..(1): n is a, c, g, or t
  misc_feature (59)..(59): n is a, c, g, or t
  misc_feature (98)..(98): n is a, c, g, or t
nccaaagacaggccgagtccctgaacccacttcatggggaagttcagcagagacacagntacagtgttgggatcggtgaggaaagtgtgtagctttancccaacagtcaggcagccctggtgcttgtaaagggtattggagaagaggacttctccctctcacccaccactgcagacaaagctctgacttctcccatgggagttctgcctgggtgcatctgtagacagcctttctggaacactgcatccccacaggatgggtgccctccaggttcaggcttgcataagaggtaaagtcacaacccctctctacgcagaacatcagaattcttggagaggaaaagaggtgactgtccaatcaaaatagccaggacgctgtgtcaggagtgtgactgggaagcagattgttttcctactagcctggagggagaactgtggtagcttcctcccttccctcagaaaagaccttagtgcatttcactgagagctcccccaaccacctctgtcaaggctgggacctctgc

SEQ ID NO: 664556 - DNA, 1080 bp, Homo sapiens
  misc_feature (573)..(574): n is a, c, g, or t
  misc_feature (587)..(588): n is a, c, g, or t
  misc_feature (601)..(601): n is a, c, g, or t
  misc_feature (611)..(611): n is a, c, g, or t
  misc_feature (613)..(613): n is a, c, g, or t
  misc_feature (615)..(615): n is a, c, g, or t
  misc_feature (635)..(635): n is a, c, g, or t
  misc_feature (638)..(638): n is a, c, g, or t
  misc_feature (656)..(656): n is a, c, g, or t
  misc_feature (659)..(659): n is a, c, g, or t
  misc_feature (663)..(664): n is a, c, g, or t
  misc_feature (667)..(667): n is a, c, g, or t
  misc_feature (670)..(670): n is a, c, g, or t
  misc_feature (707)..(708): n is a, c, g, or t
gtttccttccttcttgtcttttccttgtcgcactttcgttgattttttttctattcgctcatcctggttgcttatgatagtttgccccgcgctgtgttagttcgcccttcttgttcctctatctaccggggttacatttccatgtctggtcccctttgcgttgccatttcgctgcgtaaaatgggtggcttagttgtgctgtacgatggaggtaaaggcgatctctattgtcagcgtgctactgtgttcctctttttgttgttttgatcacccggagtcttcgctgctgtctctccaagccccggatcttgcatataggtgtcgatcttctgtctcacaggcaaggcactagtccttccccgggttcacggtcatttctgccgggcctgcagcctcccgactagctgggactacatgcgcacatccatctcacgcccggcataatttttttgtaatttttagtagagatcggggtttcaccatgttattccatggagtggtcttcaatctcctgatcctcatgatccgcccgtcttggcctcccaaatgtgctgggattacaggcatgagcanncgcgcccagccannattctacttcttnaaaatcacanananctagtcttaaattgatgacntgntcgtatgttcaaaatgtnaanaacnnaanaanagctaacaccagtctatttatattaactttttttttnntaaatcaaaaattgttaatgttagaaacatactatgaagtgcctttatctgcttagacctaaggaagattttaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttggttacttgttgagttctgttctacatataaccacccccacgcagttgctttttatagatatctatattaagtcaactttctgt

SEQ ID NO: 664557 - DNA, 329 bp, Homo sapiens
ccctgcagccttgaactcctaggctcaagcgatcctcccacctcagccttctgagtggctgactataggcacatgccaccacatccagcatccagctaacttttctttttttttttgggaatttcactttcgtcacccaggctgtagcgcaagggccggatcatggatcactgcaacctcggcctccttggttaaagcgactttcctgcctaagcctcccgcgtagttggggttacaggcatgtgccaccagcccggccaattttatattttgggaacaccaggatttctccatgtgtgacagccgtgtggctctcaaactcctgagct

SEQ ID NO: 664558 - DNA, 1053 bp, Homo sapiens
  misc_feature (573)..(574): n is a, c, g, or t
  misc_feature (587)..(588): n is a, c, g, or t
  misc_feature (601)..(601): n is a, c, g, or t
  misc_feature (611)..(611): n is a, c, g, or t
  misc_feature (613)..(613): n is a, c, g, or t
  misc_feature (615)..(615): n is a, c, g, or t
  misc_feature (635)..(635): n is a, c, g, or t
  misc_feature (638)..(638): n is a, c, g, or t
  misc_feature (656)..(656): n is a, c, g, or t
  misc_feature (659)..(659): n is a, c, g, or t
  misc_feature (663)..(664): n is a, c, g, or t
  misc_feature (667)..(667): n is a, c, g, or t
  misc_feature (670)..(670): n is a, c, g, or t
  misc_feature (707)..(708): n is a, c, g, or t
gtttccttccttcttgtcttttccttgtcgcactttcgttgattttttttctattcgctcatcctggttgcttatgatagtttgccccgcgctgtgttagttcgcccttcttgttcctctatctaccggggttacatttccatgtctggtcccctttgcgttgccatttcgctgcgtaaaatgggtggcttagttgtgctgtacgatggaggtaaaggcgatctctattgtcagcgtgctactgtgttcctctttttgttgttttgatcacccggagtcttcgctgctgtctctccaagccccggatcttgcatataggtgtcgatcttctgtctcacaggcaaggcactagtccttccccgggttcacggtcatttctgccgggcctgcagcctcccgactagctgggactacatgcgcacatccatctcacgcccggcataatttttttgtaatttttagtagagatcggggtttcaccatgttattccatggagtggtcttcaatctcctgatcctcatgatccgcccgtcttggcctcccaaatgtgctgggattacaggcatgagcanncgcgcccagccannattctacttcttnaaaatcacanananctagtcttaaattgatgacntgntcgtatgttcaaaatgtnaanaacnnaanaanagctaacaccagtctatttatattaactttttttttnntaaatcaaaaattgttaatgttagaaacatactatgaagtgcctttatctgcttagacctaaggaagattttaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataa

SEQ ID NO: 664559 - DNA, 341 bp, Homo sapiens
ggttttcctttggggacgtggttaacggtccaaaagaatcccttttagaaagcattttaggccagccatggtggctcacgtctgtaatcccaggactttgggaggctgaggcaggtggatcacctgaggtcaggagttcgagcccagcctgaccaatatgatgaaaccccgtttttactaaaaatacaaaaattagctgggcatggtggcatgggcctgtaatcccagctactcaggaggctgagacagaagaatcgcttgaacctgtgaggcagaggttgcagtgagccaagatcgcgccattgcactccagcctggacaacaagagcaaaactgtctca

SEQ ID NO: 664560 - DNA, 110 bp, Homo sapiens
aaggtcagctctggtagggtcagttcgtccagcaccctgcgcaggccattgatgttggcctccacactcatgcgcgtgtcaactctgtctcatacttgtgtgctggaacg

SEQ ID NO: 664561 - DNA, 89 bp, Homo sapiens
agtccaagggggctggcccggttgttctatgcagaagaaagcagtcaataaatgtttgccaggctgggtgcagaatttaaaaaaaaaaa

SEQ ID NO: 664562 - DNA, 104 bp, Homo sapiens
atgtgtctatcactagggcagtggggagacgtctataaccctgctgcttcccaaggatggctgtctataatttggggagagatagggtggagaggcagtggcaa

SEQ ID NO: 664563 - DNA, 1060 bp, Homo sapiens
  misc_feature (1060)..(1060): n is a, c, g, or t
ccttttccttttttcaattaaaaagttgaaataaattaacgtttaataatgatgtaccaattctgaggtgaccagaggacggggtccgggcgtagccagattctagaggcacagcggtgcgacagggaagtgtgagattagaatggaggagcaatcgagggaatagtcatcggaccgagcgaccagatcggcctaacaccagcactaaactaaaaagaatacaaactcaaaaactagcccaagaagaaccacaagcaacaagagcagcaagaaacgacgagaggaacacaagacaaggcacacaccaacacggaccgaacacgcgaaaaccccacctcgagcaccacaaaccagccacgaacgaacagccgcccaaaccccaacgcggaactaagacgcgagccaagaccaaaaaaaaaccacatcgacaacaaaaccaatcgtaaaaaccaacactcacaacaaagcgagaacagcaagacaacaaacaacagaagacacagaggaacaacaaccatgacaacagaacaaacagacaaaagaaatagagacacaaacaagacaaaggactaccaaacaaaaaggcacgacaaacaccgaaacaaaaacagtccgcacacaagaacaacacacccagcaaaaaaaagaagcgaccaaacacacaagaacaacaaccaagaaaacaacaaaagaacgcaacgggaaagacataacaaagaacagggaagacacagaaccgaaacagagaacaaagacaacacacaacaaacaaaagcaagcgcacgaataacgacataaaaccaaccaacaagaccaacaccacacatagcacagaacaaaaaagagacgaaggcaagagcaaaacagacacgtcggaggacagatacaaacaagtagaaaggaaacaccaaatagcagaaaaagacgtaaaagcagaacaacaagcaaacaacacaaaacaggcagacaaacgtaggaaaagacacacataaacagaccacagaaacaagacgagactcaaaacagagacacgctcaacaaagagaacaatcccacatan

SEQ ID NO: 664564 - DNA, 966 bp, Homo sapiens
ctgcagcccgggtgcgcaaccgggggctcgatgcgcctctttttccatacccctctgggggcatttaccggtgcgactgaaaggcccccgctttgatttgtttttggcccgctttcgcccgtgtcgcggcttaatgtgactgttcttctacaccttgtgggaaatgtgtgagcaccccttccgcttgttctcccgacccaccttgcaagcctctcaccaagggccgaactatcttatctctacgggccaccatccatgttaagtcgggtgcccgccccaacggtatggctccctactgcaaaccgagtcgagttggctgcccccattcgctattagcacgcccgcaagggccttcagtggcgggcgccccttccctttttaggcggcaccacagtggggcagttcaggtggacttttctctttcaagataaggaagggtcccgtctctagagggaagtattccaggtggtttcctatagccggcttttaaacatagagtcggggcccacatagtggacacgagattcgatgggcgtccttccgggagcgaacatccacataaggtgttttaccaggaggtgttttcctcgccgaccgcctatgtacaaaccgtcgcaccccatggacgcggcttatataggcgcctcgccagcgttggtcgcccgcgattccctggaatcgaagttacgtgggggggtcttcctcgttgcaggttttgcgccgttgcccgcgtactagttgatgtcacacctctcacctgtctgggacgtctcatcatttggttgacccgcgcagggcataagttctggtctgcggatttataacattcaaccgcgcggaggggcgttgttctttctttgaggagactacccctcgggcgacttcctcctctttgtggccttctttgttgacggttcccccaaatttggcttttctcaccccaataacccaagttctgacacgaca

SEQ ID NO: 664565 - DNA, 354 bp, Homo sapiens
ctaacattagttgtggaaatgcaaaatggtatggtatagccattttggaaaacattttggcagcttccaaaaaagttaagtataggccgggcgtggtggctcacacctacaatcccagcactttgggaggccaaggcgggcagatcacctgagatcaggagttcgagaccagtctggccaacatagtgaaaccccatctctactaaaaatataaaagttagctgggtgtggtgaagcatgcactgtaattccagctactcaggaggctgaggcaggagaattgcttgaaacctggaggagtaggttgcagtgagccaagatcgtgtcactgcactccagcctgggtgacaaagc

SEQ ID NO: 664566 - DNA, 130 bp, Homo sapiens
cacgactgtgacgacctccttgtgagagagggagcagtttgatcttcacgtcttcctgcacgctgagctgggagagggtcttcttgattgcgcagggccgtccaggtgggctggcgcctgttggaatacc

SEQ ID NO: 664567 - DNA, 103 bp, Homo sapiens
ccggtaagtagatgctattgaggagtatcctgaggcatgggggtcaggcgttgaggccttagtgagtgttttagtggggttagcgatggaggtaggattggtg

SEQ ID NO: 664568 - DNA, 384 bp, Homo sapiens
  misc_feature (18)..(18): n is a, c, g, or t
  misc_feature (359)..(359): n is a, c, g, or t
  misc_feature (380)..(380): n is a, c, g, or t
ctggattattccagagantcgaggatctcggcgtaggcgtcggcccccagtacttcttcgatacccatgtggttgttgacgaagaaatgacgcggcacgtacagcatcggcagggcgtcggaggtccagacaccggtttcgctgtcgacttcaattggcaattgcggggcgatcttggccatggaaactcaactccagaaaattcgttttgatgcccgccgcgcggatggcggcgggtgaaggattaagcgagcagtggcttattcgccccagacgtccttgagcacgttgacccagttctcgcccatgatcttgcgcaccacgcgctcgctgtggccgcgcttgagcaggtctcgtangttgggactctctgaatattncacg

SEQ ID NO: 664569 - DNA, 206 bp, Homo sapiens
  misc_feature (9)..(9): n is a, c, g, or t
  misc_feature (25)..(25): n is a, c, g, or t
  misc_feature (90)..(90): n is a, c, g, or t
  misc_feature (106)..(106): n is a, c, g, or t
  misc_feature (163)..(163): n is a, c, g, or t
  misc_feature (176)..(176): n is a, c, g, or t
  misc_feature (189)..(189): n is a, c, g, or t
ttttttggntttccaggctatttantcaagtaatttacaatgtacacattcctgagtatacaccatggtggtgatataatttatgggggnatttcctccattcagnttaaaaggtgtttcttcccaagaaactgaacttttctgtcaaatgcacttgatcgantaggagaattggnttcataaaatggnttcatagaaaatttttt

SEQ ID NO: 664570 - DNA, 201 bp, Homo sapiens
aatcagctcggtacccctcggctctgctactctctagtttatattcatgatattctaactagactaccggtagtgtagggctccagttagttacgcacgtatttgatgtaggcactttatggtctattagatatgcaaattgggaacttcgtatcgtggttaaaagttaagttataacgatcccagaagccttttttgcgg

SEQ ID NO: 664571 - DNA, 512 bp, Homo sapiens
gggttccatcggcccattgtgggttgccccacggtttggtacccacaaaggtgcgcgccggccccggtttcaacctggagaagctcagggtggccggcattcacaaaaaggtggcccggcccctcggcttttttttggatccaaggagggggaacaagtccccggagtcccttcaggccaacgtgcaacggttgaaggagtaccgctccaaattcttccttttccccaggaagcccccggccccccaaaagggagacagtttttgcttaaaaacttaaactggccccccacctgaccgggccggttatgcccgtccggaaggtttttaaaaaggaaaaagctcgggtcctcccttaggaaaaaaaaaatttcaaagccttcgctagtttccgtttggcccgggccaacgcccggctttttggcatacgggcaaaaaaagccaaggaacccccagaaccggttttttaaaaaaaaaaataaagccctcctgggggcttggaatccgtcggcca

SEQ ID NO: 664572 - DNA, 240 bp, Homo sapiens
cccgggtttggggtttaaaaagggggggggcccccttggtttccccccccctaaatgagggcccccaaaacggggggttttttaaaaccccgggccccccccccccctttcaaaaacccctttttgcccccccccgggtatttcccccggggcctttgggggggcctggggttttcccgggattaaaaaaggccccccccccccttttttttccggttccaaaaaacggacctttttggg

SEQ ID NO: 664573 - DNA, 372 bp, Homo sapiens
cacgaggcgtcccagctcgggtagcggtcgtccagcgatttctgcagcgcacgcatcacgatgtcgtccagcaccggcggcaattcgggccgcagcgctgacggcggcaccggatcggcgtgcgtgatctggtacatcatgctgaaattgttgctgccctggaaaggcagctggccggtcagcagctggtacatcaccacgcccagcgaaaagatgtcggtctggtgattgagcgggtgttccttgatctgctgcgggctcatgtaggcaggcgaaccgacgccagacacctgggtttcggtggccgataccgacatcgcggcgccgaagtccgacaccttcacattggtgccgccgaccgcggcgccgtcc

SEQ ID NO: 664574 - DNA, 120 bp, Homo sapiens
gaagcgccgggagttaattcttccgccgcccccccaagaaagttcgctaaaggaatttaacccagaacccaaccccttccaaaggaaaaaaaaaattttaaaaccaaaacccaaaaaaaa

SEQ ID NO: 664575 - DNA, 357 bp, Homo sapiens
ccatttggtatttcctattacccccctcctattttaaatatttatcagtttaaacttgtgcagggtagtaaacatgcaagttgttatgattgagctgtattcccataagtagaattttaagtaaactggtgaatttgggccataaatgtttttgctttttgtttgatttttttttccaagccaactgttagaggtacacatttatttatctgttggccaaatttgattatgattttaatgtttgaaagattgcccttgtttgcttttactaaatgtggggtaaaaaaaattttttgttcccagtatatgaaaaaatggagtaatttaaccagtaaataaccattttgtggatgctta

SEQ ID NO: 664576 - DNA, 934 bp, Homo sapiens
ggtaagctttatcgtatatatattttttaaagaagagaaaaacaccttgagccttaaaacggtgctgctgggaaacattgcactcttttagtgcatttcctcctgccttgctgttcactgcagtcttaagaaagaggtaaaaggcaagcaaaggagatgaaatctgttctgggaatgtttcagcagccaataagtgcccgagcacactgcccccggttgctgcctgggccccatgtggaaggcagatggcctggttcgctcggtcaccggtgcctctcagaacaccagcagttaaccttcaagacattccactgctaaaattatttattttgtaaggagaggttttaattaaaacaaaaaaaaattctttttttttttttttccaatttaaccttcttacaacatagggtcggtgggagctttcctcaacaggggtatgggtcatctggtggtacatatggtctcttaactggaaccacgttttttttaatgaatctcttaatactttttttattattaaaacgcaagtttcttggatcctcaccctagatgggtataacggcctttgggccatccctttttctggtggttggtggaacacaacctgtaacatctggtggctttaggggtataagtgagagatggcacatgtagtgtatcactggagtattgaggtgttttttgcacaagaccctggggcgtggccaaatttgggtgtgtctgcggatgtgtgtgtttttgggcaacaaacacatggagctggtgtactcaattctataaactatattgggaaggaggaagaactggagggtatacccagtaaactaatttatatcgggggacaagagtagagagggtataaaaagccaacattttctttaaagatattaagcgtaggcagaacataagcggataggagtactgtacacattag

SEQ ID NO: 664577 - DNA, 157 bp, Homo sapiens
  misc_feature (141)..(141): n is a, c, g, or t
aggagtcttcaggccctggcacagcacacggactgcagcctcattgatgtcgttagtatgctaacctgtgagctccttgaagtgcggcttggcccttgagcacggatggccaggtgctcgcaagttggcagcctgagagtntgaaatacttccagct

SEQ ID NO: 664578 - DNA, 124 bp, Homo sapiens
catccgactattgggaggctgaggcgggaggatctgcttgacgcccacgctttgacgcctaccaggatgacgctacatgacatacgtgccaccatgcaccatccacgtgcatgggacgactacc

SEQ ID NO: 664579 - DNA, 198 bp, Homo sapiens
ggcgcgaattcactagtagattatacccggctcctgggtagcacatcatacaggtctcgtatctaaggcagccccgctcaggtctcaaggcaggctaggccacacagcccctgagtccaggggtaagggcctgccgtgagtaggattgaccccaaaggtcagcgactgggcagggagggccctgacctagggggaagg

SEQ ID NO: 664580 - DNA, 1348 bp, Homo sapiens
  misc_feature (410)..(410): n is a, c, g, or t
  misc_feature (645)..(645): n is a, c, g, or t
  misc_feature (778)..(778): n is a, c, g, or t
  misc_feature (1235)..(1235): n is a, c, g, or t
tcccctacaaaatattttttgggaacccaccagtctacggccctctttgtccaagccacttgtgacgctcccctgatctatcctccaatctagggggacccctttttcttcccccttgcttcttgcggaccctctttctatcaaatcttccagggtaccgggatctctcttggccggggaatccgccctcttctttaagagcctcgttctttcttttcccaggcttctttggcgatctcccccatgtaaaagaagcctcctctggtctcccggcctctctctttcttctctgggcggggtcacctaatgtagcgctgcgctggtcctggagtgtttgggctcccctatatttttttttccccacgtctctctctatatatcccccgagttttctctcacacacgcttctnttataacactttttgggggcgctgcgtctacacccctatctcttttctcttctctcacgcgagagagagagatcatcacgcgtaaagagtggtttcgcggggcgacagctggcgcccgaggaccctcccccacacgagaagagaaaacacccatcttctggtgacgagaatagtcgcggggagaaggagtcgtcctcctcccctaatattgtcggggggaggaagaagagacccnccccccgttggtgggtacagcacgcaagcgtgggggcctccgttggtggctgcccctatcgaagacggggaggaggacaccccccccccaaggagtaattggacggggcaaaactctcaccggtcgagggggncagccaccccctactatcacacgcagagaaatattcgccccgcccacagctggaattaaaacttcacaccagattcataaatcctccctggtgagaaaagaaaggggggggggggctgattggtgttcctcacatcctccccctgcctcccgccattttatttatagaaagttggcgcccacacctagttgaaagaaggggggggaaaaatcatacacgaatggtggggcgaccaacacacggccgttgaattaaaaaggcccacgacggtggtggtataatgagcgtcctatgtggtggggcggctctacccccatataataatacccttcccctgttctgccaggtggggtaatgataacttcccaccaattgtttgtcacgagctggtggcccgcccaaggattcttctgttacaacagcacctaatcaaaaggtggggcaaaaggtatggacntctccgttggcgacccagttgtttgcaagataggatgcaacaccatagtgtaggaaacccccccgccggttggtggcggtgggacaacaccaggggggtgcgtgcgacaacat

SEQ ID NO: 664581 - DNA, 882 bp, Homo sapiens
  misc_feature (3)..(3): n is a, c, g, or t
  misc_feature (346)..(346): n is a, c, g, or t
  misc_feature (360)..(360): n is a, c, g, or t
  misc_feature (429)..(429): n is a, c, g, or t
  misc_feature (437)..(437): n is a, c, g, or t
  misc_feature (442)..(442): n is a, c, g, or t
  misc_feature (449)..(449): n is a, c, g, or t
  misc_feature (464)..(464): n is a, c, g, or t
  misc_feature (472)..(472): n is a, c, g, or t
  misc_feature (498)..(498): n is a, c, g, or t
  misc_feature (501)..(501): n is a, c, g, or t
  misc_feature (503)..(503): n is a, c, g, or t
  misc_feature (561)..(561): n is a, c, g, or t
  misc_feature (576)..(576): n is a, c, g, or t
  misc_feature (592)..(592): n is a, c, g, or t
  misc_feature (596)..(596): n is a, c, g, or t
  misc_feature (680)..(680): n is a, c, g, or t
  misc_feature (701)..(701): n is a, c, g, or t
  misc_feature (713)..(713): n is a, c, g, or t
  misc_feature (717)..(717): n is a, c, g, or t
  misc_feature (725)..(726): n is a, c, g, or t
  misc_feature (740)..(740): n is a, c, g, or t
  misc_feature (744)..(744): n is a, c, g, or t
  misc_feature (754)..(754): n is a, c, g, or t
  misc_feature (820)..(820): n is a, c, g, or t
  misc_feature (849)..(849): n is a, c, g, or t
gtnaggaattcccgggatgaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaataaaaaaattttnagggtttaggttgnacaccagaacagaaacagaaaaaggcgcgcgttactctgctttccgaaggagaggtaagtttcctcaanacaagtcnccaanttcatgnttccttttcctcccncatttggnggagggcacacgctgcttattgctgnagncnagataccataccgggatacgggatcctgggggaccagggtcactgcattgttatctgnaagaatcctgcagcntgccgatacaatgcgnaccntcctcctttcaaaaagaacctgtgggttttcacgatgacccaaaatgtcacaaaagacacttgcgattccaaacagttggaatnggaaaagagagaagcatatantttcccagccancttncttttctnngttctctgtctccngganctggcctcanaattgtagaatggtgggtgtgggctgtccctcactggggaagaaagggtagtacagctgggatgtngagagacaacaatggttgaaactttaatngatggctctcaaataaccctatgaaaagtgctt

SEQ ID NO: 664582 - DNA, 168 bp, Homo sapiens
tacaactacattctatcatgtcctaaacccactgaacttgtgcctcattagtggggctcactgattttttgtttttgagggtctcgctctgttgcccaggctggaatgcagcggtgtcatctcgtgctcactgcaacctccctgggcaacagggtgagatactgtctc

SEQ ID NO: 664583 - DNA, 313 bp, Homo sapiens
gttccctgggggatccagggataaggaaaaagtggcctaaaaacaggtcttggattcacccccctggggggtccttttgggggaaacaggccccaaaaggggggggtggaacagggaactgccccttcttggggggcccgggggtgtgtaaaaaaaaactttttgttttccccttaagccaatgtattggggccggttgtttttttgaacaattcaggaatcaaggggtgtggagaaacccccccatgttgttggccacaggtgaatgaccctaaaccggggccatgaaaaaaaagccccctgtttctcccca

SEQ ID NO: 664584 - DNA, 244 bp, Homo sapiens
  misc_feature (164)..(164): n is a, c, g, or t
gggatttttagtattttaatataatacagttccaatcagtgtgtctggttcatctcagtttctttcactgccataaccgagggggcaggggactgctttcagttttctctgccctttctctattgtcagctgatgaccaggggtgtaaagggtatctgctgccnatcgagacttttaaactgtcacgtttgtcattattttttcttgatcttgacagatttggcatcccttctgtcgtcttctc

SEQ ID NO: 664585 - DNA, 305 bp, Homo sapiens
  misc_feature (187)..(187): n is a, c, g, or t
tgcccagctaattttttaactttttgtagaaagagagtcttactgtgttgcccaggctgcttgttatcccagctactcaggaggctgagacaggagaatcacttaaacccaggaggcggagattgcagtgagccgaaactacggcattggactccaggctgtgcaacagagcacgactccatctcanaaacaaacaaaaaaaaaagagtgtcaccttgggctacttggccagacacagagagcaaggagacatccctattatctgtcaaaaataattgttggggctgagcacagtggctcatgcc

SEQ ID NO: 664586 - DNA, 175 bp, Homo sapiens
gttgcaagcatggccattcatgcatctcaagcaggcaagtgcagtacaggcccccactccacaggcaggcagcttgtcccaatcaagcagttcaatggttgtgcatgtgcaggcaattcaggtgcaggcaccttcaagattcttgctctccaggcaccatcaatagcctacgggc

SEQ ID NO: 664587 - DNA, 893 bp, Homo sapiens
ttatggtgctgtctctttgctagcaaatgctctcagaccactgtggcagtgaatcatcctctaatttctatgattgctttttagaagggaaaagatacaatgcttccaccttaataattcgttgtaaagttattcgaactaatccgtggccgtccatatatgtgttctggttcgattcaccgtggattgatgctatctgaattcaagttataagcgtcctataggccataatttacttcttaaactcttttattattctgtgcacaaacattgggacgagagccgtttcttgaaagacgggtacattcgagcatacagaaagtatctgaagtaattaatgatggttcaccaagcatggacatgctgtacatgaagctatgactagttgcttcacaatcccactgtaagatgccagtgtcttcatctcttcatgaagggtgcctagcaggaggtatacagtatgtccagtcacactggaatagcatgctcgattggaaacaaaggatctatctctgaacaagctgtttggcgatgaaggagattcttcgtgttgtgttcaacgatgagtccctctccccttgtccagagagaaatgccagttgtatcgaacttaagtgccttttgtccggcggaaattggatgcttaacctgattcttaattcgagcgggtaagggcccgagatcatgttgctgtcgatttcaaccagtgttgatctccgaaattcaagaacacggaataaagatctgcgatgccatacagatgctctggtgtcaccaccataagtggggcatcctcacaatgcaaaacagccccggtgcagggtaccattgctgatgacttactcgtgtatactcaagcgcatcgggagagttgggcaatttcagaaattggc

SEQ ID NO: 664588 - DNA, 732 bp, Homo sapiens
caggcctttggctccaggacttaccccagtggccaccccgcttctcaggctttgagactcaggctgcattactgcaccagtgaccctgctgctccagctcacagacagcagattccaggacctcccagccttcatacttgcatgagtcaattcccacataaatcccatcttacgcagctggatggagcctattggttctgtttctctgggaaaccctaatacggacccatagatacaaaatcttctatatgcttcttcctcggagaagatccctacatcttttatcctctcagcgtggccttgacgcccattctaaagcaaggggagaggttctagtgaggaggaaatagcatggggaccaacaggatggcacgctaggccttcgatggcccttgcagaatgtccagcacgactgccaagtgctcgtcaggtcttttctggactgaggacatctctctcaagcctgggctctcctgacgctgccttggcaagctctagaaggcagccccatcctctggattaatccgccctgctaaatgttctctctggcatgggattcactactgcctaaggccaactcagccttgagagtctgggtccatactattgttgactgcaattagaaccacatattagcaaatgctagcttttaaaaattacaggtacaggcagacctcagacatactgcgggttgagttcccacagaatcataataaagtgaatattgaaaaa

SEQ ID NO: 664589 - DNA, 216 bp, Homo sapiens
  misc_feature (10)..(10): n is a, c, g, or t
  misc_feature (47)..(47): n is a, c, g, or t
  misc_feature (58)..(59): n is a, c, g, or t
  misc_feature (64)..(64): n is a, c, g, or t
  misc_feature (66)..(66): n is a, c, g, or t
  misc_feature (86)..(86): n is a, c, g, or t
  misc_feature (101)..(102): n is a, c, g, or t
  misc_feature (120)..(120): n is a, c, g, or t
  misc_feature (145)..(146): n is a, c, g, or t
  misc_feature (154)..(154): n is a, c, g, or t
  misc_feature (165)..(165): n is a, c, g, or t
ataaataagnctgttaaagttttctggacaatgccagcatttggaantttttaaaggnngtaangntcttattgatggcaactaangggtgtttgtagcanntttatcatacagtagatnccagccattcactatacttttctanntgagttgncctacatgcangtacatgtttttaatgttgtctgtcttctgtgctgttcctgtaagtttgct

SEQ ID NO: 664590 - DNA, 133 bp, Homo sapiens
cagcaagacaagtcaagcatctgatttgttactggatcacttcagtctgctctaaaccagctctctctcagggctgtctcttcttccatccccgccactcccattctcctcttctctttcttcccatttttcc

SEQ ID NO: 664591 - DNA, 1130 bp, Homo sapiens
  misc_feature (28)..(28): n is a, c, g, or t
  misc_feature (72)..(72): n is a, c, g, or t
  misc_feature (89)..(91): n is a, c, g, or t
  misc_feature (143)..(143): n is a, c, g, or t
  misc_feature (269)..(269): n is a, c, g, or t
  misc_feature (657)..(657): n is a, c, g, or t
  misc_feature (899)..(899): n is a, c, g, or t
  misc_feature (980)..(980): n is a, c, g, or t
  misc_feature (993)..(993): n is a, c, g, or t
  misc_feature (999)..(999): n is a, c, g, or t
  misc_feature (1046)..(1046): n is a, c, g, or t
  misc_feature (1056)..(1056): n is a, c, g, or t
  misc_feature (1065)..(1065): n is a, c, g, or t
  misc_feature (1099)..(1099): n is a, c, g, or t
tgaagaatggatggcaatggcttgacancccccaggattgaagatataggtgtgataactactgcattagtngctcccagcctggattnnntttccagctgcagggcacgatcctacccttctcttttcctctcacagaagtngttctgggcaagaggaagcatgaacagctggtcccataggatgaattgaagcagcaaatctcctagagaggttaaaagtatgtacctcgctaggctgcaagcagcccaaggaccaagggatttatnatctgcaaaagaatcttggaggtaattggtaagggcacgaaaacagtgataacatctttaaaacatctggggtgctggtgaacttggcagaagaaaggattaaaaaaggtaagaatgggggaaggggatgggtccttacagggtattaatccagattagatgttaaatataagtatcttggttaaagtattgtaagtgggtatgaatgtgagggaagaaggaggaggatgatgttaggggaggggacaataatggataatgaaatggaatagagataattaggggataatttagagggcaatacctcctaagtgcactggaagtgtagggaggggtaagttggggataacacaaattaaatggggaatgagaggagcaactgaaagtntcaaattcaggctatagatgggaccccagccccccatactctcccgtcctacatgagatgggcagtggagggccaggacagcaactccaagccagtgtaggttttggaggtagacagtgaggaggcttgcttctgtcctttgttagctgagtgcccttggacagcttacttacctactctcagcctcagtttccccatctctaaaataaggctaccaatacctaccttctctggccattgtnaggatgaatgaaagagctctgaaagtatttctgtaattagcagacatcagagattgttattctccaaggtaagaggccccntagatccctggcnggtganagtgttaagattctttttccctcctctgcggtgcccgctccttttcnagccttgtgnctgcctctnatcctctcttttcgccaacccccactcctccttngggacaccttgcggcgcccagcttcttgcac

SEQ ID NO: 664592 - DNA, 223 bp, Homo sapiens
cgagtgtgagaactacaacctggtgcatgatgtgaaccacaacatgtgcagaatgtgaacacgcaccagtgcagagggaaccactgaccaggttgatgagaactgcaacagtgcagatgggaaccacaaccaggcagagggaactacaaccaggcagagggaaccacaacaggcacgggtgtcacagcacagaaaagttgtcaaggcaatccatccacctgag

SEQ ID NO: 664593 - DNA, 111 bp, Homo sapiens
gtcgagactttccggaggcctacaagcccacagtgtacgagaacacagggggtggacgtctcatgatgcatcagatcagcctgggcctttgggaaaaaaaccggacaatga

SEQ ID NO: 664594 - DNA, 903 bp, Homo sapiens
  misc_feature (36)..(37): n is a, c, g, or t
  misc_feature (40)..(40): n is a, c, g, or t
  misc_feature (56)..(56): n is a, c, g, or t
  misc_feature (623)..(623): n is a, c, g, or t
  misc_feature (658)..(658): n is a, c, g, or t
  misc_feature (770)..(770): n is a, c, g, or t
  misc_feature (777)..(777): n is a, c, g, or t
  misc_feature (785)..(785): n is a, c, g, or t
  misc_feature (790)..(790): n is a, c, g, or t
ttcatattttacgcaaatgtacagccacaagacaanntancgcacgacttttattnccaccgtcagaaaacaggcccccacacaggaggagaatgacacaatgaacccacatttcaagctggtttccaagtgtttttggagtctcggcttttgacaggtcccaatgctactgtcaagaggaggtatggccagatactcaaatttgctccagactttgctgtatatcagatgatcccatgatgcttgcagcctggaacagttccttataaagggagagaggggacaaaatcacttatgctgaagcaactttaagcaatacactgaagatttcaagggaagtcagagactgcatcagagaaaaactggcatacaaaagattctgctgagtactgaaggcaaaattggactgagccagatgaaagagtattataataataagagtggtcccagcagagaagacaacacttgaggaagaagaaagtatgactgataatatgctcacggccctgcaaagtctcactttgtctcccaggctggagtgcagtggagtgatcttggctcactgaaatctccaccttctgggttcaagtgattctcctgcctcagactcctgaatagctganactacaggtgcccaccaccatgcttagatgaacanttgaagtttttagtttaacttgtccaggattccgtagctacatgaccaagatggattcaaaacctgatcttaggatgccaaggccaatggctttctttatttcaagctgacntttgggnccatttgngtaanaccttcccagaaaaggtcccagtctatacccccggagaagaaatgctagtttcccaaaagtttcaataaaactagcaaggaaggttccaaaatttctgaacctagagagggag

SEQ ID NO: 664595 - DNA, 891 bp, Homo sapiens
  misc_feature (36)..(37): n is a, c, g, or t
  misc_feature (40)..(40): n is a, c, g, or t
  misc_feature (56)..(56): n is a, c, g, or t
  misc_feature (520)..(520): n is a, c, g, or t
  misc_feature (632)..(632): n is a, c, g, or t
  misc_feature (639)..(639): n is a, c, g, or t
  misc_feature (647)..(647): n is a, c, g, or t
  misc_feature (652)..(652): n is a, c, g, or t
ttcatattttacgcaaatgtacagccacaagacaanntancgcacgacttttattnccaccgtcagaaaacaggcccccacacaggaggagaatgacacaatgaacccacatttcaagctggtttccaagtgtttttggagtctcggcttttgacaggtcccaatgctactgtcaagaggaggtatggccagatactcaaatttgctccagactttgctgtatatcagatgatcccatgatgcttgcagcctggaacagttccttataaagggagagaggggacaaaatcacttatgctgaagcaactttaagcaatacactgaagatttcaagggaagtcagagactgcatcagagaaaaactggcatacaaaagattctgctgagtactgaaggcaaaattggactgagccagatgaaagagtattataataataagagtggtcccagcagagaagacaacacttgaggaagaagaaagtatgactgataatatgctcacggccctgcaaatgaacanttgaagtttttagtttaacttgtccaggattccgtagctacatgaccaagatggattcaaaacctgatcttaggatgccaaggccaatggctttctttatttcaagctgacntttgggnccatttgngtaanaccttcccagaaaaggtcccagtctatacccccggagaagaaatgctatttcacaaagcttccataaaaactcaagaggaatgggttccagagcttctggaagcctgaagatgtggaagactctggagggtggtgcactcaggaagggcatggaagttttgcacagctgtctccatgcctcatcctccacatgtctttacatctggatcctttataatatcctttacaataaactcaga

SEQ ID NO: 664596 - DNA, 164 bp, Homo sapiens
cattttttttttccccccccttttaaaaaccggttaggggagaagcccccttaggaagcctggggtgcccaaaatcccatttaattccatttcccctttttgcaggcggtttgggggtagggcccctttttttttgccccccaaaaaaaaagggttttttttta

SEQ ID NO: 664597 - DNA, 768 bp, Homo sapiens
gaagtgcggctgattgacttcttgctatggtatacctctcactcctgcctggtgttccaacccgttctgtggccatagtattcattttggaccctcttcgagcgctcattcctgtcgagttccagatgaatccattagcgtgcttcagtaaggcccgtagacagtgtatgcagagtgagcgtaataggctgcacctggacgagggactcagagctacacgtagtacttggatgcagtctgctgctgagtaggggctctcaatgcctacgttgggtgactgcccgagcgtcctattagtgacaccgcttgtacatgactctcgggaccagcactgccccgagcgagtccaaggccttctctgcaggccttggacattcaatcgagctgactggcatgggcccgatctggggactactgtccagtcggcgtcctgaaactgatgcctggttcgcctcgtgctgcttgtgctctgccctctgcctccatggttcctctcgccttccttttcttggtgtaaaggtaccttcctttgctgattgtgaatggtgtcccctttgcttgcttggggagcctcccccaggcccaggtttgctgctccatatgatgacttggggctgcctgggacaggctcctgaggaggattggaacggctgaacagtctcccagagtccgctaaagctaggtctgctcccaatagggattggaaagcaagggccaaaatttcaccaagaataatatgttaataccgacaacttttggccggaacct

SEQ ID NO: 664598 - DNA, 154 bp, Homo sapiens
tagcggaccttgggtgttggtccagaaatcacagcagggacttagtatccttaatacaaatggaaacattaagttcatcatcagatgataaaaggaacaaaaaaaaacctgatactcatctcaaaagacataagaaaacacataaccaagcaac

SEQ ID NO: 664599 - DNA, 104 bp, Homo sapiens
agcggggttcgtggactgcttctgactgcgccgcctgtgacccgcaccccgccgctctcccgcctgcccgtccccgtgccgggctgcgaaggtgtcccctgtgc

SEQ ID NO: 664600 - DNA, 179 bp, Homo sapiens
gcaagaaagcaccaccatacctggctaatgttttaaattttttgtatagatggggtcttgctattttgcctaggctggtcttgaactctggggctcaagtgatcctccaccttggttccaaagtgccgggattacagcatgactgtattctatgaagagtccaatgcttgttttaatgg

SEQ ID NO: 664601 - DNA, 116 bp, Homo sapiens
cgacggagagacgacaacgactgtgtgtctgattggtcctgggatttttgagctgtgccatttatggtactcattgcctatgcatcccctttttagattttttttaaattttatct

SEQ ID NO: 664602 - DNA, 698 bp, Homo sapiens
  misc_feature (11)..(11): n is a, c, g, or t
  misc_feature (70)..(70): n is a, c, g, or t
  misc_feature (93)..(93): n is a, c, g, or t
  misc_feature (107)..(107): n is a, c, g, or t
  misc_feature (113)..(113): n is a, c, g, or t
  misc_feature (123)..(123): n is a, c, g, or t
  misc_feature (160)..(160): n is a, c, g, or t
  misc_feature (172)..(173): n is a, c, g, or t
  misc_feature (175)..(178): n is a, c, g, or t
  misc_feature (182)..(183): n is a, c, g, or t
  misc_feature (186)..(187): n is a, c, g, or t
  misc_feature (189)..(190): n is a, c, g, or t
  misc_feature (192)..(195): n is a, c, g, or t
  misc_feature (201)..(201): n is a, c, g, or t
  misc_feature (203)..(203): n is a, c, g, or t
  misc_feature (205)..(207): n is a, c, g, or t
  misc_feature (210)..(211): n is a, c, g, or t
  misc_feature (213)..(214): n is a, c, g, or t
  misc_feature (251)..(251): n is a, c, g, or t
  misc_feature (255)..(258): n is a, c, g, or t
  misc_feature (260)..(260): n is a, c, g, or t
  misc_feature (270)..(270): n is a, c, g, or t
  misc_feature (272)..(272): n is a, c, g, or t
  misc_feature (290)..(290): n is a, c, g, or t
  misc_feature (292)..(292): n is a, c, g, or t
  misc_feature (303)..(303): n is a, c, g, or t
  misc_feature (305)..(305): n is a, c, g, or t
  misc_feature (318)..(318): n is a, c, g, or t
  misc_feature (324)..(324): n is a, c, g, or t
  misc_feature (337)..(337): n is a, c, g, or t
  misc_feature (340)..(341): n is a, c, g, or t
  misc_feature (366)..(366): n is a, c, g, or t
  misc_feature (371)..(371): n is a, c, g, or t
  misc_feature (379)..(382): n is a, c, g, or t
  misc_feature (389)..(390): n is a, c, g, or t
  misc_feature (394)..(395): n is a, c, g, or t
  misc_feature (400)..(400): n is a, c, g, or t
  misc_feature (412)..(412): n is a, c, g, or t
  misc_feature (418)..(418): n is a, c, g, or t
  misc_feature (426)..(426): n is a, c, g, or t
  misc_feature (428)..(428): n is a, c, g, or t
  misc_feature (432)..(432): n is a, c, g, or t
  misc_feature (438)..(438): n is a, c, g, or t
  misc_feature (441)..(441): n is a, c, g, or t
  misc_feature (444)..(444): n is a, c, g, or t
  misc_feature (453)..(454): n is a, c, g, or t
  misc_feature (456)..(456): n is a, c, g, or t
  misc_feature (460)..(460): n is a, c, g, or t
  misc_feature (465)..(465): n is a, c, g, or t
  misc_feature (488)..(488): n is a, c, g, or t
  misc_feature (498)..(498): n is a, c, g, or t
  misc_feature (511)..(511): n is a, c, g, or t
  misc_feature (536)..(536): n is a, c, g, or t
  misc_feature (552)..(552): n is a, c, g, or t
  misc_feature (562)..(562): n is a, c, g, or t
  misc_feature (576)..(576): n is a, c, g, or t
  misc_feature (583)..(583): n is a, c, g, or t
  misc_feature (611)..(611): n is a, c, g, or t
  misc_feature (697)..(697): n is a, c, g, or t
ttccgaaaatntccacagcctcacgcctacctgcccttaccctcagctcttggctgggtctcccactatnccccatccctccttccctcagangctgggtgccaganggtggntgagaagagnttctcaaagctgggcaggtcccaggaaaagccacttnatcgacctgggnngnnnngggnnggnngnngnnnngggttntntnnngtnntnnttttgggagccagatgaaatgaatcagaaaagggganaaannnnanacgactgaantncccaaattgacttacttntnccagaggcgananttataagcaaggncacggnttatgctctccgnttnnggagtgatggggggaggtaggttgnttttntttgttgnnnnttatttnncacnnttcanatattttatttngttgcnccaagttncnatgnagaagnggnttntgctggtgnntnaggncgcanatgttgctttagctgccgtcccntgggcatctngccgacaagactnttttattgcaggtgcgttctcttgntagtgtggtggggccnattttccctntccccaccctttanctagtcncagcatggttctgaacaaaatgaaagtnttaagggccatagaggggaaagaaaaaaaaagagaaccagcacattacaaagcgaccatccccacatccattcctaggacgggctnt

SEQ ID NO: 664603 - DNA, 117 bp, Homo sapiens
tctagcggatccctctcctacccacgatccaatagggatgtggaacaagaactttgtgacagttttcttgtaccacatacctattggatcgtggtagtaggtcgtgaggtaggaggt

SEQ ID NO: 664604 - DNA, 712 bp, Homo sapiens
  misc_feature (349)..(349): n is a, c, g, or t
  misc_feature (462)..(462): n is a, c, g, or t
gtagctgctaagaaatttaaggacatcatacattatgatccaacgaagcaagaccatgccacttacgaaagaaaaagagatgataaaccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcanacactaaagacataaaggaagagacctacagagttgaaacagtgaaacctggaaagattgtctggcaggaagaccctcgtttacaagacagcagttcagaagaggaagatgtnactgaagaaacagatcacagaaactccagtcctggagaagcatcattacttgagaaagagaccacagaaactccagtcctggacgaagcatcattacttgagaaagagaccactagatttttctttttctctaagaatgatgaacgacttcaaggttctgacttattctggagaggagtaggaagtactatgagcaggaactcttgggaggccagaacaaccaaactgcgtatggattgtcgaaaagaaa

SEQ ID NO: 664605 - DNA, 182 bp, Homo sapiens
  misc_feature (114)..(114): n is a, c, g, or t
  misc_feature (143)..(143): n is a, c, g, or t
cgagagatgcgttgactccttgatctctgcgccagccttggttgtgctcgcctgctgtctgcacgtgggtgtctgcacgtgggtgtcttgcatgtgggtgtcttgtgccctcanagtgtctctgtgtctgcacgtgggtgtcntgcaccctcacgtgtctcgtgtccgcacaagcatgtgta

SEQ ID NO: 664606 - DNA, 300 bp, Homo sapiens
ttacaaattacatattcataccaattcttattacagaatgaagctgttattctactataagcatttttcatatggtaaatattttgatccttgtggtagccctgatgatatacatactatcaatagtcacattttataggatgaggaaactaaggtacagtcaggttaagtaactattcctagaaatcaagataccatcatataccaggaaaaggatggagctggaattcaatcaaccattctgactgcggggcccatatctatgactatacatattgactgtaatttggattggttgcg

SEQ ID NO: 664607 - DNA, 432 bp, Homo sapiens
  misc_feature (109)..(109): n is a, c, g, or t
  misc_feature (418)..(418): n is a, c, g, or t
tatagatggtgtcttgttttgttgcccaggctgatcttgaaatcctggcttcaagtgatctgccctgcctgggcatcccaaagtgttgggatcacaggcatgagctacntgcagccggccaacttttggctgcttaatgtactgtaagtgaagttgtttgtttatgatgtgaaccttacctcttagcccatttgaagctggaaatgcaacttagcactattaggcctactctccctatctctcacctgacattacttttctcattcctctcttgggcataaaatattacatctcttcacctccaattggaacagacttatgtttaaccgtaggaaattccagacaggaagtacttccatggaaaaggggccggtggaatgagatgtgtttgacagtttggctgtggcttgtgaagtangaaccagaatagag

SEQ ID NO: 664608 - DNA, 630 bp, Homo sapiens
  misc_feature (12)..(12): n is a, c, g, or t
  misc_feature (128)..(129): n is a, c, g, or t
  misc_feature (132)..(132): n is a, c, g, or t
  misc_feature (141)..(142): n is a, c, g, or t
  misc_feature (145)..(145): n is a, c, g, or t
  misc_feature (147)..(147): n is a, c, g, or t
  misc_feature (207)..(207): n is a, c, g, or t
  misc_feature (345)..(345): n is a, c, g, or t
cagcacactganttgcttcccagcctccagaactataagcaagaagtttttttatagtaacaaatttattgttcacagttcttgcttataaactttataaaccagactaaggcatttcgttatagagnnccncggctatannttntnctagaaatgtgacactggaatgatgtggctctcaagatgacagtgttgcttctgaatgtntatgttcatgtcatctttaattgcatgaacaccagttttagcatcttcccttgagtagaaagagattctctacagcaagtattacgtaagaagtactggtggccaggcacagtggttcacgcctgtaatcccaacacnttgagagcggagccagaggtatcatttgagcctagaagttcgagagcagcctgggcaatatgtctaaaccccatctctacaaaaaaaatacaaaaatgaaaaagccgggtgtgattgtgtacacctgtagtcccagcaacttgagaagctgaggtggcaggattgcttgagcccaaggggagggttggcggcagtgggtggttcgaggctgcagtgagccatgattataccagtgcgctccagcctaggtgacagagcaagagccggtctcgattatgtgataga

SEQ ID NO: 664609 - DNA, 130 bp, Homo sapiens
gaaactgtccaagcacatggaaattatacaatatgctcctatatgactagtgggtcaataaagaaatttaagataggaaagtgataatcattttgttattgtataataaatttttaagtagaaaaaaaaa

SEQ ID NO: 664610 - DNA, 471 bp, Homo sapiens
gatcgttatacatcccggaacatatgtatgcacagagtttcggatatcacctggtcggaacgctcatacgcggaaacgcgatatcacatagataacatctgctgcgacgtggccgtgttaaccgcggacaggccaggatgtaggcgaaaccgtacgagtcatccgcgttgagatgccactcctgggtgcctcacgcgtgtagatggcctgcagcactcatcacgcgacagagcgagcaagaatttggaagattccagtgatgtaaaacctgccccccttggtgagggtgaagagttggcgagaagaacaggaacagagacagaatgctgaatatgatctgacaggatcatggtggcctggactgactgcagccattcgtttggtaatgatgagaaacagaggtggacacatcccaaactatcccttgctcagaagaaagatcaggtaactcaaaagaaggcaaactccctc

SEQ ID NO: 664611 - DNA, 318 bp, Homo sapiens
  misc_feature (313)..(313): n is a, c, g, or t
cgatctcatacacggatccccttcgtcgaagaacaacggcaaagacaggtatgacctctcctgcgggtgtagcccttacggtcgatcttgtggccgaaaggcagactaggccacggtttacagtaccatgatcgggcaaccttttcccgagcccccgcttgaggtgccaccagggctggcgcgctgatatccacagcgctccatgacagtgaacaccttccttgcccggcgtgctgggacccatggcccggctgcagggtggcctctgatacagtatccgcacactaccgtgcccgttgttccttcgacgaanggtac

SEQ ID NO: 664612 - DNA, 542 bp, Homo sapiens
cagccacacgtgtgggagtgagaatctggcagtgagctactgtccaccagcaaggcactgtccaggcagtgggacaccatgagacacgatgtgccgtcgaaaacactgagatagactgttaagtgacaaagttcacagcagcactatctgtagcagatgaaagatggaagccacccaaatgtccccccgctaagaatggataagcacaacgcgctcagtccacacagtggaggacaattcagccataacgaggaaagcagctctgacacgccacagcacggatgaacctcaaaaatgacgtggggtctaagatcagaccccaaggttgcatacagtgtgatttcatcgataggaaatatccagaactggcaaatccacagaggcagaaagcagattagaggctgccagtggttgtacctgcagggagggagggcagagacaagaggctggggagagacctgccaggtgcagtcacctcaggaaggtggtgaaagtgttttggaacaaaacaggtgatggttgtacaacactgtcatgatttt

SEQ ID NO: 664613 - DNA, 402 bp, Homo sapiens
tcatgaaggcatagaagaattgtcatcgcccatctcctttctgtggataggcgggacaaggccggcccctggcctggggcctgggatgcgagggctctcatagcttgtacatggtgacggtttcagttccttgtcctcagtcgtggcctggaccgacttcacgaggtcttgggtctgcagcatgctcatgttccaggacgccacgtagttgaggctctcggccaccgaatggtcgcgggaatacagcaggttgaccttggtgctctgcaccgccacggggctcttgctggaaatctcggctgccagcgctaaggcagcatccagcatgacctctttgtctgggaacacccggttgaccagcccactgcccagggcctcgtcagccatcatcttgcagttcgc

SEQ ID NO: 664614 - DNA, 230 bp, Homo sapiens
atgatcatttgcccgtcttcccacattccttagcatgacccatgctgcatcacagacctcgccccaaagcttcatatataaactaaatgtaacgtatctgctacttcttcctgctccataaccagctggtctctgtggtagttatgcggtcaggtatagatgacagtcatcacttctctgggaaggagaagaagagtgggccaggatgaatattggtagaagactaggtg

SEQ ID NO: 664615 - DNA, 770 bp, Homo sapiens
  misc_feature (17)..(17): n is a, c, g, or t
tatacgctagtaaggcngggtgaatcggccgaggaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaa

SEQ ID NO: 664616 - DNA, 211 bp, Homo sapiens
tttcaaatgtccttagttgacggaagggatccattcagatagttgagcaagcattcaaattttatttgtggtttacattagtgataacaggagcctgtggagatgctataaacctctgttttttctcttcttttctcttgttttttttttttttttttttggaaacggggtctcattgggtcccccagggaggaggctcagggtcggcggg

SEQ ID NO: 664617 - DNA, 736 bp, Homo sapiens
  misc_feature (17)..(17): n is a, c, g, or t
tatacgctagtaaggcngggtgaatcggccgaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaa

SEQ ID NO: 664618 - DNA, 185 bp, Homo sapiens
ctcttcatcctccatacgttactaaagctatgccaacggcaagaccacgcagaatcttctcatgtggagtttctggttgcttaaccaaccaggtcctcaatagccggagcttttttagagcccaacataactaaacctagggccaggccagcggcttccccgggggaaaagtagggtaccgagct

SEQ ID NO: 664619 - DNA, 691 bp, Homo sapiens
cccacaaaaagcccaattggtagagacatgcccagtccaaccaggggcccctcgtgccaacggcacgaggcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaa

SEQ ID NO: 664620 - DNA, 905 bp, Homo sapiens
taattcagttattgtggacttggcctgtatcttttatatgctagttgtacacgttggacgttcagattgacacagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactgactgatttcaccaacacataggaagaaggcttgggtgctcaatttgcagtgggagtgaagccccaaaagaagtcatccatctcatgcacaacactcatgcttgatagaccacacaatgtacagacaataggtgttgtagaacccatgagaacgctacagaacacacaagatctctaagcattctattcaagacaaaagacactacacatgacaatcaaccaaaactgcctaaaagaacacccacatgtgtccacacgggatccattactcaatgaaccacagctatttgcgtaattctgatgagacaaaggcaaatccattgagacaaccaagttacaatgacccagtacacattgtccagacaccagcaatgcactggttgaacttggaccccatatcagagggacaaatacagtttgagcgtatgacatgagccgactgatggacatcatccgagaagagatacatcaccctggatcacaatacatgacgcatgcaccaaagagactaaggacatagtattactc

SEQ ID NO: 664621 - DNA, 214 bp, Homo sapiens
  misc_feature (151)..(151): n is a, c, g, or t
ataacttgtccattgtgaaccctggtcacagtgctctggggctttcaaaggcacctcgcatgcctttttgtagcctgtcagccccagcatcatggacacatcatcttgttgatgcggagttacgtgcaaggggttgcgagccgcaccccgngatatcgcacacgccatctttgtccacagctttttaccatgtacctttttgtgctcacatatt

SEQ ID NO: 664622 - DNA, 1084 bp, Homo sapiens
  misc_feature (539)..(539): n is a, c, g, or t
  misc_feature (570)..(570): n is a, c, g, or t
  misc_feature (619)..(619): n is a, c, g, or t
aggcagtggtatcaacgcatagtgtcgaattatggccgggttgatgttcgccgatcgttgactattcctctacgctatcagtacaagacaattggtgacatattactatccatatgtagttcgagcgtcaatgatgcgtggatgatgtctagcgctaccagtatccttagagacttccctatatatcctagcacgcaggctggagcacaagtcaggcatagccttcattatggtaatcgaccaacatgtaacagtgaatactcgtttactgcacacagtgctgtggagtaattaatactttcttacatagttgataagccatgcatatttgcggggagttattggcaaaaatgtattgagttcacacctaatcaatcgggggacccctcatattttggaagtccccactcgaccattagtcaaagattaggctatcatgacgcttgactctccactttcatcctaacgtacctgcatcagctgatctgcctcaatagtgcggatggaccgtgttagcaaagtgacacaagagttggacnataagttcataactctcttctccgttggacnagtggaaatcttacatgctcgcaaccacttgagtaggacacatactcgntaggaactccataagacttaggtcttcattcctctatctatcacttcatgcagtgatgtgcatcctcgtcttcatgcgtataaaggaggcacctttctcacatttcactccaagctaatctaataaatactaattatggagaacaccgccttctgtccaataaaaccccgaattgaacccaaaatttgcaccacatcattgcgttacttatgattcccggtacttataaatacagcggggtagggtctctaatatataccttaatatgcttcgcctagcgccttgaagactggctggggcaattctatttggatatcttactcttaacagaaactccgcgtaaacttctaaatcagagacttgtgttttggaacccccgccaggaagaggaaagggaggatccccatgtgttattgcgaactgattttggagttttttcgggcgaccccctggtggtgtattcgg

SEQ ID NO: 664623 - DNA, 1585 bp, Homo sapiens
  misc_feature (258)..(259): n is a, c, g, or t
  misc_feature (269)..(269): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaa

SEQ ID NO: 664624 - DNA, 708 bp, Homo sapiens
gagagagagagatagagagagagatagagagagagagagagagagagagagagatagagagagagagagagagagagagtgtgagcttgtgctcctgcgcctcagctcctctcgcatcttctcctgtttgtgctttcctctttcccttcttaccctcctgcaccagccccattctcctgtgctctccaggcctatggctatgtatgtgctcatattacacgtatcatgatttccattttctatgcactcgtacctgtcttcatgtcccttccttggtgacagactcttcttctccttattattctgtgctctctgtctctgtgcatcctcatctcctgtaatctgtgtcttgttaacttgtcttttacttcccacacctcatctcatactcccctgttattccatctcccagcttatcatcccctgtccttcattctcctttacgcctgctttaccatcctcacttctctgagtttttcttttatctttccatttccctttatttgcctcttcctttccttcccttctcctttttgttccttctcttcctttcttgtattcttctctctcttcgttctctcccctttctcaccttccttttcccctgcctctctcttgcttccttatctttgctcctctttgaccctctttttcctttttgtcttccctctacctgccggtttctttcatgtccttgttttctttctt

SEQ ID NO: 664625 - DNA, 1268 bp, Homo sapiens
tttaggatatcgagaccggatccacgtgactgcgatacaccactgcgcaaaatgtgaagagtctgcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaa

SEQ ID NO: 664626 - DNA, 1422 bp, Homo sapiens
tctccccagcgccccccccctatcttttttttctttctagagaagaacaaaaagagtggaggggagagaggagggggggggggagggaggcaggaggcccaaacagcggcggaacaataacagagcagtggcgcggggggacgggagccaaacaagcaggcgggagctgaaaaaccaggcagaagaatcaaacagacaggagggcgcgacacccactcccaccgcgccaaacacacccgcgcgaaagacaagcggaacaagataaaacacgagaatactaagagggggagcacttatagacaagagagcggaggggaggccgcgaggagagaagaacaacactcacgcctgggaaggaaatacacgaggaggagaacacgatgagggagagggggggagaggcgcaccaccctcgcggaggaagacgagacacaagagacaagatatttagcagaagagagacaacccagaggaagaaaaacaaagaggacgggaagccaccagaagagaaagagggaaggaccgaagcgaaacggcgagcagaaaactgagcgaggagagagactcccaccagagggagagagggagcacaaaggaagagaacagcaaatatgacagaggcgccccccacaacaaagcaaagaggtgagagagatatatcagacaaacaacacacgagcgccgcccggccaagacaagagaagcgacagagcgagaggagaaaaaaaaagaggagagaaccaagcaagagagcgtaatatcagcacggaaacgacgagcagaacgaacacacgcacggccgcaacgatgaacaagaattgcgacgaaaacacacctagagccggcagagagcaaacaaagagagagcacaaagatcaaacgagcgggccacagaacacgcactcatcaagcgcaccacacacacacatcatagggaaacacacaaaagcatcaaaagcaacggaggagaagaaagagaaaggagaggacgaacacccacaccgcagagagggcaagcagacaacaggaaagggacgtaggaacacccgaccaagacaacgccgaaggcgaagacacaaaagaagaagaaaccacggcaggacagcagtgaaagaacaagagcaacgagagaccaggggcaggactcaacacaccgacagagaagagcagagcaatcaatacgaaggagacagcagaaggaaggacacagacgagcacgacgaagagaaacaaaagatgagagaccgaacaagctgagcgaacaaccaaaacaaaacagaggagcagagtagagcggagagaggcgacaaacaaaatagaagcagaagaatagctcaaacacgaagaagcagggcgaacaacataaagaagaagagaaagagaaagataaaaaccgacgcaaataaagtacaagaaagaccc

SEQ ID NO: 664627 - DNA, 313 bp, Homo sapiens
acaagactacataagaccaccagtctaagtctagagaacagtcacagcatgactgaatcgcacatacaaaaaagctttcagaaatagactagaatctctaaagagtaggtgtacacatgccatgtaatacatagatttccacttaatggtacaacagaataataagctattcttagcatttatgtagtagtaaaagtcaatatacacattaatataattcctttcttcaaaatcttatacctaatctgatatatctaaaaatagcacatgtaagtcatgtgtataacatgctatagaaccttctaaaactagg

SEQ ID NO: 664628 - DNA, 378 bp, Homo sapiens
tgtagtgaggacgtagggagcgtggccgctttcccaggcagctgtagggtgtgaagcagcacaggcctgacacagacagtggcagggctctcaaaaagccacttgagtagagtgagggctggcgacacagcagagttcccaccctgcttccatgctgggctgggccacatggaaaccttccaggtgccttttcccaggtgccactgtaccccttcacttgggggcacctctccctggcaggtactagtcttaccaatatagctgctggagacagaagagaactgagcacaaagggaaagtgatctgtacacctcccattcatggaatggtggccctgctgtgtgtcttccctccgatcacgcttatagagcaccatgg

SEQ ID NO: 664629 - DNA, 1272 bp, Homo sapiens
tcggggacgcgccggcgccggcgactcgcgcgcgccgccggcccacgcgggacccaggggcaggggcggcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaa

SEQ ID NO: 664630 - DNA, 270 bp, Homo sapiens
ttgtttaattcgatcattttatccaccttgtgatattcaataagttaagtataacacaacatgcgcctaaggtataattaaataatatgtacatcgccgtctggctgaatcaaaccacgtccgactttaccgcttaacccttgtacacggcttgtttgtaattatagggaccacctacacgcccatgacaacgtgcaagccagaaaggaggagtaccacagacggaagttggtactctcttattatatcacttatgattatatcttcaat

SEQ ID NO: 664631 - DNA, 409 bp, Homo sapiens
tttttttcagtagatacaggtttcaccatgttggccaggctggtcttgaactcctgacctcaagtgatctacctgcctcagcctccttacttttatctcacatttttttttcttttagacagggtcctgctgtttcccagcatggaatgcagtggtgtaatcatggcttactgtagccttgatctcctgggctcaatggatcctcccacctgggcctcccaagcagctgggactacacatgcatgctaccacacccagctactttttgtatttttttgtacagatggggttttatcatgttgtccaggctggtctcgagctcctgggctcaaggaatctgcctgcctcggcctcttcagcttgctttttaattttgctgattgtttcttttctgtacagagcttttatt

SEQ ID NO: 664632 - DNA, 1868 bp, Homo sapiens
  misc_feature (258)..(259): n is a, c, g, or t
  misc_feature (269)..(269): n is a, c, g, or t
  misc_feature (1592)..(1592): n is a, c, g, or t
  misc_feature (1610)..(1610): n is a, c, g, or t
  misc_feature (1619)..(1619): n is a, c, g, or t
  misc_feature (1622)..(1622): n is a, c, g, or t
  misc_feature (1637)..(1637): n is a, c, g, or t
  misc_feature (1642)..(1642): n is a, c, g, or t
  misc_feature (1662)..(1662): n is a, c, g, or t
  misc_feature (1674)..(1674): n is a, c, g, or t
  misc_feature (1681)..(1682): n is a, c, g, or t
  misc_feature (1684)..(1684): n is a, c, g, or t
  misc_feature (1729)..(1729): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaaaaaacnctcgaaactagtttctcncgaagcggnctnccgaggaaggcctgngggantctcggaaacgtgtctgtcntgtgaaggcgcntgggttnncncgttccccagggctcgtgggctaggaaggcagcggcgaggtgccntccccaggttaccccttcgggggcccagccgagcaacgtggggcgaaggcggcggcaaaggcccgggcttgggacctttggcggccggagttcccagccatggcggatctgtgagcgcttcagcagcgggtccaggagc

SEQ ID NO: 664633 - DNA, 201 bp, Homo sapiens
ctatagtgggtcgagtcacagtctgagtagtaacttaacgtcctaacctcaatgtataaaatagcatgggggaatagctaaacctttttaaaaaaatttattggatattcctccctgcttaaaagatttcaccagacaaaccttcatataaaaattcaggccctttcttggacaatttttaaacattggtatctttactag

SEQ ID NO: 664634 - DNA, 250 bp, Homo sapiens
aatcccatgatagcgatagctatagtgctacatagagaaataagtgactattaaatgagacacatgagagaggaaatcaccagaggtgagagtatcgtagtcatcagatgacactgagtagtatcgaatatacacattcttacaatcacagagtatagaagacaacacaattgaaaatgagcgagagacttaacgcacacttcataatggtcaggagacgggcaggaaaacacagcacaaagggggctta

SEQ ID NO: 664635 - DNA, 2230 bp, Homo sapiens
  misc_feature (258)..(259): n is a, c, g, or t
  misc_feature (269)..(269): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaaaaaaaaaaaaaaaaaaaaaaaaaaaaaaaaaaaaaaaaaaaaaaaaaaaccggggcttttttggggggggggaaaaaggggaaaggggggccgcgccgtaatcaagtaagtttgtcctgacccaccaagtttttagttgacacagagggggaaaaatcgggggggccccccaatatagagggacgcaacaaaaaattaccagacagcgcgcggttacccgtcttttatccttcatccccgcacacacggaacacagacaaagaggaacgagagcagacataggagaacaagaacaaaaccaactagcagacgcaccaaacaggtagatgaaacacgagggacgcagacaagagaagccaagcagtaaggaacacagaagacacgaacgagaggagcacaaagacagcagacacacacaagaacgggagcgccggaaaagagagagaacaaacgaacaagaaacaagcaacaggagagaagaaaggcgcgagagaagggagcaagaacaacggacggacagcgaaagagacgccgagagaggagaaaggacaagaagagacacaaaacaccacagcaaagcactgggcagcgagggaaagaaacacggagaagaaagggacgaagccggggaagacaaaaaagca

SEQ ID NO: 664636 - DNA, 324 bp, Homo sapiens
tacatcaaagctgggaaattctctacaaaagaaacctaaacaggccaggcgcggtggctcatgcctgtaatcccagcactttgggaggccgagacgggcagatcacgaggtcaggagtttgacaccagcctagccaagatggcgaaaccccgtctctactaaaaactacaaaaattagccgggcgctgtgcaggcacctgtaatcccagctattcgggaggctgaggcgggaaaatcggttgaacccaggaggcagaggttgtggtgagccgagatcacaccactgcactccagcctgggcgagaagagtgaaactccgtctca

SEQ ID NO: 664637 - DNA, 1661 bp, Homo sapiens
  misc_feature (258)..(259): n is a, c, g, or t
  misc_feature (269)..(269): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaggggggggtctaaagttccccggggcccaggttcgctcccggtttggtcaaggggccctaaggggcgaaaaaacag

SEQ ID NO: 664638 - DNA, 424 bp, Homo sapiens
  misc_feature (1)..(1): n is a, c, g, or t
naccttcatcctcttcaccggcactccctcagcccctgacatcgagtttatgaaacgcctgaccaaggtggtcaacatcgtccctgtcatcgccaagcgggacacactcaccctggaggagagggtccacttcaaacagcggatcaccgcagaacctgctgtccaacggcatcgacgtgtaacccccctgaaggaatttgatgaggactcggaggaaccggctgttgaaccgagaagttccgggagaatgatcccatttgctgtggtggggcagtgacccagaagtacccagggtcaaacggcaaagaggatccttggggaggaagaccaggtggggtaccatcgaagttgaaaacaaccacacagtgtgagtttggccttaccttgcgggacctttctcatcaggacgcgccatcgtgcgctt

SEQ ID NO: 664639 - DNA, 375 bp, Homo sapiens
atcatatgaatataagcagggtggtgaatattacgcatatttcttttcattttttttttttggagagatgagatctggtaatgtggcccagacggtgaaggcaggggctattcacagggtgccatcataatacactacagccttaaacttcggggctcaaggggtcctccggcctcagccttctgagtagcgggaactataggtgcactggactatatctgactggttggtggcagtttgggcggcccaactcctaactctccttcctacttagaattccctatttggtatcctatttatgaaacagggtgcccagcctggctcttgggaagacagaagggccaggttcgcactcggcccacggcataagggggg

SEQ ID NO: 664640 - DNA, 337 bp, Homo sapiens
aagtatcaaattaatcatgtgtgaggctcttgagaggaaataaacaatacacgatgcatgtggggataagagcatattctaaatgtgcaaacaagtacttcataatcctcaatggtaacaatagcagctgacattgatcaagcacgcttcccgtgtatcagtcgtactgcccagatcatgtatatatctgtaccgtgatcaatctcccaactcgtagaaacaggtacggccatgatccccagtatacagatttaggaaactgaagcttagcagagccgacactcaaaccgcagactagatatacctgactccagaagcaggaactgaactattcacc

SEQ ID NO: 664641 - DNA, 319 bp, Homo sapiens
  misc_feature (1)..(1): n is a, c, g, or t
  misc_feature (14)..(15): n is a, c, g, or t
  misc_feature (36)..(36): n is a, c, g, or t
  misc_feature (44)..(44): n is a, c, g, or t
  misc_feature (73)..(74): n is a, c, g, or t
  misc_feature (81)..(81): n is a, c, g, or t
  misc_feature (88)..(88): n is a, c, g, or t
  misc_feature (110)..(110): n is a, c, g, or t
  misc_feature (117)..(118): n is a, c, g, or t
  misc_feature (153)..(155): n is a, c, g, or t
  misc_feature (160)..(160): n is a, c, g, or t
  misc_feature (168)..(168): n is a, c, g, or t
  misc_feature (183)..(183): n is a, c, g, or t
  misc_feature (217)..(217): n is a, c, g, or t
  misc_feature (226)..(226): n is a, c, g, or t
  misc_feature (242)..(242): n is a, c, g, or t
  misc_feature (252)..(252): n is a, c, g, or t
  misc_feature (261)..(262): n is a, c, g, or t
nggtgtggtggcannaggcgtaccagcctcggaatncagaacgncgccggcgagttcgtggacctgtacgatnncgcgganaatgctncgctagcaatcgcatcatcggngccaagnnccacggatccatccagatgaacgtggccgaagttnnncaagntcacaggnaggtttaatggccantttaaaacttatgctatctgcggggccattcgtnggatgggtnagtcagatgattccantctccgattngcaaggcgnnggcatcgtctcaaagcacttttgactggagagaatcacagatgtggaatatttgtca

SEQ ID NO: 664642 - DNA, 173 bp, Homo sapiens
  misc_feature (90)..(91): n is a, c, g, or t
  misc_feature (146)..(146): n is a, c, g, or t
cacatggtgcaggatcctgtctcttttatgaaagaaaaaaagaaaagaaaaatatacagctgcgaaaactgccaacaggtgtccacattnnctttcaggcccattcatcaggaaactgcaggccagagtgagacttgtgtggccanctgaaggttggcttgcttctttcctgg

SEQ ID NO: 664643 - DNA, 478 bp, Homo sapiens
gttcacccctagcttagccttatgacctgggctgtccttccccagaagctgtctggcccctttgagagacaatgtcttcccctagccacatggttcaaccaagtcatccattggcatctatactccagtgtcttaaaatgtggattaagggtggcctcacccttaatctcctctatgcatatctccttcttaattcttcccggttcctctggggaaataggtccggtggtaactctccatcttacacgacagtagagagcaaatagagttcagagaggggaacagtgtcgtgcacaaggtcacacgagctggtgtgtgggatgggtccccaggctgtggttccttcagcctctgcacatttccagtgcactcacatatccctgtctgatgggcggtcaaagcacagaagattcttccttgacctagagtcaggagatcagcgccctgattcttgtcatccccatggccctctgtcgct

SEQ ID NO: 664644 - DNA, 394 bp, Homo sapiens
aagtggggggcccctgtttggcttccggctgggggggcgggaaccagattttttttcgtttcccggtggtttccagtgtgtgggcctcaaaatcttggttaatgctccgtcccaaaaagccctcgtccaaaagggggcgcccttccatcctgtgtgtgggccccctggaaggtggcaaccccccctgggtgggtctttcaggggggccccttatgtgtaatggtgtgctccaaggggtcccttcctggggctcggtcccttggggggcccccaataagccttctgtccccgccagagtttttttttatgtgaagtgggtccaggcccccttaccggggttatctttgacgcccagccctgtcccctacccccagtaaaataaaatgtgcatcca

SEQ ID NO: 664645 - DNA, 192 bp, Homo sapiens
tgggaagggtttagccattatttctttaattttttttctacccctttctgggttcttcaaattggacttctgccggttttgtttgtttgttgtttgtttgtttgtttttaaagtcaaggtcttactctgtcacccagactagagtacagtggtgcaatcataactcactgcagatttgaacgccttctgggc

SEQ ID NO: 664646 - DNA, 419 bp, Homo sapiens
cagaccagcttgatctactgtcgctattataatattacagaccagctagatatactgtctctattatattctgacagacctgctagatctactgtctctattgtaacatgacagaccagctcgatctcctgtctcaattatattatgacagaccagctagatcaactgtctctttgtgtctattatattatgacagacctgctcgatcaactgtctctttgtgtctattatattatgacagaccagctagatctattgtctctattatattatgacagaccatctagatctactgtctccattatattctgacagaccagcttgatctactgtctctattataacatgacagaccagctagatatactgtctctattatattatgacagaccagctagatctaatgtctctgtcgacgc

SEQ ID NO: 664647 - DNA, 365 bp, Homo sapiens
tattaccgagagagggtagatacactgggctcttcatattcatggatttaacatttgaagttttgactactcgcgggtgaccccagtgttctgagtaatcaactcccagtgttctttgtcttcctttccagttcattgattccttactttgtggtcttgctcttctccctccactgcttagatttctggtccatataaataccttccatgcccttgcttctcacccttcttccatttacctggaaaaatcccagacttgagtgagcctggccactaggcttcttggaatgtggatctggcagctaagccttattagagaacatgactcagcagagcagactgagcctatcatacatgcacattaa

SEQ ID NO: 664648 - DNA, 492 bp, Homo sapiens
gcccgaggaagatactgagtggagcacaggagcagtcacctgctgccactgctactgccagctactgctgcctggctgcgtctgcacctctcgtgcctgccatgtgtacctgcctggcgcctcggtcgacctgcccacgactacatcatcacgacagaccactctagaacaccactgataaccctggaaccacgacaggaacctctgtggaccacatcgacaagaaatacaactagcaactgacgaaactatcaataaccaacaataaaaaacgtcataaaataaacaaacactaaatataaaaaacacttactcgatacacaacatagccaatcaacaacgcgaaacattcaaaacaaacaaccatctcacagacatccactcaacataacaccacaaacaaaacaaacaaaaaacaacagaaaaaccacatcaaaacacacaactttggacatcacagatatcacaccaacaaaaaccccaaaccaaaaa

SEQ ID NO: 664649 - DNA, 334 bp, Homo sapiens
  misc_feature (73)..(73): n is a, c, g, or t
  misc_feature (253)..(253): n is a, c, g, or t
  misc_feature (281)..(281): n is a, c, g, or t
  misc_feature (305)..(305): n is a, c, g, or t
  misc_feature (315)..(315): n is a, c, g, or t
acccacaatcggaaaatacttctgctcaactatgtcgcgcagattcagttcagcaatggttttaccgagaatnatgcgcgattgcagcagttggatctccggtgcagactcgggcgatgagttagggatcatatcgctcaggccgctgagaatggcgttgccctgtttttgctcaacctggaccagagtatctgcctgataaattggtgtgcttaacagcgagtaagcgacagatttcagcgtgaaataacgnggtcacgttgataataaacttacggtgntcccataactcgccgaccagacgnagcagatcgntctcattttcctgtagtgc

SEQ ID NO: 664650 - DNA, 234 bp, Homo sapiens
  misc_feature (156)..(156): n is a, c, g, or t
  misc_feature (169)..(169): n is a, c, g, or t
  misc_feature (218)..(218): n is a, c, g, or t
aatcgagctcgtaccccaccttatgcgtgggtgggggacctgaggggcaggcattggtcacctgggagggacactgtgcaaaggacacaaacaacaaattcagagagctcaaaaatccaaagccaaactggaggaagcccatgcaatgggaccacntcctcacacgcangcccttatgcctcctggctttagtggccagtgtgtagcaagtgattttntgtttttgtttttgtt

SEQ ID NO: 664651 - DNA, 141 bp, Homo sapiens
atggctgttactaaatggctgttacataaatggctgttacctaaatggctgttacctaaatggctgctacctaaatggctgttacctaaatggctgatatctaaatggcaactcggatcgccaaatccagcagccatttag

SEQ ID NO: 664652 - DNA, 182 bp, Homo sapiens
ggatctgagtgtaaacagacgagctagttttacaaggatcgtgtattattacaccaggactgagagtattctcagataccgtactgataacgccctcaacactcacctccggttgaccttgaaactctgcacaagcagaaagtgaaggctaggccaggatgatgacctgcatatagtcccag

SEQ ID NO: 664653 - DNA, 236 bp, Homo sapiens
tgtgtgggggacgccacagatggatgaggacggggctgacgcagctgatgggccgcccgggtgagaacacgtgaacacgcaggtggactagcgcaggcaggaccaacatactcaccagtgtcatcacatagtatctgaaaaaggtatctgaagcactcaaccaccaagtctcatcaaatactgcttccccaagcagctgtagcatgtacatctcttgctgcttccagcacgcatca

SEQ ID NO: 664654 - DNA, 302 bp, Homo sapiens
tttgggcccccccccccctggggtcccccccccccctgggttaaatttcccccccccccccctgccgggggtttttaccaaaaccaaggttaattttccccccagggccattgcccccccaaatgggggaactgggggtggggcccaaaaaaaaattgttttccccccaatgggggggccttttttccaaccaaacaaaacccctggcccttttggggggaacttttttttccccccccctttgggggggggggtggttggggccccattgcttttaaaaaaatttttttttttttctggga

SEQ ID NO: 664655 - DNA, 172 bp, Homo sapiens
atgaattccccaaaagttcatgtgttggaaacctggactccaatgcagcagtgctgggatgggattctggggaggtgattggctcatgaggactaatccattcatggactaatgggttctcagggagtggagcagttatcaccagggggctggttataaaagccagctttgc

SEQ ID NO: 664656 - DNA, 445 bp, Homo sapiens
  misc_feature (47)..(47): n is a, c, g, or t
  misc_feature (73)..(73): n is a, c, g, or t
  misc_feature (188)..(188): n is a, c, g, or t
  misc_feature (394)..(394): n is a, c, g, or t
gggacgttaacaacacttggtatggtcattctttttaatgttagccnttctatttttagcccttctgtgtagnggtgtcttattatggtttgatttgcatttccctaatgactaacaatgttgagcatctttttttttttttttttttgagacggagtctcgctctgtcgcccaggctggagtgcagnggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagngctgggattacaggcgtgagccaccgcgcccggccgagcatctttttcaag

SEQ ID NO: 664657 - DNA, 4076 bp, Homo sapiens
atggatttcctgcttggagtctcaggccccagcgtctggcacaggcaggggcctgcggagctgagggcagtggaccagctgcagggagggcgacctgtatgcggagcgccgttcctgcgacatggaccgcggccagcccagcctggagcctgctgccgcggccccccgagcctcgggccggtgcgtgatcgcgcccgtgcgcgctgtgctccgcctgcgccgccgggtgtgtgtcctacgcaaacggcgcctcctgcagccgggtggggggcccgacgtcgggaccggggcgcccaggccgggctgcagcccccgggcaccgcgcgcggacctggaccagccaaagttcttcaccttcgacagccccgcggagctaccctccaggacgccacgcaagaagcgccggcgcagccgcctggtgctttacccggagacctcgcgcaagtatcggccgcgcgtggagcacaggagccgcgcgcagcgctgccttctgctgctagtcgccatcgtgggcttccaagttctcaacgctatcgagaacctggacgataacgcgcagcgctatgacctcgacgggctggagaaagcgctgcagcgcgcggtgttcggccagcccgctgccgtatcgcgcatcgtggcgctgatgcgggactacctggccacgcatgtgcacagtcgtccgctcctcctggcgctgcacgggcccagtggcgtgggcaagagccacgtgggccgcctgctggcgcgccacttccgctcggtgctggaggacagcgcgctcgtgctgcaataccatgcgcggcaccactgccccgaggcgcgcgccgcacaggactgccgcgaggagctggcgcggcgcgtggccgacgtggtggcgcgggccgaagcggaggagaagaccccactcttggtgctggacgacgtggagctcatgccgcggccgctgctggacgagctgcacggcttcctgcagccgcagcgctcccaccacttccacaacgccatctacgtgctcctcagtggcgcgggtggcgccgaggtcacgcgcttcgtgctgcagaacgcgtcccgcgcgctgcccctgcgccccgacggcttccgcagtgccgaggccgcagcggcgcaggcggaagaagacctgcgcgccagcctgctggctgtgctgtcccgggagcatccgctgtggcaggccgcggccatcgtgccgtttctgctgctggacaagcgggatgtggtcagctgcttccgggacgagatggcgggtgagggcttctttcctgaccaggcccgcgcggagaacctggccgcgcagctcagcttctaccgcgtggctggccgcgagtttgccgtcaccggctgcaagcaggtggtggccacggtgaacctcctgtagtggaggcgcaggacgggacgtttgggttgatggcggcagtaggagggcgaccagggaccttgtgggctggtgcaggcccctgaggtttctagtgaatttgtggctgcccggctggtgggtgcggatcagcttggagctctgcttccaggtccacacccgcctcagagtccggagtctgtccctgggggcggcaggacagcagccacctccctcccaaacttgcccattgccctgctgggcgtcccaggcatggtctggtgcgttctccctgtggccccaagaggtgggttcccatggtacaaggatgatctcagggccaacaattcccggggtcacacagctgggacgtgaccccgcctcttgggggtggtcgcgtgttgctcagtgctgaagtggggttctcattccggcccccctggagatgaccccggaggaggccacagccaaccatgacagtgctggggctctggctgccttctccacccaccccacccctcactcaggtcgtgttttcaggagctcaaggctggagtgtcttgacagtaaggggaggggagcggaggcggaggcgcctcaggcagcctctccccctccttcctggaccccccaaccccgggcccgccagccctggcttgggcttactgggtgaccgagagcccgcggggcaagcgggaggtgcctaggcctctccccatccccctcttctccgcacgtgggacccttagcccgtggccagtcccctggtcaccacgattgcgcgacctccctttccctggggccttttgtgccccgagttccgcccacccgcaccctctgcgcagagcgccctccccacgccagtcgaccccacaccccacactccccacgcgccgcctcccggaagccctcctggacgcctcccgtggatgggcccaccgcgcccacgggggctttaggggaaggtgctttgggcgttttttgcgccatgtctcctcggggccggcggttgcctcgggacggttctcgcctcctcccacagccccggtgtctgggacgcacccggcagccccgctgctgccgccttgtggcgcgcccggcccagccggtggcttctgtggtcgccgggggctgagcgcgcggctgggccctgagtcccccaggccgccccgatcctctgtccccgccgccggccccgctgcagtcccaacccgggcctgcccgggaggagcgcaggggcggcgatgaccagtcccgaaaggggctcagagggcagcgaggaggtttcacgccggtgcggggcgccgtcgaggtgggggcaccgcgaaggtggaggcggggccgcgccggaagccccgagtcgagcgcacacggcgggcgcccctggcaagtgggactcctccggccccgaggcctgaactcagcccggagaccgcgcccaccagcgccggtgtccccggaggggccccgctagttccctgagcagaggtcctgcggcttcccggagggtgtcctgttctctcccccgcctcgcatccattctcgccctggtggttggtgtctgtggtcgggggcgagggccgtctagtggagacggggattcaggccgcttgaaagtctgggatctctgggcggatggcagcggctccgcggagctcgagctcggcgcgcaggtcctgggcccagggcgggagcgctagcgagagggctgccccgtcctgcccagagggtcctgaggactcccgctgctcctggagtcttggggaggggtccggctccacggggtgggggtgggggctaccaggaaacctttgcctcctggggctgtgcaggaccggctagccagcgctgggaaccagggctgagttcagcccagctctgtccaccccaaccccagggctaggggaaggagctgggagaaggagccccacctctcccaggcgagtatctgtcccaggagcccacacagagggacacccagctctggtctggccttcgtgttggcttcaaggtggtaacagagagagctgcagagtgggggtgtgtttgccagtccctgcatgggtgaatgttggggtgcccactgctccccaggcaggacccccaggactgtcagctccccttcccacagagcacccacctggaggtgtcacctgccggcaagcgtgggccattcatccacctgtcagtcaacaacacccgctgagcatcggcttgtatcaaaaggtccagacctaaggggaaattttatctctttctttctttctttcttttttttttgacacagagttttgctcttgttgcccaggctggagtgcaatgacacgatctcggttcactgcaacctctgcctcctgggttcaagcgattctcctgcctcagcctcccgagtagctgggattacaggcgcccgccatcacgcccgggtaatttttttgtattgttggtagagacggtgattcactatgttggccaggctagtcacgaactcctgacctcgtgatccgcccacctcggcctcccaaagtgctgggattacaggtgtgagccaccgtgcccggcctctttttatttattcctaaaatattaccttgaggccaaattctgcgcttaaggagaatgtgcaccaagtgctggggtgggggctggttataaacgaggccacaaatcatgcttgttaataaattgtgtggttcaaatctgaaaa

SEQ ID NO: 664658 - DNA, 111 bp, Homo sapiens
tactcttaggattttttctctaagccctttacgaggtgatagtcatcgctgtccgaggtgtcatacagcaggttgtaggcgaacatacccctgaagtaaccgtagggctca

SEQ ID NO: 664659 - DNA, 273 bp, Homo sapiens
ttaagtgaaaaacatggggaaggggaaaggggaatggctgcttttgatatgttccctgacacaaattttgaatggagccccccccaccaagtgatgaaagtgttgaaaaacttaaaaaccaatgcttgttgggcaagaatgggattgaggattattttttctcaaaaaggcattgggaaggaattgagccagatttttttccccacggcaaacccctattgtagtaaaaaagttttttttactattttaaaaaaacagaaattgggagattca

SEQ ID NO: 664660 - DNA, 2518 bp, Homo sapiens
atggatttcctgcttggagtctcaggccccagcgtctggcacaggcaggggcctgcggagctgagggcagtggaccagctgcagggagggcgacctgtatgcggagcgccgttcctgcgacatggaccgcggccagcccagcctggagcctgctgccgcggccccccgagcctcgggccggtgcgtgatcgcgcccgtgcgcgctgtgctccgcctgcgccgccgggtgtgtgtcctacgcaaacggcgcctcctgcagccgggtggggggcccgacgtcgggaccggggcgcccaggccgggctgcagcccccgggcaccgcgcgcggacctggaccagccaaagttcttcaccttcgacagccccgcggagctaccctccaggacgccacgcaagaagcgccggcgcagccgcctggtgctttacccggagacctcgcgcaagtatcggccgcgcgtggagcacaggagccgcgcgcagcgctgccttctgctgctagtcgccatcgtgggcttccaagttctcaacgctatcgagaacctggacgataacgcgcagcgctatgacctcgacgggctggagaaagcgctgcagcgcgcggtgttcggccagcccgctgccgtatcgcgcatcgtggcgctgatgcgggactacctggccacgcatgtgcacagtcgtccgctcctcctggcgctgcacgggcccagtggcgtgggcaagagccacgtgggccgcctgctggcgcgccacttccgctcggtgctggaggacagcgcgctcgtgctgcaataccatgcgcggcaccactgccccgaggcgcgcgccgcacaggactgccgcgaggagctggcgcggcgcgtggccgacgtggtggcgcgggccgaagcggaggagaagaccccactcttggtgctggacgacgtggagctcatgccgcggccgctgctggacgagctgcacggcttcctgcagccgcagcgctcccaccacttccacaacgccatctacgtgctcctcagtggcgcgggtggcgccgaggtcacgcgcttcgtgctgcagaacgcgtcccgcgcgctgcccctgcgccccgacggcttccgcagtgccgaggccgcagcggcgcaggcggaagaagacctgcgcgccagcctgctggctgtgctgtcccgggagcatccgctgtggcaggccgcggccatcgtgccgtttctgctgctggacaagcgggatgtggtcagctgcttccgggacgagatggcgggtgagggcttctttcctgaccaggcccgcgcggagaacctggccgcgcagctcagcttctaccgcgtggctggccgcgagtttgccgtcaccggctgcaagcaggtggtggccacggtgaacctcctgtagtggaggcgcaggacgggacgtttgggttgatggcggcagtaggagggcgaccagggaccttgtgggctggtgcaggcccctgaggtttctagtgaatttgtggctgcccggctggtgggtgcggatcagcttggagctctgcttccaggtccacacccgcctcagagtcctggagtcttggggaggggtccggctccacggggtgggggtgggggctaccaggaaacctttgcctcctggggctgtgcaggaccggctagccagcgctgggaaccagggctgagttcagcccagctctgtccaccccaaccccagggctaggggaaggagctgggagaaggagccccacctctcccaggcgagtatctgtcccaggagcccacacagagggacacccagctctggtctggccttcgtgttggcttcaaggtggtaacagagagagctgcagagtgggggtgtgtttgccagtccctgcatgggtgaatgttggggtgcccactgctccccaggcaggacccccaggactgtcagctccccttcccacagagcacccacctggaggtgtcacctgccggcaagcgtgggccattcatccacctgtcagtcaacaacacccgctgagcatcggcttgtatcaaaaggtccagacctaaggggaaattttatctctttctttctttctttcttttttttttgacacagagttttgctcttgttgcccaggctggagtgcaatgacacgatctcggttcactgcaacctctgcctcctgggttcaagcgattctcctgcctcagcctcccgagtagctgggattacaggcgcccgccatcacgcccgggtaatttttttgtattgttggtagagacggtgattcactatgttggccaggctagtcacgaactcctgacctcgtgatccgcccacctcggcctcccaaagtgctgggattacaggtgtgagccaccgtgcccggcctctttttatttattcctaaaatattaccttgaggccaaattctgcgcttaaggagaatgtgcaccaagtgctggggtgggggctggttataaacgaggccacaaatcatgcttgttaataaattgtgtggttcaaatctgaaaa

SEQ ID NO: 664661 - DNA, 504 bp, Homo sapiens
  misc_feature (11)..(11): n is a, c, g, or t
  misc_feature (40)..(40): n is a, c, g, or t
  misc_feature (77)..(77): n is a, c, g, or t
  misc_feature (99)..(99): n is a, c, g, or t
  misc_feature (103)..(103): n is a, c, g, or t
  misc_feature (119)..(119): n is a, c, g, or t
  misc_feature (124)..(124): n is a, c, g, or t
  misc_feature (149)..(149): n is a, c, g, or t
  misc_feature (151)..(151): n is a, c, g, or t
  misc_feature (154)..(155): n is a, c, g, or t
  misc_feature (163)..(164): n is a, c, g, or t
  misc_feature (178)..(178): n is a, c, g, or t
  misc_feature (188)..(188): n is a, c, g, or t
  misc_feature (193)..(193): n is a, c, g, or t
  misc_feature (205)..(205): n is a, c, g, or t
  misc_feature (504)..(504): n is a, c, g, or t
tgatttaaaanattttattttctttatgcaggtaggcagntagaaatttcaaagtctaacaatgacattcttgaagngggcacagccttttaaactcangctntgtatacagtaacctnggggnactggttcccagatcttcactttcntnaanncacagggnntgtccttttctttncagagggctnctctnatattccatcgncagtttttaagaaagaaggtggattacaatcagtgctccattctggtttataccgcttattgttgagggtctgaaatactatggctactagacctgcatactccaagttcatcccctttattggtgccgtcgagtaccgataaacggcgctgggaaactatccagtctctagaagagcaacttaattctagacttgatagaatcccatattgcaccggcgctggcaaaatgtttaacctttatctaaaaatgacttcatgtgacagtaaacacaaaaaacatagacccatgatgacgan

SEQ ID NO: 664662 - DNA, 436 bp, Homo sapiens
  misc_feature (11)..(11): n is a, c, g, or t
  misc_feature (40)..(40): n is a, c, g, or t
  misc_feature (77)..(77): n is a, c, g, or t
  misc_feature (99)..(99): n is a, c, g, or t
  misc_feature (103)..(103): n is a, c, g, or t
  misc_feature (119)..(119): n is a, c, g, or t
  misc_feature (124)..(124): n is a, c, g, or t
  misc_feature (237)..(237): n is a, c, g, or t
  misc_feature (239)..(239): n is a, c, g, or t
  misc_feature (242)..(243): n is a, c, g, or t
  misc_feature (251)..(252): n is a, c, g, or t
  misc_feature (266)..(266): n is a, c, g, or t
  misc_feature (276)..(276): n is a, c, g, or t
  misc_feature (281)..(281): n is a, c, g, or t
  misc_feature (293)..(293): n is a, c, g, or t
tgatttaaaanattttattttctttatgcaggtaggcagntagaaatttcaaagtctaacaatgacattcttgaagngggcacagccttttaaactcangctntgtatacagtaacctnggggnactggttcagccagagtctaacaatgacattcttgaagggggcacagccttttaaactcaggctatgtatacagtaaccttggggaactggttcagccagatcttcactttcntnaanncacagggnntgtccttttctttncagagggctnctctnatattccatcgncagttttcgtcaggagatcgaaggttgtagatgtctgcacgtggcttccttggaggtccaggggtgactccctcttccaaaatccattctgtacccgctggctgctctaaccacacacaaaacgggaacttacgggcaggaca

SEQ ID NO: 664663 - DNA, 803 bp, Homo sapiens
caacgtcctgtgacactggtcagggtcttgtcgtgccccacaagaaatcccacaggctgtggaaattgtgttccgcgtctccatttggggtgataattatcaaactgattaatcgcataagtgatacagcgtcatccgaagatgacagttcgtgcagatctcttcacccgcgggcagaatcacacactcacatggaacgccttgcggacccacactttcactcgcgctttctttccacacaggggggtgctcgcgagatcataagggcgcttttctccggcatatgaggagggagagtcttttggtgtccttcccccccctgccccccccaccgcgagggagcgtgtttcgataacaacgaagttctaaatttgataaacctcctcggaaggatagagataattcgaagacattgtcggggagagcccccactctcttaagacatttgggtccgcaccacccgctttcgaaaaggggtcaggctcttggttcaagttatgtatctcccttacgcaacccactgttgtgaactgtacatatagagtaagttcttaatctacattgggtaccgccccccctcgtgtcatgatatcatggtgtgcgttgcacacaaatgtccgggggatgcccttcagaagttgtctttaaatcctattccggagggccagaccgccggaagagtgtctaagggtcccgtaacaagatcatgttgacccccacctcttcatgataaggtctacaccccccgctacgccacacagttctttgccggtgaccaaagattttctcagcccccacaaaca

SEQ ID NO: 664664 - DNA, 943 bp, Homo sapiens
acacacaatccctcgtacagaacgatacgaagtacgctccacgcgaggtgtctggtgcattagtgggttttggttcacacctgcctttggaccagttcactccctctttcgtgcgcgcccggaaattgctttgcaggacaagacccttcccgggggcacttctttaagcacatgggagccttttctctggtccccgggtgacggtgtctacccggcccctggccgcccctgcaggtcccattaggcgcgatgaggcgtttgcaacttcggcccccctgtaagtgcgcctccacctgggtcctcgcgtcgttcaaatccttgcctgctggccggcacctatgcttctgccccctggtgcggtgggctgcatcaacagcccgtggcgggtgctccgccccgcgtgttctctccccctctcccggggggtaactgagccccataggtggcccccctgcacgcaatttggcccctgccgggccatctcctgtggacctcagttattctagggaccagggcctctggtgtccaatcgtggggctcactccatcagagtgggtccccccccggagggcatcccccttgccgggtcccaagcgcggccccccgtagagatcgtccacgggggctggtaaaaattggtgtgtcaggccatctggcataagaatggggtcggactctactcgggcctcgagttttttatcaggcgctcaacccctaggttgatccccctcgtggtcgggagatgctatccaacccctgggtctatcatcaacgagtgggggagcaaacacccagggtgtcgccccagtctccagggaaacacatggcgtgtatcccgcaccgacggattgcagtcgcgtatgtcagtcacgaccgacaccctccacccactcccggggccccccccgggtgcccaaaaaaaggggttacagcccacatgaca

SEQ ID NO: 664665 - DNA, 541 bp, Homo sapiens
tctgatagatcagaaccgccgtttagacttatattcagttctaaggcgattgtgctacgatgcgtaaggtaaagctgagaacgaagggagccccagtactggccagcatgagatctacaggatatacctcatcttgcctatttctgataaactttcttttacgaataaagatgcaaatatttgcttccaaacagttttctcaaatatccacaacatccctggccaagatatatgactgtaaatgaacaaaaagagaaagcatgtaccaatttctaagtgatgaaagtattattactacaatctcacatttatgtagcctaatcttcaagtttaaaatatcttactagttctgactgaaccagaaaagaaatctataaatcccaggaccttatcgtacatttgggtcatggcccaccattttgcttcctgtggcagtggtaagaaaagaacattcctctctctttccctacaaaacaactcattttgttcacaggaatatggaggaaggcatataagaaagtactcagtgagctgggtgggg

SEQ ID NO: 664666 - DNA, 1426 bp, Homo sapiens
ataattcaacgcacgtgctcaatcacaacttttactggtgctctctatattaccctacctacaagcctcagagtacttcgagtctcccttcaccatttccgacggcatctacggctcaacatttatatgtaagccacaggacttccacggcacttcacagtacattataggagtcaagcttctcctcgactagtcgtgctctcactcctgccaacctaagtagtttcacgttctacagctccgaacacagtcacttttgcgcgttcgcaagcccgcgcgcactgcatacgtggacacttattgctagcactgctgtgttactgagctactctatcgtggtacatgctcgtcgcacatcgtatctacagatgcacgcgcgctcactctcacccaccacaaacaacacacacacagccacccacaccacagttacacacaacacacagcgcgcgcgagagggcacacgaccatcccacgacggcgagactgctctcactactcccaccgcgcgcagagaaccaccaagacgactcaactggtgcccacacctcacacacagcgcgacactaccccgcggcagcacacacacccggagcgccacccaaaaaaacaagtgacaagcgcccgaggactatgagaccagaagcgccacatgtcgagacaacagtagcgaccccctggagacccgcgccctgacacacacaacagcggacacacacgagaacaacggggggccaaaacaaccatcgcgggccgaacgccgcccacgagagcggggaacacagccaacacggcggacgacaacaacgaacaccacacacgacaaaaaaaccacacagccccggcgagcgcaccggcgacgaaaaaacacaaaacaagcgggcgcgcgcaccgaccaccacaccgcaaacaggcctccaacagccggcggcgccacctcttcaccaccgacgagcgggcacccccaccccccaaggcggcccaaaacgcacccgcgcacgcaggacagcccccccaagacacaagcacagcacggcgagcaaaagacaacgacgacgcgacagtactcccgcacacagccacccgacgaccaccccgagtgcaccaacacaactatacaacagcccaacgcggagtcgaaaccagccacaattgtacaagagaaagagtcaacaaccaagctgcgcgccaccacactgaacaggcagcgacccgactacgcacccccaccccatcacccgtgcccacagcaggcccgccaccatacatacaagccagcaccacagccacccgtggagacaacgacgcaacacgtaaggacgacagcgaccgatatcacaacacaaacgcagcaacaacccggcaatccccacaacgcaagcaccccacgggccagcaagcagggagccaaccagaagcaaaccgg

SEQ ID NO: 664667 - DNA, 801 bp, Homo sapiens
  misc_feature (527)..(527): n is a, c, g, or t
  misc_feature (535)..(535): n is a, c, g, or t
cacgcgtgcgtccacgcgtccggaagaccaaggactcataggaacgatatattcggcatttgagtcccacgattgtcagattttgaatccaggtggagctggcggctgagtgcatggttagagtcactcccatgtcctcctcagacttcctacatgttcacatcactcatgaggatatattttgccctaccattggaaagttatcatgtgatatgatactatccgtgtgttacatttagcttgtgttaagcatctgtcagctctgcacgctagaatgttagctctctaaagtggcagaggtagctgtatcctgccacagttggtgcccacggtctgggaagagttctgtgggcagcatggtggagtacactcatggcatttggtgagagttgaaggcgccccctgtcaatgccagggactctcacctcgcctgagctatcttggctgtggggtccagtgcggtgataccctgtgtgaagcatcaatcgctagactgaaatgtccatgacctgtcctgcccttccagnggtcgagntgttacgtactgtcgtagcgcacatcacctagactgcgcagccagtgaggagcgggccatgcggcagcagcagcagtgcgtgagccagaacgggcagggtggaggccgtgcccaggggatcctgctgtctcgcacacttgcatgttgaacgcacagaccagtcacggaggaccacgtcctggcggcaggagaagatcacccggaccaaggaggaggccctggagctgatcaacggtacatccagaaagatcagtcgggagaggagg

SEQ ID NO: 664668 - DNA, 1565 bp, Homo sapiens
  misc_feature (796)..(796): n is a, c, g, or t
agcggagaccctgccgcctgagagagagcacagcctggtgggttctggggtctacggcctaggggcccggggaacgtttgcgccgccgcgaccagtgctgcgatcccgagccgcggcctccatgccccgaggaccaggggatcggcgcggcgccctgccctacggaacccccgcgggccacgcagccagtcgtctcgccgctcctccgtgcttggacacaggtgtttaacgccttctaacacatgtcactcctatcaacgccaccctggcttacactgccacgcttacttccgcccccctccacccggcgacaccacacacggtccccgacctgcgccacccttaaccacccctccgggaacattgaacgcacaccgagacaccgctccgcgacacagctcgcacacccccccacgccgcctccggcgacgaccccgccactccacaccgacctccccggcccccggacacaccacttacccaccaccccctacgcccgactcccccaccccccgtctctggaccacgccacaccctgcctcctacccccaactccttctccccttctacactgcctaaccacaccctcgcgccgccttccattggccccccccactatctccacaaccctccaacgcacggcccctgcaccccgcacactgctgccgacacacacccgctctgacacccccacacttaacaccacccacttgcacccggccccacactaaacccccacccacacttgaaacacgcacacggccaacacacctccacttcgccacggccaccgccncaggcccgcgcccccacgcccgaacccaccaaccacagggccccaaacccacgcacacacctgcgacgatcccccgcgacacacacgatcgcccacgcaccccacacctaactcctgacccacccacggagcgcccctgcccatcgcgacccagagcgacgccccacacacattaacgcgcggcgcacccccacacgacccacgcgacctcggcgcgagcaccaacaagccgacacttacggtacggaacacgcacacaccaccactacacgcgccgacccaccagcactgtccccacagacgactaacagcgcccacacagcgcgctacaactcgcgggaccacaacactgcgcgcgccactgcgccccctaccgcctggcgcccattaggacacttaacgcctcaggaacgagaacggccacgccgacacacgacgcgcgctctactaccacacgaccgcgcagccctcacgacatacctaggacgccgcacgtgaaccagcgacgggaagcccccgaccgtaacgcgccgagacacaccacggcgaacccgcggacggcacaaccacggaaaccgtccaaccgaacagacggggacacttcgccgggccgcgagacagcgagcacgcgggcgcagcagcacgacccgttagagacacgcgcggacagacccgtggcaacgacagcatgaagcacaccggccaccaaccacctacgagcacgtggcgggcgcgcaccgatcactgacggactgcagcgacgccccac

SEQ ID NO: 664669 - DNA, 190 bp, Homo sapiens
caaattactgcagcataaatattggaggctgagacaggaggggtcagtagacattgtggccccatccgaggacacccccggacagggccaaacaggaaggatataaccccacccactttgccaaagcacagcccccacaccacaaacacatacagaccctacagagcatcaggacagcaacagtcgacgc

SEQ ID NO: 664670 - DNA, 1197 bp, Homo sapiens
agtcatggccttgggattaacagtagcttccgacatggtccagcctacctttcgcaattatcttgcagcctctatcagacccagtatcagaagttacactgaagacagtgcatgaaagacaacatggccataggcgaatacatggccgtattcagctgtaccagtccgccattttgctaccaagaaagccaaagccaaagggcaacaggacagtcccaaaccagagtgaactattaatgctgccttggctagaggatataatcaacttggaagaggtgaatgacgaaactgaagtctgtagatagaacgctctcaacggcataatttcactcagactctcaatataaggacctcaccaggatacccttgacaagactcgctagtggtaacctgctgcacgcgcgacgctatgctctaaaccacgtattagccagatctccatgaagtcgccacagcctgatctcggtgcaatatggccagcttccccagagtgtacagctgcagctatcaaggctatcagcacaacgtggactgaatctgaacccagaagtggcagggacgctaattcgggtacccattccccaagtaaccagagcagcccagcgaacatgctggtgcacctggacaaacagagcaccatcaacggccagagactctttacggccaggttcgcaccaagctcactgcacaagctggtcgaatttccaaggctaccgctcagaggaacaccatataggctattcgccgaagccgactacgccatacagggcggacttcaacatcgttggacgtaacctggactcggtcacttcggcaagtgttcacaccaataaagctcttgggatgcacagaccaatgaggcccgagcacactctcccagacagcccagggattatggccgcgaacccccacgcggtcggtcgaccatagcggcacaattctgttcgattcccaactttttcgcaaatacttcgtcaccccgacgtgcatcaaatccactgtctcatgcatagtcgacacacatcagcagggaaccaccgacagcgtgaagtatctaccaaaacataacgagtaggtgaagatgacttcatcaaacaactgcggggcgcaaccagaccatcacgatcatctacaaactccaaccacaggctgccggtgcctcaacaacataactataatgatcggaactatatgaag

SEQ ID NO: 664671 - DNA, 1340 bp, Homo sapiens
tagcgtctagagacgccgaatggtggcagcccctctgagagcccgcaggttggggtccgcgcactgctgggtgccggccagctaggcggagaatcgaggaggggttcccgggctcatcgcagaggatggaagggcctagattactgaccaatgacaaacagtgtgggcttaattgtcctcagtcttcgagggagagaatgtggacgtttagcatttgaacattgaatatttgagattgaagatttctgaataatcgccccttagcaactctggtactgtaccgtacttgcattactgtccagggtaggtggcattgagctatatatcaactggtctacacgaggggaggtgggaatgacctgacattgcttgccgcagattacagagaactatgaatatcccaatgtgggcagcaaccaggttagacaaaagaactaaagcacgtgtcactggaaaggcatatgagcctcattgactgttccagcacagtacctggaccatggttcgacaccgcaggaacacccacagacagcgcgtcctgtgagaccctatcccgctactgcaacgtcacagccgcacagaggccactagcggcacaacgctcgccgaaacacacactagacacaataccagcgacgggatcccacggcacgaacgactccacaacagggggcagcaggcaacgaacaatctcaacgacattaaacttcacaggaacgtttggaaaacgttacgcacacgtaggtaatggggcaaaaccaacgaagggaccaccaattgggagaacataccaaaagagccacagaaaaatatcacaaaacaggcacagattaggacaagggaacaatgcagagcaacaggaagcgaaatcgagggagacaacatacatacgaagggagagaaacaatggaacacggaacgcaagacaaacaaagaagacgacagagacaaaagaaaacaaaagagcacacgagaagagacacacgataacaggggacgaagaccaaaaaaacgcaaaaaaagcgaaacagaaaaagagaagagacaaacacgaaaaaagaatacaaccgaacagagaagagggaaaaaaaacagagaaaagagcaacagcacaaagagacgcacacaaaacgcgggaagcagaggaacgagagcgccaagagaagagaggacggcaaagagcagagaacccgaacagaagaacgaagcgacgaaagaaggacgacgagacagaaagacaggagacgcgaagcagacagacaacgaaacaggacgcggagagaggcaaaaacaaaaaaggaagaggaaaaagagagcaaaagaaggaagagagcagaagc

SEQ ID NO: 664672 - DNA, 146 bp, Homo sapiens
caaccaacgcttttatcactcgcgtgagtggaagtctgtgcgcgaccgggtgatacttcgcgatgaaggtcttgacatggggcaccccgattacccgatcaatgggcgcatttacatccaccacatgaacccgatgcagcccatcg

SEQ ID NO: 664673 - DNA, 229 bp, Homo sapiens
tttatgagctggcctggccctgcccacaatacccaccggtgtaagcacacaggccccagacagggctggatggcactgaagctggtagcctgatctacctagcactgcagctgggctgcttcgccctcaccaagttctcactgggcttcctgcttggccaccaccattgtgcgcactgctgcgctttgcaacgcctcatgggccccgaaaccttcattaacgaaccggg

SEQ ID NO: 664674 - DNA, 163 bp, Homo sapiens
ggtcgacgattgagactctacctctcacccaggctacagcactggcacaatcagagctgactgcagcttcgaactcctgggctcacgcaattctcctgcctcagcctcccaagtagctgggactatcggcatgctctaccatgctcggctaattctttgtttc

SEQ ID NO: 664675 - DNA, 283 bp, Homo sapiens
  misc_feature (44)..(44): n is a, c, g, or t
  misc_feature (53)..(53): n is a, c, g, or t
  misc_feature (55)..(55): n is a, c, g, or t
  misc_feature (64)..(64): n is a, c, g, or t
  misc_feature (70)..(71): n is a, c, g, or t
  misc_feature (77)..(77): n is a, c, g, or t
  misc_feature (101)..(101): n is a, c, g, or t
  misc_feature (112)..(112): n is a, c, g, or t
  misc_feature (116)..(117): n is a, c, g, or t
  misc_feature (126)..(126): n is a, c, g, or t
  misc_feature (133)..(133): n is a, c, g, or t
  misc_feature (143)..(143): n is a, c, g, or t
  misc_feature (165)..(165): n is a, c, g, or t
  misc_feature (205)..(205): n is a, c, g, or t
  misc_feature (228)..(228): n is a, c, g, or t
  misc_feature (243)..(243): n is a, c, g, or t
  misc_feature (256)..(256): n is a, c, g, or t
  misc_feature (271)..(271): n is a, c, g, or t
tccagtccctgtaatttttctatatacgagtgtttcgcatccanataaagagntntacagttcngtgctnnagtgancagatgcgagaatgtacgagaaancacatagagcnacanntatgagatnaataaanaacacaactncactcgcgtgatgtcagagagntagagttactcagagtactagtttttaaactgttactganatttaagaaaaatatgtggaaanaggtatggaaaatangatgaaaagaganataattttaccaganaatgcagtttgt

SEQ ID NO: 664676 - DNA, 414 bp, Homo sapiens
ctgtcatgcagtaaaacatgtatttaaaatgaaaattgatagccaggactacagagccccgaattaataccaatagaagggcaatgcttatagattaaaatgaaggtcacttaaacagcttagagtttagttcaaaagttgtaggtcattcacataatttgaaggcgatcttttaaaaagagattaaaccgaaggtaattaaaagaccttgaaatccatcacgcagggagcattgcgtcatttaaagcctagtaaacgcatttactaaacgcagacgaaaatggaccgcttaattgggattggtaggataaaaccatttggagaagatagaagtttgaagtgaaaaactgtaatacagaagtacgggaaggcgaaaaaaagaattgagagaatatagcgaagaaatgggtaccg

SEQ ID NO: 664677 - DNA, 579 bp, Homo sapiens
  misc_feature (88)..(88): n is a, c, g, or t
cactgtgtacccacgtcgtgtggaggcgataggtgctcagagggtgacacagcgggagcaggcaaaccaggaccactgctgtgacagncggctcttgttggtctcaaaccaaggccccgaccacttgctttagatctactcgatagagtggttcagcttgaactccacgccaggagcccaccccaactactgaaactagctgaggtccaagtcggtgcagcaggcccaggtgccgggagaggccatcctgctcgccaaccacatctaccgcctgcacgcctatctccagcgcttcgcctagtcctcccaccacaaacgtgggatccgtgcacgttaacgattactaggactatgcagaatcctgggggtgtggggttgcgggggggcggtgctgttggttggtgggaggggggctgcgggggtgtcgtgggtcgggggctggggtcgtggtgcggcgtgttctgtcttttcctgtttcgtcgttttctgtctctttgttttggcttctcttttctttgtccttttttcttcctctcgtttttctgtcttttcgtcctctttttctgctccttccgtctt

SEQ ID NO: 664678 - DNA, 349 bp, Homo sapiens
  misc_feature (134)..(134): n is a, c, g, or t
tcggggaactccctctcctagccaagggaagccattaggactgtaccatgcactccggcccagatactgtgctttcccatggttttcgcaacacacagaccaggagattcactccagtgcccacaccaccaggntcctcggattacagcacaaaactcagcagcagtttgggcggacactgagctagctgcaggagtttttttttttgtttgtttgtttgtttgttttttctccataccccagtggtgcccagaatgctagtgagacagaatcattcactgccctgggaaagggggctgaagccaggggagccaagtggtctgggcttgggacttgaactcttacctgg

SEQ ID NO: 664679 - DNA, 163 bp, Homo sapiens
  misc_feature (66)..(66): n is a, c, g, or t
  misc_feature (130)..(130): n is a, c, g, or t
gattggtaggatctactgaataagaatgagttatctatttacattatctcatttcagaaacttaancttttttgtgaactatgtacactaagcagattataggtacactactgtagagtatgatacttcncaaaataatttaaatatcggcaagaaaaagagt

SEQ ID NO: 664680 - DNA, 236 bp, Homo sapiens
ctgtggctggttgtaagcaggacggagagtgttagctgagggatggattgtacaggtaaggcgagtgttagcggccgtgtgtctatcacagagaggagagaatatcgggcgggcgtggtgtcagatgcctgtagtccctgctagtctggaggctgaagcgggaggctcacttgagcctgggaggcagaggttgtagtgagctgtgctcatgccactgcaatccagcctgggcgacc

SEQ ID NO: 664681 - DNA, 224 bp, Homo sapiens
ctggttctgaggatcccctaaaaaattacggcaggtacagtggtcatgctgtatcccagcactttgggaggcgaggcaggtggatcacaatggtcaggaaattgagaccatcctggctaacaaggtgaaaccctgtctgtactaaaaatacaaaaattagccgggcgtggtggtgggcgcctgtagtcccggctactcgggaggccaaggcaggagaatggcat

SEQ ID NO: 664682 - DNA, 141 bp, Homo sapiens
tttagttttttttcctgaaagcaaaaggaaaaaaaaacccccctccctcaaaaaggccaaggtcccgtccccctgttgtcggtgatttgtttgtttttttgaaaggttgaaaattgtgtaataaacttgatggcgctgtca

SEQ ID NO: 664683 - DNA, 117 bp, Homo sapiens
ttcgactaccttcctattatgtctagatatatgtatacgggtctacgcattagcagaaagctcatcaagtaggcacgagtctcgttaagttcctgatatgtaaatggtatataacca

SEQ ID NO: 664684 - DNA, 279 bp, Homo sapiens
tcagctggccccaagaattgttaatggtcatctgtcagtggactagcacatggcagtctgcttggaacccattcagaccaatccagttgagcggtgtgtgggctggggggctcttctcccccatcaacggaatccttggtgtgcaccaatcttccccagagctccggagcgccctcgtcctcacttgcaggtttgggcgcaagagcttgcaggaagcccggagcacagatttcgttctgaccttcagttcactttgtcgcccttgggggccagctggag

SEQ ID NO: 664685 - DNA, 774 bp, Homo sapiens
agcggggctggtaaccccgccagcggagggaccgggccgagcccgacggacccctccgagtgtctcctggggcccagccgttggtaccccatttcccccgggtccggtatttggggtggtctctgtctgacccgagatcatctcacacctgtctcagggggacccatcttgggacgtgaaactttttgaaagtttagaagcgaacttactgtgggctctcacgtgtgaatatgtgtctaggtgcatccattaagccatgagtgacttcacgcagttcgaaattacagttttgtcagcgcatcaacatatccttatcctttatggtctggtattgcttgctcaaacaggtggaaacatttttaaagttgcttttgtagcagagttaaacaaatggctgatagtggcttagataacaaaatccacaaaatgccccgactgttcatctgcttctcagaacagatgtacttatgtgtatgttccagcaaaacaagggttcgtccagtatcggtggttggcacctgtcaccagacatcaagcatcggtagtgcacaaatcctttgctctcacctgggagcaggaacacatgtacccacatcttcacggagatattaacctccaggacagaattggcccctccagaacccttcaatgtgcgagacgaaagcatctagcaacaatgggggtcgggccactttaccgcaagcacactttccctccataagcgattggcacggcgcgctatgaggaaatcttaccttggggacctttgggaaa

SEQ ID NO: 664686 - DNA, 141 bp, Homo sapiens
tgcagtgtctacctagagaagggaaagtcaacatttcctggaataggctaggtggtctggggttccatccatccggacataggaagtagattaactggaagaatggagagagaatggaaaaagtgggcgcatccagacttg

SEQ ID NO: 664687 - DNA, 268 bp, Homo sapiens
  misc_feature (121)..(121): n is a, c, g, or t
cactgttatattctatcagtggaagcacagtgaagttaagactgctccaaacaatggatgtgcagagatgagatctgctgaccttggagaggccctggcacgtgcagtcatcccccagtgncagaaggatgaattgcgggagactctcaaatccctaaagaaggtcatggatgacttggaccgagccagcaaagccgatgtccagaaacgagtgttagagaagacgaagcagttcatcgactgcaaccccaaccagcctcttgtcatc

SEQ ID NO: 664688 - DNA, 764 bp, Homo sapiens
ggccacgtgttttatgggcatgatacatatataaatatatagatataaatatatatgaatatatttttttaagtttcctacacctggaggtgcatggactgtacgaccggatgactttatatcgtatacagatttcgcacgccaaacctcggcagcttgggggaagaagaaaaatgcctttctgttcccctctcatgacattgcagatacaagaagatggaaatttttctgtaaaacaaaacttgaaggagaggagggcggggaagttgcgtcttatgaacttatccttaagaaatggtactttttatcgtaagacaaaatcaaacaggactacttaaacattcgtcatattaagaaacaacagtttatctagcatttgtgacataccaataatagagtccatgtatttatgtggaaacaggttttagggaaactactcagaattcacagtgaactgcctgtctctctcgagtggattggaggaattcgtcggtcagagcagtccccttttatctccttccacgggccagggaagcgcgccgccctcactggctttgtgaccggttattctgatgacaactggggcggatcgacagagtctcccttttccgcacagtgggtcggcttttcaaattactttacggtcgaatgtctggataacatttcacttaagcagcggtgaatggtcgaaacactgggctccaataaactttcctcgaaaggacccatctctcctgaaaaactaagtgtacaaggccactagc

SEQ ID NO: 664689 - DNA, 295 bp, Homo sapiens
gttcacattgaaccgcctgaggattaaaatcacagttgtttctgagaaacagttctccaaaaggtatttgaaatatcttaccaagaaataccttaagaagaataatctccgtgattggctacgtgtggtcgcatctgacaaggagacttacggaacttcgttatttccagattagtcaagatgaagatggttcagagtctgaggactaattggcctctgcttgtaatacaatgaaagtattctaaagaaatataaaattggactttatgagaaaataaaagtcgatttcactcta

SEQ ID NO: 664690 - DNA, 998 bp, Homo sapiens
  misc_feature (255)..(255): n is a, c, g, or t
gatacagcacgaaggctcgaggccctagaccagagttggtggctggacctcctgctgacttccgagttgcgatgctgtacttctctttgttttggtgcggactcggcctctgcagagactgtgggtcggcgtgggtcaggaatgggcactatcgcccatcaggcatcagaagagcgtcagggccaggccctcagcactggcgtgaaggcaaagcagggtgcgtggaccacgggcaggagagcctgtcggagcagntgagtcctgatcatgtggcgaggttgctgacagagggacgatccggacctggctacgatgtcagtgagcctggaggctcatagacctcggacgaagcttctgcatgtctgatcctcgctgcatggaaggcccgtggtggtcctgagcgtgaagcaaccagagacctcgggggggtaatcctggcaagagatacgtattgggggagccaagacgggggacgtgaccagatggcgacggtagcggcaggcgatggccaggggctcgaagagacggtggacaccggactacccggagcaggcgcatgcagtccacggtcacaagctctaccaccgggccccgcgagcagacgggacgcggagaccaagcaccctcgcagcctcacaatggcgcctctggcgacgtgggacgtgcgcagagggggctggagttggaacacctgataccctgtctgcccgggggcggggattcggcacggacattgtgctaaaattgccctagaaggtagactcaaacggctcctcagccgcgcttggctgccgcgagacttccggggggcaccttagaggtcgactcgtcgtccagcccaagcacgaagaaatcacagaaccacgcaccaccgtcacacacgtgctgtcaccggcgactccacacagcgcaaccatacacggcagttgcagccctcccgctcgcgctcgctaccacccttacacaacagacaaaacacaaacaacacgcaaaaaaga

SEQ ID NO: 664691 - DNA, 387 bp, Homo sapiens
cacgtgcttgctgggcttagtatggcgctgccctgagttcttactgatctgagcctactacctctgctggaagcccagatccgattgtgtgccaacctagtaccggtgcccattaccaacgacattgtgtaccggatcactggccagtgggtgcatatcgtatcggcctttcttacctttaacatgacagatgatacgatctttcttagagagtaccagacactgtcagaactcagggcttgtatgacttcagctacctgaatggtcagcgatagaatgggaacgtcgtcagagtctatggaggccgagaacatgttgctcacctgctgtttattagggacaccaagagcatgaggatcgttactacctggactatgagatctgtgg

SEQ ID NO: 664692 - DNA, 569 bp, Homo sapiens
  misc_feature (190)..(190): n is a, c, g, or t
agtacaggagccttattaacgcaaaaagggccctgtgctttgaattcccccccacaggaatgttgcggagggcaagaaacccgcgctggttttcgggatgcagaactgtagtattcaacaaagacccaccagcggttatgcaggtggtttgagctcggcctatgggggcctcacaagccccggcttaagntacagcttgggctccccctttggttttggggggggttccagttccttcaaccgacccagttcctccagggccgtggttgttaaaaaaatcaaaacacgtgatgggaagttggtgtttgagtctttttacgtcctgcccaagtgaaaagttggggtagcccctcccagcctacccctcttgtgttgccccagagccttggaaggaggccgtttttcagggtagccttgggtacaggagacccccctgagggtcagccctagccctcagcccccctggggagtttaattcctggggaccccccttgcccatgcctccaggtacaaaacaattcaattgctttttttttttggtccaaaataaaccctcaggtagttttgca

SEQ ID NO: 664693 - DNA, 357 bp, Homo sapiens
ttttccacccatttcccccaagctcgggttttcggttgggggaaggccccccctaacggtgagggggggaactgcggcccattcttcaaatccaaaaagggcagggcctttttgttcagttttaaaaaacccccaaaaagggagtaacccaaaccctttgatcccagaccctaaccccggattaaaaccaccccaccctttcaggttgatttaaaacacccctggaaaaaaagggttgaaatatcccaagtgggaaaaacccggtttttaaaagtgccagcccccttttgaaaacaaaaaaggggcaggccagaaatggcccagggagaagggttaaaaaaaaacccacccccccca

SEQ ID NO: 664694 - DNA, 374 bp, Homo sapiens
agctcataccccatgccgtatgacagaggtggagctagaaatgggaaatggagaaagaggagaagagattgctctgggaacagctgcaaggataagagagctcaaagcaggccgaaacatccaggctgcaggaggaacttgctaagctctccgagaaactgaaaaagaaacaagcaagttattgccgtctgcagacagaaaaggagactctgtttaatgacagcaggaacaagattgaggcaattacaacaccggaaggaagctgaatcacaaagcccagttggctcgaacccagaagctgcagcaggaacttgaggctgccaatcagagcttggcagagctgagagatcagcggcagtaggagctttagcctg

SEQ ID NO: 664695 - DNA, 259 bp, Homo sapiens
gggcccgatgaagatgctgtttcgtagtctattttgtgtcactggagattcgtacaagctcaggctgagtttaatctttcattggggcagggggtgatctaaaagactctctacgccgacttctattgacttgggttaatcgtgtgaccgcggtggctggcacgaaattgaccaaccctggggttagtatagcttagttaaactttcgtttattgctaaaggttaatcactgctgtttccccgaaaacggcatcttcat

SEQ ID NO: 664696 - DNA, 517 bp, Homo sapiens
  misc_feature (236)..(236): n is a, c, g, or t
  misc_feature (510)..(510): n is a, c, g, or t
tcgacctcatttaagaaactaatgagtactggtttgtaaagaattatcaacattatccattccatttatgaagaagaggagaacagtttattagctgttctcctcttcttcataaatggaatggataatgttgaagaggagaacagctaataaactgtattgtaaaatccatatgttaagtgtgtcttgaattttgaaagaaaaaaatatattttgcaagctaacattttcttganacaatttgaggcatcatgtaacttataaccgaatccaagagccgttcgcgcaagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttggaagtatttaccaatagtcacatggtggtaaatatccaagtggttataaaaggatgccatttatatnttaaatt

SEQ ID NO: 664697 - DNA, 233 bp, Homo sapiens
agggaggatcgcttaacgccaggagttcagggaccagcctaggaaacacagtgagacctcaactctacaaaaaaatttaaaattagccaagcatagtgttacgtacctatgttcccaggtactggttgggcagggtgaggtgaaaggatcacttaggcccaggtgatcgaggcttcagtgagccatgatcacaccactatgctccagcctgggtaacagtaagaccctgtctc

SEQ ID NO: 664698 - DNA, 132 bp, Homo sapiens
ctgaggtagctctcaggatcttggattgagatagcacggtgccattaaactttaagatcttgtgccaaacgtctggccaaatgtcgttctgccaagtacagacttctggaggactgtggactgagtgcatag

SEQ ID NO: 664699 - DNA, 253 bp, Homo sapiens
gagtgtctcagactctgaactattgcgtttaacagtcgaatgattgtgtagatacggattgagctggatgggtacagcttaaatcatgggtccagcctaaaaaccaccatttaacttacactgatcaatttcaacatggactgttttcggttatttgtgttgaaataaagcatcattaatgcacatctgcaggggtttgccatacagcccaaacggtatacagttacaatcattaaaagttcttatttttgta

SEQ ID NO: 664700 - DNA, 479 bp, Homo sapiens
  misc_feature (76)..(76): n is a, c, g, or t
aaggttgctaatcaattgactctgaattaatcaaaagggcaatattctaggtagacctaacctaatcaagtgagcnctttaagaacagagagttttctcctgcttgtggcagtagaggaagtctgagagattcaaagtgtgaaagagactctacaggaggaatgttctccattgctgaaatgacaatttcccacagacaaggacctgagggaagcctctagaagctgagagtagtccctgccaacagccaaccaaaaaaactagggaccatagtcctacaacagcaaggaactgaattctgcaaacaatctgattgcgcctggaagcaaattcttccccagagcctccagataagagcccagcttctgaccaacatcttgatttctaccttgtgagaccctaaacagaggacccagttgagcccacctggacttaagatctacagaactgtgagataataaatgggtgttgttttaagg

SEQ ID NO: 664701 - DNA, 100 bp, Homo sapiens
tacaaagtgctctcagatattatggtgaggttattaccatcacaagtgatgatacaatctggctaggccaatgcgcccactttttcgcaaagactattcc

SEQ ID NO: 664702 - DNA, 100 bp, Homo sapiens
gctcgtccgttactttggagccagctttcgcatatcaggcgctatagcggtattgaagcccagctgggcgatgtgctgagctgatagtgagctgcagaat

SEQ ID NO: 664703 - DNA, 259 bp, Homo sapiens
ctattttatgtaacaatcatctttatgatcttttgagtttcatttattttcatattatcattattaggattatctttatttggctaattttctgtctagttcctcgtctatatcaactccttcatcatagattattgtgcaagatataatttgtctttttattcgctacgcttattgtttgcccaatatattgaagtctaaaaactgactttacaaatcatttaacattctcttctattttcttagtgtttatttggca

SEQ ID NO: 664704 - DNA, 837 bp, Homo sapiens
tgcctttcgaatttaaacacaggaggcggaacacactaacaaaaggtaagatatcaaacatccagatggagggaaacatataggacaaatgacctagatttttactacaaataagaaacttcatcgaaattgcacagaattaagaaaaagagagacacagatggaagaatgcatggcttaacaaatttgcgcacaaatccaacaaattacaatgagtcaatgctaaacaatatcagcagaatgtagtatactaggttctctcataccaactgttagaccataattaaacaggtgtgacatttgaatgacactcaattatggctgtcactgatcctatatgcttatgatcccaccagaacagcaagtaggcacacgtcgccccatatcacttacattatcgaaatcatagactcatggagccaaactgcaacaaattagaatcccagctaatagacaatatactgtgccatatgaccttgagccaatatacagatcaactctataatgacaaacaactggcgggtgattaatgagcatccaatgcacaacggtcgccctgactgataaaagtgcgaggatacaccggcaacaccagagaaccaccacaaaccggggggaaaccaagtgcagcgggcaggcaactagccacaacagtagcgtacgaatagacccacacggagaactgacaaaaccggacaccacatagagccgccgggggcaagaccccaaaaaacaccccagagacaacagcgcagacggagggtaaaaacaaaggagaacaaaaaatcgcaggaaggcaggaaggaaacgaacacaaaaagagggacgaaacacaac

SEQ ID NO: 664705 - DNA, 822 bp, Homo sapiens
  misc_feature (12)..(12): n is a, c, g, or t
  misc_feature (63)..(63): n is a, c, g, or t
  misc_feature (69)..(69): n is a, c, g, or t
  misc_feature (100)..(101): n is a, c, g, or t
  misc_feature (135)..(135): n is a, c, g, or t
  misc_feature (207)..(207): n is a, c, g, or t
  misc_feature (215)..(215): n is a, c, g, or t
  misc_feature (217)..(217): n is a, c, g, or t
  misc_feature (221)..(221): n is a, c, g, or t
  misc_feature (223)..(223): n is a, c, g, or t
  misc_feature (237)..(237): n is a, c, g, or t
  misc_feature (261)..(261): n is a, c, g, or t
  misc_feature (269)..(269): n is a, c, g, or t
  misc_feature (271)..(272): n is a, c, g, or t
  misc_feature (274)..(274): n is a, c, g, or t
  misc_feature (278)..(278): n is a, c, g, or t
  misc_feature (281)..(281): n is a, c, g, or t
  misc_feature (284)..(284): n is a, c, g, or t
  misc_feature (288)..(288): n is a, c, g, or t
  misc_feature (290)..(290): n is a, c, g, or t
  misc_feature (292)..(293): n is a, c, g, or t
  misc_feature (298)..(298): n is a, c, g, or t
  misc_feature (307)..(308): n is a, c, g, or t
  misc_feature (310)..(310): n is a, c, g, or t
  misc_feature (314)..(317): n is a, c, g, or t
  misc_feature (319)..(319): n is a, c, g, or t
  misc_feature (321)..(322): n is a, c, g, or t
  misc_feature (325)..(325): n is a, c, g, or t
  misc_feature (327)..(328): n is a, c, g, or t
  misc_feature (331)..(332): n is a, c, g, or t
  misc_feature (452)..(452): n is a, c, g, or t
  misc_feature (507)..(507): n is a, c, g, or t
  misc_feature (557)..(557): n is a, c, g, or t
  misc_feature (560)..(560): n is a, c, g, or t
  misc_feature (565)..(565): n is a, c, g, or t
  misc_feature (627)..(627): n is a, c, g, or t
  misc_feature (677)..(677): n is a, c, g, or t
gctgtgttgtanactttttattggtatggataacctttattaaagtaacaaatctgaaaacanattttncttttgctggaaagaaagtactatgttagannagaactaagagaaaccagaaatcatttgtaaaangtaagcatgtgatatggtttaaagtaatgtaacaaccagaaaaacagtattaaccatttgaatgtgcgtgtntgtacaancntcananaccaatgacatacnccccaaaccccctgccccaccccncttcctcngnncnaccngcnggnttgngngnncaggntaggcgggnngngggnnnngngnnggngnnggnntgttgtttcttctgtatggggtttccttgccagatagggggctaatcatgcaatagcttgagtttctctgaacgtgataaacacccaggattactagaaccagaaagcgtgtgttcactnttttttttgtttgctgagcggtgctacaaaaacaacagaaagttccttcactttnatctggttatatgcccaaacctctaatcaagaaataatgcagctacaggngcnaattnaattactataaaacattccttcatctgtaaaacatttcttttcccctcaaattaaaaatttnaaataaaatgtcttcgtttttgataagcagctccaccaccagtctctganaccgtatatcattcaatgcagccatggcgtctagttctggagatctcataagggtgggtccaaagacgattccaaggttctctgcattcataagattctccttttcgtggagggtcactctctttagatgtgccatgaggtaccg

SEQ ID NO: 664706 - DNA, 263 bp, Homo sapiens
cgcaagctctgcaagtaatggacgtgcacatggactgctggaagcccttcccaggcgcaaagtgtaagtctccggccaccttattgacttccaagaagccatacacctggcagccttcattcttctgctcctgcatcttctggctgaagccctctcgccggcactgctcaatagtatctgggttcttgaaggcccagcctctacggcgatatgcctcccgcacagtcttcacaggtgttacagcacttgatatcttctgcctc

SEQ ID NO: 664707 - DNA, 812 bp, Homo sapiens
gatagaggccgtgtagcgctcaccgttagtcctaaggagattccagtcgtgtagaggagaagtcgaggttcccaggtaactgggacgcactttgctgtctgccatcgtaagattgagggctgcaagcccatgcagaggtactaatcactctttacacttggagaagcacaccatcttgtactccaagacatgcattcattcatagcatcacctaccagcagcgatgctagcctagccagcagactgagcagcacgcatggccgccagcaggcggccagatacctgtcagaatggtgcgaacaggccatgccagctcaagctgcatatggctttgacgtatttgaaccgtgcagagcaaattttagcaagaacccaggcagaggaacgtacgcttctaccctaacgcaacgccgctcctctttgtgtggcgcaaacttcgtttccttccacgaccattcagctgtaggcacagcataattgcaccgtacatactacttctgcacgtaagatacttgggacacacggcaatggcggagagtgccttcacttcataactggattaaccggtgatctatagggcttttattctcgcttggggaagaccccagataaccccattaagcggggcattacttttgcctacacaggtagggacagctttgcgaaccaccattagttggcacaacattcccgagtggcatacaagggcacgctcattgtcagttggtcgccgccatataatggccattggccctataaagataggacagttcccttgtaccagagtttccgaagaaacctttcacttccag

SEQ ID NO: 664708 - DNA, 464 bp, Homo sapiens
ctgacgatccatgtgtcctaatgtactgcggacatatacagagtagggctgaaattggccatgcactgtacatgtggatggtgcttattaggacaaaaacatctcagcggctatcactctacaggtaaaatcatgcctatttagtttgaaggtgtaggttacatgtatcccataaatataaagtaagggaaaggggagaaacgctcgctaaaatccggatatataagtgatgcattcatggaattattccacacttcacgcgatgcacatacagataaaagttagtcccttcgaagagctaacactctgtaagacctatgatataagactcctgtaaccttatttacttacttatataaagaaagttttcatacctattaaatcattctcaaggctatatctatcaaggttcatgctttctaattcctcttgggggtggggcaatcaagctgggggatccacta

SEQ ID NO: 664709 - DNA, 190 bp, Homo sapiens
gatgatcttcaagaagggacgtagggagagagagtccctgcagcagatgggcgaggtcacctgcgaagggatccgtctgaagaagatccttattgaggactggcagaaggcacgggaggaagaagcagaaaagctcattgcgctacaggatgggaagaagtctctggaagaccaggtggagatgctgcgc

SEQ ID NO: 664710 - DNA, 247 bp, Homo sapiens
agggagtgatcagaggatcccctcagcttatacttccttcttctttcttccttcttccttcttttcttcttctttctttttcttcttcttccttattcttcttcctctttcttcatctttttctttcttctttccttctactttttcttcttcttctttcctctttcttcttcttccttctcctcctttcttcttcttattcttctccttctccttctttttcttcttcgacgtatctcgcgttgag

SEQ ID NO: 664711 - DNA, 808 bp, Homo sapiens
ttaagaaatacatttgtaaggctatggctgcccgaagatgtaactgaatcactgcactagcataataaaacatgaatggataagcagttgcttcttgtggatgaacaaagaaagtggtctcttgagatggaacctaatcctggtgaagatgtgaacactgttgaaatgataacaaaggattcagaatactccatagacttagtttatgaagtagcagcagggtttgagaggattgactctaactttggaagttttcctggccgggtgcggtggctcatgcctataatcccagcattttgagaggccaaggtgggcagatcacaaggtcaggagttcaagaccagcctggccaacatggtgaaaccccagctctactaataatacaaaaattagccgggcatggtggcacacgcccatagtgccagctactcatgaggctgaggtaggagaattgcttgaacccaaggaggtggaggttacagtgagccaagatcgcaccactgcacttcaagcctgggcgaagaacgagactctgtctcaaaaaaaagttttcctgtggtctcacacaaaaatctttcatgaaaaagaatgtcaatcaacgtgacaaattcatcatgtcttcattaagaaactgaacagcaccccaatttcaagcacacttgatcaacagcatcacattgaggaaacctcacagcaaaagatatgactcatgcagcagtgaggtaggcgtaaaaaattatctatcaccgacacagaccctcatttcataaaatggaggcaaagactcgagggagctaagtgccgagag

SEQ ID NO: 664712 - DNA, 444 bp, Homo sapiens
atcatggtatacgatttaatttgcttttctgttctttttttttaagactatcgatgtgagatgggcttagattggactacggttctcatgtaactggctgagaaaaggtccaccttcgctgcacccatgcagtgtctaaaagggaaccacacacccatgaatcacgtttacttaccagaaaattccttcctcaattccggtctgaaggccttgtccaaggccctgatctccttcagctccttctcctccaccaagaggcggatgatactctaacccagaaaccctcctgctcctgtcacaaggcagctccagcctgtcatggccaatccaaagtagcagacaacacactccaggaaacagaagatgctggggagcagatctgattctagggtgaccctggagagggctaaaaaaagagatcaaagggttatatactcacacaga

SEQ ID NO: 664713 - DNA, 1358 bp, Homo sapiens
gggtaacctaagctggcagtggcgtgatccggcaccaaatctggcccgtcggtgcggtgctggagactccatgagtgccctggacatgaacaagcatgagatggaggcaggcggggcagctatgtgactcgtgtgtggaaggtgtggccatgcgtatgggcggacgaggaagtggaccctgcacactgggagctttgtcaataatcccacgcgtggctggctgcttcccaacagacaaagtcatggtgacccggtggttaccttactttggttcgggtgactgtcggggttagttgtcgggggtgtccctccaggttcaactcgctgttgcccttgagacgtttccaacgaccctgtgcactctatgtgtcatccgatgtggatggccaatcgatgtcttcgcgttgtagttgatgtgcttgttgcgcgagggttgacctatatggggcgcgcggacgaaagtgggcacgtgacgcatacacggcacccattgattaaggcccggcacccagtcttcaatgttctaattaccctagggagcgtagcgaagggtaaaagccgttgggataaattttttgcttgggcacacgttgcgcgaaagttccaaccgtacgtgcaatccggggtgcttccaaaccctaagtacaccgccaccgttacatagaccccttccaatttgtggccccgtggccaacgtaaacgtttagccaaaaaacaatggatcttcaagttcgtgggcgcgaagactcacaacccgaccaaagttgaccagagattcctgagttgccttcccatttttgtgccaagtttctcccgggcaggaggcgggaagtttcccctggggaacgcaactctagggcccaaggaggataactttgattcgggccgcggtaacttgcgatttggacgcaagaacaagggaaaggggcccctttgcgtggaaaaattcaatggaaggtaaagccacgtgggcgcgaagcaaaattttacggttgagcgaagggaatgggttccccccaggaaaaggggggtgccttgtgccccacaatggggaaagtggtttcaaattcgaaagccagagacccgaagttttagtggcgccatggtggcaccttattctgggatggtgttgggcaggacctttccgaacaccgaaaggttaacgcctttccaaggtggaaaaccccccagaggctctaagaaagctttggggttcaaagatccgccctttcgaatttggaagccacgtggacattgggctttggggcgttttttgacgtggggggagtccaaagagaaatcgcgggggaatttggactgtggacacgtgcgcgagcgccgaaacagagaaaggcaca

SEQ ID NO: 664714 - DNA, 415 bp, Homo sapiens
cacaaaatgttactagcccttttgtactctgaactgtgctcggtaaagttatgatagacattctacatacctttctgcacactgtctcaaagcgaattgcattttacagaataaactggacttaacattcttaagaactatctcgggactccacgcaatcgggccattactactatacagccgcatttatccggcatcactacgactgcctgcgatcggtaaacaaaatgcttaacctctaggagggtcacactagcagagatgggaattccatatagtgcctatactataggcctgtaccgttaaacaaccagcaaggctgatcccgcgccacaaatcactatgaatacttcatttcaacttgtatgccaacttttccaggggatcataggttcgctcttatgtcgggcggctc

SEQ ID NO: 664715 - DNA, 396 bp, Homo sapiens
ttgccaaataaaaaaaaaaaaatccctgctcccccccttccctccccccccaggatatttagggtaaaggagaaaataatgggaaagggcctgggccgtggattaaaagggctatttaaagtccaaggagtgttttgtttccattcctagtatggtccgggaaaggggaactgagtatcctttgttgacttgggaaacccggagccccttttttggttggttaaccaagccagccaatgtggaaaccaacgtttcttttttcccccctatggttttttgtcctacttagaccggctgtttttatttcctggtttttcataggaaaaaaaaaatatttaggcttaaagtttgtaatgatccatgggtcataattcctttaatcttttcctccaagga

SEQ ID NO: 664716 - DNA, 1117 bp, Homo sapiens
gggccggacccccacccgccgaggggcccagtgaggacgcggcagagtcacggtggcagcattgagagttggacaccctgggtccttgaagtgatctctagtgccccagccccaaatcctgccaccattcctgtgctgctgtgtggacaccatggctccagaatgatggactgctggaggggatggccttaggggtgcagtttctggagatgtgcttggcaaactacatgtgcgcaacggtacaagcgtggttggatggactgggcacctgtgcttgtgctggggaccctggtcatgctgcttccagtgagctggctgcccgacatcgagcaagtgcttatgcccagcagtatggctgactgtggcccgaaagtggcgggggaccgtggagacagggcccccagtatggcacactggacgaagtgcctggcatgccttatttcactggcggctgagctggctgagctgcgctgcacctggaggtgcgggagaagctgcaaagggcaggacagttgagcagggtgcgcgccttgggcagctgtgtggggctttccacctggcctgtgctgggctggcttccgcgagaagccggggcgagcgaggacggcttccgcaaggcccagaagccctgagtgaagagggctgaaggaggtagaggcttcccatgaaaagctaccacgcagccggaaggatgagcaagacggccagacgacggggaagccacgcaaggcagacagcgcgtctcccaggagcagctgcgcaactggaggaacgtgtggacgctgtgccaggaggcgaaaagaagatgccacggatgacagaccgtgcaaagatgatcggtacatcacgtacttgacggaattgtgaaacagcatttgataacatggcaggaagatagacgcaagaggattatataagggaatgggggttaaattaaactaactgggcgcttacagaggagagtcatagccacggagtgaaagaataagagaaagaaaaaatattaggagaaacagaagaagatagaagtaaaatgcgtagtcagaggagaggaagtgggggagagatagaagtagcctgagagaagagtatagtttgtagtcgcgttgttgaaaaa

SEQ ID NO: 664717 - DNA, 691 bp, Homo sapiens
gcctcgtgccgcaactaccgaggaggtttcaaccgcagcggaggtggtggctatagccagaaccgctggggtaacaacaaccgggataacaacaactcgcaacaacagaggcagctacaaccgggctccccagcaacagccgccaccacagcagcctccgccgaccacagccaccaccccagcagccaccgccaccacccagctacagccctgctcggaaccccccagggccagcacctacaagtaagaacagcaacatccctggctcaagcgccaataccagcacccccaccgtcagcagctacagccctccacagtccgagttacagccagccaccctacaaccagggaggttacagccagggctacacagccccaccggctccacctccaccagcaccatgcggctacaactatgggagctacggcggttacaacccgtgcccctatagcggatggaagcctgcaccgcacggacctaactcgtcaagccagctatagaccagtatcagcagtatgctgcagcagtggaatgcatgtactatcagtaaccagggccagttggccgccatactacgtggaactacgacgtacgggagctactccgggaacacacaggggtggcacaagatacacagtagccagtgtgacccagaggctcccggaggcccctgcgcgggttcctccaaca

SEQ ID NO: 664718 - DNA, 127 bp, Homo sapiens
acccctcactttatacttcacactgtggatcaccctgaattctttctatgcacaagataccaagaaccctctctatggggtctagatatgggacccctttacctgtaactatacatagctactagca

SEQ ID NO: 664719 - DNA, 161 bp, Homo sapiens
agtaaagtagacggttaggagggtgatggttgctattaattgtggggatgaagaggcgtattgttattttgtgaattcttcgcataatggaccacttgggccaaacccgggtaacgggggcaggcctcctacggagaggagggtggattgaattaagggtg

SEQ ID NO: 664720 - DNA, 838 bp, Homo sapiens
  misc_feature (56)..(56): n is a, c, g, or t
  misc_feature (124)..(124): n is a, c, g, or t
  misc_feature (131)..(131): n is a, c, g, or t
  misc_feature (203)..(203): n is a, c, g, or t
  misc_feature (206)..(208): n is a, c, g, or t
  misc_feature (213)..(213): n is a, c, g, or t
  misc_feature (224)..(224): n is a, c, g, or t
  misc_feature (244)..(244): n is a, c, g, or t
  misc_feature (252)..(252): n is a, c, g, or t
  misc_feature (257)..(259): n is a, c, g, or t
  misc_feature (266)..(266): n is a, c, g, or t
  misc_feature (269)..(269): n is a, c, g, or t
  misc_feature (286)..(286): n is a, c, g, or t
  misc_feature (289)..(295): n is a, c, g, or t
  misc_feature (327)..(327): n is a, c, g, or t
  misc_feature (660)..(660): n is a, c, g, or t
  misc_feature (690)..(690): n is a, c, g, or t
  misc_feature (771)..(771): n is a, c, g, or t
  misc_feature (804)..(804): n is a, c, g, or t
atttttattacaaattattttttatccaaatcatatccttaaaactgtttataganaacccagggaataaagtgaactgttcattgtggaaggccttaaattacattattacagtagaaaatanaggaggnagaagataactgaaaagactaatgcaacattagattcaaatctatagctcctgtagctacttaaaacatggnttnnnggacngaacccaacanttccagcaaccatagagacngttaaganggagnnngccctgncancccttatatcatgcttnccnnnnnnnggtaggaagatgttagatccaggacacatganatatgacattttatctacaactcctgtttgctttactgagggtgtagtttcaaaattcagtcaccttcttcagcttcagattcagattcttcttcagcatttttgagccattttacaaactttttcatttgctcaaggaaaacactcttcccctttgcaacatgtgcatctttataccactacaaaatgggctcctcgctcaggacttcagctttataaaaaagcaccactattttctggaaggctttcatgaaatgaatgttgtcatagcaatactcctgaatcttcagtaacagagttagctcagactgaccttgagtagtaaaggcagcnagtagagggctgtattgcttcaagtgcttnatggcttgctctgctacaagctcctctttttttgttccattccacagtgctcattacacttgaccagactattccgatganaactggctctgggatgttgttttttttcatctnctccttgacatataaattatatccttaaatggat

SEQ ID NO: 664721 - DNA, 485 bp, Homo sapiens
ggtccccatgcatagtgtggaaggcaaagggggtggatcatgaggtcaggagctcaagattatatttgggaagtgaacaggaaggaaaatttatgcagtctggaggcaagggtgtggagtgattctggctgtttcttttctttttcctttttttttttttggaaagggagtctcgttttgtcacccaggcgggagtgcagtagcgcgatctcggctcaatgggctcacggcaacctcggcctccggggtccaagtgattctccggcctcagcctcccaagtagcggggactatgggcgggcgccaccacgcccaggtaatttgggtattttaagaaaagacggggttccaccatgtgggccaggagggtctcaatctctggacctcgtgatcagcccgcctcagcctctcaaggggcggggattacaagcctgagccagggctcccggccacttggctaaggttcctgggcatggtcggcggcct

SEQ ID NO: 664722 - DNA, 198 bp, Homo sapiens
cgagctcggtaccccagctgaacgagcagtttaactgggtgtcccggctggcaaacctcacgcaaggcgaagaccagtactatctgcgggtcaccacggtgagatgttagatcacgcatgctgttgtgcgggagcccgagctgtgatcgggagcaggggcatgtgtgcttttgactgagcatttatcacacggcaaaa

SEQ ID NO: 664723 - DNA, 431 bp, Homo sapiens
ctgctccgcccctctctgctcctcagtttttcatatatgtacaatgagactgatgttagaaacaacagtaatgataataagacccatttccagtggttgggaatgagaatgaaataaggtccagggtgtaaagcagtttatccttcctgggcttggcaggagtacgttgccctttgggagtgcagaagaagaaccagttcccgttcactggccagcctcaggcatctgtcatgtgtggggccctggaatacagagacgaatgagacaggctgatgcctctaggacgatcatataaaatcccaagctcaagctcaggacccaggccttacctggctttgtggcactggcatcgtcgcctgctgttctggaaacacaccagggatgcttgttcatggtggtgaccaccaagcagagaggggcggagcaggggt

SEQ ID NO: 664724 - DNA, 213 bp, Homo sapiens
cttacatgcagatctgaggaagttgtcacagcaatcgtgcctgctctggctgtctgtgtcttgaaggtcattgtgtccttcggttccttgggagtaggtcttcgaaacttgtgtgtgcagagctcccagccccttgaatgaggaaggatcagagaagaggctactgggggagaattcagtgcccccttcgccctctagggagcagacctccac

SEQ ID NO: 664725 - DNA, 512 bp, Homo sapiens
  misc_feature (28)..(28): n is a, c, g, or t
  misc_feature (61)..(61): n is a, c, g, or t
  misc_feature (92)..(92): n is a, c, g, or t
  misc_feature (117)..(117): n is a, c, g, or t
  misc_feature (197)..(197): n is a, c, g, or t
  misc_feature (203)..(203): n is a, c, g, or t
  misc_feature (239)..(239): n is a, c, g, or t
  misc_feature (249)..(249): n is a, c, g, or t
  misc_feature (251)..(251): n is a, c, g, or t
  misc_feature (315)..(315): n is a, c, g, or t
  misc_feature (338)..(338): n is a, c, g, or t
  misc_feature (374)..(374): n is a, c, g, or t
  misc_feature (424)..(424): n is a, c, g, or t
  misc_feature (428)..(428): n is a, c, g, or t
  misc_feature (451)..(451): n is a, c, g, or t
  misc_feature (475)..(475): n is a, c, g, or t
gaaggatatgagggccccctccctctgngctttcctctctagagggcctcagtctcctccngcaggctgggctgcacgacccccaatccttncacccctaacccggaggagggggcnataccagggagggcagtggacagggagcctgggggagtaggtggagcgcagggcagggtccatggagtgcagagggggtngcagcnaccaaggtggtcagttcctggcagcaatgaccacanaaagtcccanancccccaaggcaacagcagtagccccaaacagccactaccatgggatggaccaggcacccttgcnaggtcactaagcaggaagcaggntggggtggcccagcattttccggtacaaggcggtcncagtgctccgctgcgccgcatgcttcttcaccagctttgagagctctgcntggntcgtcttgttggaaggttccagnttcagggctgccctcaggatgggnattgcctcactgtactccccctgctgggccagcacct

SEQ ID NO: 664726 - DNA, 799 bp, Homo sapiens
gggcctgattgacctgcgtgaagagagagaatggccgctgcctgccgtccagtctgctggtccgctcgccgccgccagtcgctctagtgccggacgccctcgtgtgcgcggcggagacaacgaggattccggtgggaactctacttcttggtgccaccgcctcatgcactgtgtaggtcgtgaatcagtattcttagaagggctttatggaccaccggctacgaacgagacctccgtttatcttgaacgactgtgataccagaagagctgacatgactggtctatgggctgaaacactgttcaattattgctaaccctatcagagaggaatgcatgtcagctgattgtagtagccagtcctcttgacttcttcaccagctcaaacacccaacagaggagctatcatctcagggccagtccaacactgactaaggacttgaacgtgccaacgcagcacgaatttacgctagaagtgcactcgtttcgaaaggaaagatcttcctcagaactgtgatccctatcattccccctagttgctcaggaatcaattgaaaaagatgattacgtcaatttgcgattgagctacatttcaacaaagtggtaaaactcacagagcacttcgacgatggttccactttgaccaagtataagtatgtaaacagttttccaacttgatttcactgcggaaaacttcccttcagggaaagagcaggaaggccccttagacctcacttgtgaatcgacttgcagaaccaacaatatcagcacgcattgctacaaggtgaacactgatgagaaa

SEQ ID NO: 664727 - DNA, 475 bp, Homo sapiens
tcgcgtcccactggaagctatacgatgtggcaatcaagcatgacatgatgcgcacgtcaggtaatcataagagaaatgcagatcataaccacaatgagacatcatcccacagcccattggaagccactataaaaacaacaacaacaacaaaaaaaaaaaaaaaaaaaacgggaaataacaggtgcggccaaggttttggaaaatttaaacccttgtgcagtacgggataggattgtaaagggtgatgcagccactatggaaaacagtttggatggtccctcaaaaagctaagcattagaattcctatgtgacccaagcaagcccacttctgggtaaatatcctaaagaattgaaagcaggggcctgaagagatattggcacacccattgttcattacggcattatttttacaacaggcataggcggaataaaacgctgggggaccctcatagagtgaccctgcagggcattgaag

SEQ ID NO: 664728 - DNA, 109 bp, Homo sapiens
ctcgtataaagggccaaatcaggatgttgatccttggccactatcaatagtcatacagctatctatcacaggcctgttataatactggtgcttgttgtgattattcgag

SEQ ID NO: 664729 - DNA, 855 bp, Homo sapiens
  misc_feature (762)..(762): n is a, c, g, or t
  misc_feature (847)..(847): n is a, c, g, or t
ctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcnatttaaacattcttaatatgtcatcttgtttgtctttatggcttatttgcctttatggttgtatctcaagaataatatgacagcntgaggaaa

SEQ ID NO: 664730 - DNA, 1057 bp, Homo sapiens
gacccaggcatcgcgcgcgagaaggcggggtccccacactgataggtccggaaaggcgacttccgggggctttggaactggggagcctcccggaggcgtcggcacctgaacgcgaggcgctccattgcgcgtgccgcgttgaggggtttcccgaaacctgatcgcagaagaccccaaaccgggctggggggcgtccgcctgcgcgttcttgcggcattgaagctgggccagtgggggcacttgtgcggcctgaagggcaggagccgggggcggtatcttccgcctggcttggcaattcggctgctccctcctcgtgggggtccccggaggagcggcggacacgaagaaaccggcagtaccccacgaacttcatgccctggtgtgtcgaacgcgttggttaggacaagaaatgccggggagcactcaacagccataacgctgcggggtcaccagtggtcaccgagacggcggagtccgtggccaggcatgggtagaggtgtactgcgggggcttgggcgcagggacaaccaggaaatagaattaaccctggacccgaaggcatgggatgcgggcttccagaggcaaatgtggtggcccatcgtggtcaacaaagaaagaagttggcacacggggggttggacctgttggcccaacacaggcataagacattggcagggagggaatactccctttcttgcgtcccagaggttggctctcccaagaaggggcagggcattcctgacaagacccacttccaaggggatattgtccaccttaatcgacgcataaggtggacccggcaacgcagtcgcggggcgcctgcgccggtgacattctttcccaacggcgggacctctgacgtggaacaaggaccctgcgggacatacactccatactatgagaggcgcgcgcggggcgcataaggaacacggacacgcgccgggaggagggccgaatgccccgcgtgcatccgccacagagaaaacccccgggccctggcacaggcgggctcaggcggcgagccacagagagaaacactctgggcacgcggcacgaa

SEQ ID NO: 664731 - DNA, 857 bp, Homo sapiens
  misc_feature (320)..(320): n is a, c, g, or t
  misc_feature (354)..(354): n is a, c, g, or t
  misc_feature (358)..(358): n is a, c, g, or t
  misc_feature (405)..(406): n is a, c, g, or t
  misc_feature (409)..(409): n is a, c, g, or t
  misc_feature (412)..(412): n is a, c, g, or t
  misc_feature (432)..(432): n is a, c, g, or t
  misc_feature (438)..(439): n is a, c, g, or t
  misc_feature (471)..(471): n is a, c, g, or t
  misc_feature (474)..(474): n is a, c, g, or t
  misc_feature (482)..(482): n is a, c, g, or t
  misc_feature (485)..(485): n is a, c, g, or t
  misc_feature (491)..(491): n is a, c, g, or t
  misc_feature (522)..(522): n is a, c, g, or t
  misc_feature (537)..(537): n is a, c, g, or t
  misc_feature (764)..(764): n is a, c, g, or t
  misc_feature (849)..(849): n is a, c, g, or t
ctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctccgacccttcccaccatccttccnccaccatacaaaaacttcccaaactttccccccnccanctcactctccccccccatctctcacccctccacacaaaactatttcnntantcnacctcccatcccatctcacncattcnnttcccctccctctcaccccaaccccattcccnccncctttccnccncacccnacttctctccccttctcccccccaaaccaanttccctccttttccnacactccccaccctcacccactgctcctctcccactctccctcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcnatttaaacattcttaatatgtcatcttgtttgtctttatggcttatttgcctttatggttgtatctcaagaataatatgacagcntgaggaaa

SEQ ID NO: 664732 - DNA, 449 bp, Homo sapiens
ccccagacgcgaacccaattggcatctcccagaaagtataacaaaacccgagcgggttgcccccttcaccttctatacaaccctctatcccctttccccagggctcctgtcctccactccagatcattcctttagtacagagctagggcagcgacgtggatatcactgaaggagatcggaagccagactacactgcttacgtatgccatgatccctcagtgcataaaggaggaagacaccccttcagatcatgatagaggcatctgtatgagcccagagtcctatctggggtctcctcagcacagcccctctaccagagggctctccaaataggagcctcccatctccaggtgtactctgtgggtctgcccgtcccaaaccttacgatcctcctggagagaagatggtagcagcacaagtaaagggtgagaaagtggataagaagctca

SEQ ID NO: 664733 - DNA, 410 bp, Homo sapiens
  misc_feature (28)..(28): n is a, c, g, or t
tcgagctcggtaccttccacaggttatntagagatgcagtgcagaaggctaacacgaggactcgtcaaaaagacttctgaaatatttgatttccaggatttggtagattaagtgtgtctatttgtaatgaggagtccatcatgtccagattggattgtaaataaagctgtaaagccctacacattcatcaatgccttcactgtcttgtccacaatcagaagaggtggtaaaatgtccaaatggaactctgaaaaataacctagccaggaattttcagaaactggactgaagtggctggattccctacctataaatgtaaccatgagagttgtgacaaacaaaaatctgggatcttcacctaaaaaactgagtaggcttcggaggcttctggttacatccccaatggtagg

SEQ ID NO: 664734 - DNA, 383 bp, Homo sapiens
  misc_feature (371)..(371): n is a, c, g, or t
tgggtggatcacttgaggtcaggagtttaagactagcctggccaacatggtgaaaccccgtctctactaaaaataccaaaattagccgggcatggtgttacgcacctgtaatcccaggaggcagaggttgcagtgagccaagatcacacccctgcactccagcctgggcaacagacagaacaagacagtctcaaaaaaaaaaaaaatcaagaaagaaatactatgcagttggatgtcttccctcacccagtttaactgtacaagggcagcactactctagatcttctgagcacttgccttttctatgtgtactatctttatatttaattgttttaatatgccatcataggtcatcttaaggcaatttctangcactgtttgga

SEQ ID NO: 664735 - DNA, 132 bp, Homo sapiens
gtgtgggtttttgtcatgttccacacacttgtccattcttcattttcactgattgttcagcatcatgtgagcagtcagatgttgcatttgcagtgttggcagtcagcattcagtgctgtcagcgtcagcaca

SEQ ID NO: 664736 - DNA, 119 bp, Homo sapiens
tgcccacggcaggtgtactgtgaagcaacaaggattactacaaaacaaaaattataccaggcatatttttacaattcgtgcttgaatattccaatttttaagaatcacgatatgcttaa

SEQ ID NO: 664737 - DNA, 143 bp, Homo sapiens
  misc_feature (77)..(77): n is a, c, g, or t
  misc_feature (79)..(79): n is a, c, g, or t
tgcctaacccacgtgtttcccagcagcctcccttcttttttcctttaaattttaattatgtgtgtgtataagtgcananacgtgttttccttccgtttgttttctgcttaagaagtttagaagtttaatccatctgagaaaaa

SEQ ID NO: 664738 - DNA, 369 bp, Homo sapiens
ccccaaggacatctaaaattctatctatgttggtatctaaaatttttcatgctgaagttaaatagttgacaaagtatgtatttgctgcggtcgtgtaaatattggtatcttaaaatactgttacatgactattttcatatccagtacaatttacatatcacaacaatttgacacccttcattcatttatcttctgtattgccataccacttttcagccgagaatcctatcataatgtaatctattatgcccgacatcttttaatcattcaccccattacttcatgtctcagaagatatatacgtgaaccattttcttagctcttgctttaagaaggttgtacttatctcagtccagaacctattatcgt

SEQ ID NO: 664739 - DNA, 1275 bp, Homo sapiens
cactctcttctgggttggggcagggagtcctggacggacctagggatctcgagatgccgtagtcacgcggaggtaatgaacgcatcagatggatgcagggatgttgcatcagtatgcccatgacatgagcatccccttggggtcttcgtgagcttgtggatgaatgagcacacagtgtacttcgtgtgagcttgtcactaacaacctaccctgagctccggattccatgtcacaacaattcgttatgcacgaccatcgcgaagacatggagaagagaggactccttatggcattccatttcgagggcgctctgtgtgtgtgcacattacctagctagtccgagaatagcatatcatacatagtgagttcgtgtagctggtaatgaatggcactagccttgttcgtccacgacttgagggctaatattggcactaggactcgacttaacgataatcggggactttgccgatggcaccacaatgacgtgacgaagtcgcatttacatatcgcgcaacacaatgtctgcgtaaacgcttggtgggtgtgctcaaagggagcctcgcggacaaacacactaagggataaactaaatacccggggacatagcgaacctaacaccaccaacacatgcacattgggacttaacaagctgggggagcattgggacaccgcaaggttaattgatttggcggcgcggaaaggaagattctctctgtatcgcttattggcgattggccgagaggatctacaaggggcacactgcgcttgtttcgcgaagctagtacctagttcccggtgagcatcaatctcgatgggtaatattctttacatcaccaatgtgaccggtcaccgtatataaacacataagaggcattcttttttgtccttgggcgagccgacttgttgtgcgatggcacatttgaggcattcaaggagggtacggtctcgggacggtgatggagggtcgaccgacaggggaggaaggcgcgcggacactgttgtgctttgtttaaatttcgggagagggccccttggtatttggtacccatgggcggcgtggggaacctcttaaaataatcacgtgggggcatacttgaggaatggggaagggcgaggtaaacccacgaataagtaattgactgaaagtcgcttgtgaacatgttcctatggttggaaatcgcgaaagtctggggagcacaggtgaaatgtgggcgaaaaacgaggattgatgtgggtcaccaaccggggtgggagagggagggtatgcgcaaaatc

SEQ ID NO: 664740 - DNA, 628 bp, Homo sapiens
gagagagaaggaaggaggtggtgtgcaggatggcgacggcggcctatgagcagctgaagctgcatatcacacctgaaaaattttatgtggaagcttgtgatgatggagcagatgacgtacttaccattgaccgtgtgtccacagaggttaccctgcagtcaagaaagatgttcctccttcagctgtcacaagaccaatattggtatactgggcacaatccatctggtggcaggtaattatcttatagtcattaccaaaaaaaaaaaaaaaccaaaaagcaaaaactcgggaagaaaattggaattggaacttaaggggggcataaaaaaagtagctgaccttgggaagggctgacactattcaccattcagggacagtaggtatgcagccagaggtctgggtgcagggagctgaccgacatttaatgatggagtgggctgtgacaaaggggtatgacgtatcccagagaaaagtgttgcttgcaaagacttcccattaagggaaacctgggagaatatttcccaactttgaaggtgccaggataaaatgtcagaagtggtgtttaggacttacggaaggtgtttgaaagtccccccaggattgaacaactttcggtatctaatctata

SEQ ID NO: 664741 - DNA, 142 bp, Homo sapiens
agggggccccagcagcttcgaacctacacctgagggctaccaacaggtggcgctctggctttgcactgcaaaaactgagaccagcccccttttcccacaaataaagcccaataaagcctgagaagtgaggaaaaaaaaaaaa

SEQ ID NO: 664742 - DNA, 326 bp, Homo sapiens
tgagatacatcccacaaaccactatttgtagcccacagtgtggcacggatcaggtaccacagccctactccataggcgacaaggctataacaaatgatattaccaaaaacctgtatcatttaagggctctcgtcactgcatgcatgaacttcttatgtaattcttctggttcctgtttctttatctatatcataaaagctcaataccacaagatgcatgaactactaatagacacaatacagctgtaaccttgaattggagtctgtaccaaggctgacagctgatggcactggcccgggcaccataccccagaaacagccgagtct

SEQ ID NO: 664743 - DNA, 161 bp, Homo sapiens
cgataatagtcatctggaatatgcatgatgtaatatctcaaagacgtaacaattttcatttctctgtgactggtgatgttgagcaccttttcatacaccttttgacctttttttttttcttttttttttttttttttttttttttattttttttttatttt

SEQ ID NO: 664744 - DNA, 816 bp, Homo sapiens
ctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctacttttctccaaggctggcaaagccaattgggccagcacctgggcaccactcaatagacaaatggcgtctcgaaggacacaccaactcaggaagactggctggtgagctgtgcttcctgaaggatccagggctctggtcgtggaccccttgtatcattcctacagattatctggaagcaaaatcggcacagttctcgacgaagtgcccggccatcacctcattcctgtcaaggagaacctcgcttgacaaaactctggacagaccgtcctgagccgcccttgccacgcctctccctcaccactgggcctggatttacacacggcactctccctggaagcgacacacggtcggcagaccgttcgcgctcgcacccatgggcctgagacggaaccggtacactgttgcgttccggctgcatccctcgcccatccacactcggcgcactcagccgtggccctccttctacaccctcccgcaggaaatcacgatggtccgcagccacccaatcccacctcattccacccttccctacg

SEQ ID NO: 664745 - DNA, 391 bp, Homo sapiens
tcggccggtttggcagatcagggctgactctggccatggccttctagatacatgaagggcgtgatggaagggcaaagagtggggaaggaagggaagaggaggagaaaggaagaaaagagggcagagcccttgcaatctgattgcctctccagggccccatgccttagtactgctgcaacagcaattacgtttcaccatgagtttgggaggggacattcattcaaaccatagcacgtatggacaaaaaaagggtgtagagaaaaccagaagttgctttttcccttttcactacttagatttatgatctttttatatatttttgtcattcataatttctttttaattatacaactgggactgtggattaaaacagcatgttgtcactcatgct

SEQ ID NO: 664746 - DNA, 313 bp, Homo sapiens
tatgaccggggtgcgagtgtgcaactgaaaagggtgcaaaggcggtaagagtaaaagtcatatggcttccctatacaggctgctgtgcgtgaacacagcaggctctgatacagatcctccaggccacatccctcctcctgactgcttgctgacaattcacacctgtcacctcattcttaatccagttccaaacttctcgactctgaagaaaaaaatccatccaaagccgacctcgtcattctgttctgtctactcactgtaattgcatactttattcatactatatgagtctacaagtgttactgccttggaa

SEQ ID NO: 664747 - DNA, 906 bp, Homo sapiens
  misc_feature (121)..(121): n is a, c, g, or t
  misc_feature (164)..(164): n is a, c, g, or t
  misc_feature (241)..(241): n is a, c, g, or t
  misc_feature (243)..(243): n is a, c, g, or t
  misc_feature (246)..(247): n is a, c, g, or t
  misc_feature (249)..(249): n is a, c, g, or t
  misc_feature (256)..(256): n is a, c, g, or t
  misc_feature (258)..(258): n is a, c, g, or t
  misc_feature (264)..(264): n is a, c, g, or t
  misc_feature (267)..(267): n is a, c, g, or t
  misc_feature (269)..(270): n is a, c, g, or t
  misc_feature (275)..(275): n is a, c, g, or t
  misc_feature (279)..(279): n is a, c, g, or t
  misc_feature (281)..(282): n is a, c, g, or t
  misc_feature (305)..(305): n is a, c, g, or t
  misc_feature (311)..(311): n is a, c, g, or t
  misc_feature (318)..(318): n is a, c, g, or t
  misc_feature (335)..(335): n is a, c, g, or t
  misc_feature (339)..(339): n is a, c, g, or t
  misc_feature (364)..(364): n is a, c, g, or t
  misc_feature (384)..(384): n is a, c, g, or t
  misc_feature (390)..(390): n is a, c, g, or t
  misc_feature (396)..(396): n is a, c, g, or t
  misc_feature (402)..(402): n is a, c, g, or t
  misc_feature (410)..(410): n is a, c, g, or t
  misc_feature (413)..(413): n is a, c, g, or t
  misc_feature (416)..(416): n is a, c, g, or t
  misc_feature (433)..(434): n is a, c, g, or t
  misc_feature (442)..(442): n is a, c, g, or t
  misc_feature (445)..(445): n is a, c, g, or t
  misc_feature (451)..(452): n is a, c, g, or t
  misc_feature (457)..(457): n is a, c, g, or t
  misc_feature (546)..(546): n is a, c, g, or t
  misc_feature (748)..(748): n is a, c, g, or t
  misc_feature (780)..(780): n is a, c, g, or t
  misc_feature (891)..(891): n is a, c, g, or t
ggtgagtcggagctcctatggaggtggcagcgggtaccgagtggcggctgcagcagcgactcctctgagctgagtttgaggccgtccccgactccttccctccccttccctcccccttttntttgttttccgttccccttccccctcccttccctatccccgangaccggaacctgaggaggcagctgcggtggcagctgtagagttctcggtgaaggtatttcatttctcctgtcccctntnttnntnaccccancnattaanatnannctttngaananncttcgttgtaaagccgccaaaanggagantgcgaangcagaagggggtgcttntcgnttcaatacttcttcgggcggaggangaaataagggtgcacctcancaatancccaanactgcnggcaacancanatncctggggaaaaccccanngcaaaaancanagaaanngattnctgcacgaagcactagacgagatgacaactccgcagcaaacaactccgcaaacgaaaaagaacgacatgatgcaatcttcaggaaagtnagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcncagcagcagatgggtcaaccaggacagaagcnaagcaccacattcagacgcctcctaatttccaaattacaagatgaatttgaaaaccgaactagaaatgttgatgtctatgataagcgtgaaaatccctcctccccgagagnagaacagagagcatt

SEQ ID NO: 664748 - DNA, 187 bp, Homo sapiens
  misc_feature (37)..(38): n is a, c, g, or t
ggggggggggggccctttttttttttccctttttttnngggggggaccccccgggggggtttttttttttgggggggggggggttttggggtccccttttttccccccccccgtttttggggggggggggggggggggggatttttttttttttttttttattggtttttaaaattttttcccccca

SEQ ID NO: 664749 - DNA, 1203 bp, Homo sapiens
  misc_feature (48)..(48): n is a, c, g, or t
  misc_feature (64)..(64): n is a, c, g, or t
  misc_feature (75)..(75): n is a, c, g, or t
  misc_feature (83)..(83): n is a, c, g, or t
  misc_feature (104)..(104): n is a, c, g, or t
  misc_feature (114)..(114): n is a, c, g, or t
  misc_feature (158)..(158): n is a, c, g, or t
  misc_feature (205)..(205): n is a, c, g, or t
  misc_feature (210)..(211): n is a, c, g, or t
  misc_feature (218)..(218): n is a, c, g, or t
  misc_feature (224)..(224): n is a, c, g, or t
  misc_feature (227)..(227): n is a, c, g, or t
  misc_feature (272)..(272): n is a, c, g, or t
  misc_feature (282)..(282): n is a, c, g, or t
  misc_feature (284)..(284): n is a, c, g, or t
  misc_feature (290)..(291): n is a, c, g, or t
  misc_feature (294)..(294): n is a, c, g, or t
  misc_feature (302)..(303): n is a, c, g, or t
  misc_feature (333)..(333): n is a, c, g, or t
  misc_feature (339)..(339): n is a, c, g, or t
  misc_feature (341)..(341): n is a, c, g, or t
  misc_feature (343)..(343): n is a, c, g, or t
  misc_feature (346)..(346): n is a, c, g, or t
  misc_feature (373)..(373): n is a, c, g, or t
  misc_feature (402)..(402): n is a, c, g, or t
  misc_feature (416)..(417): n is a, c, g, or t
  misc_feature (430)..(430): n is a, c, g, or t
  misc_feature (432)..(432): n is a, c, g, or t
  misc_feature (438)..(438): n is a, c, g, or t
  misc_feature (442)..(442): n is a, c, g, or t
  misc_feature (446)..(446): n is a, c, g, or t
  misc_feature (453)..(453): n is a, c, g, or t
  misc_feature (462)..(462): n is a, c, g, or t
  misc_feature (466)..(467): n is a, c, g, or t
  misc_feature (476)..(477): n is a, c, g, or t
  misc_feature (490)..(490): n is a, c, g, or t
  misc_feature (497)..(497): n is a, c, g, or t
  misc_feature (499)..(500): n is a, c, g, or t
  misc_feature (506)..(506): n is a, c, g, or t
  misc_feature (525)..(525): n is a, c, g, or t
  misc_feature (527)..(527): n is a, c, g, or t
  misc_feature (559)..(559): n is a, c, g, or t
  misc_feature (580)..(581): n is a, c, g, or t
  misc_feature (589)..(589): n is a, c, g, or t
  misc_feature (714)..(721): n is a, c, g, or t
  misc_feature (725)..(727): n is a, c, g, or t
  misc_feature (730)..(734): n is a, c, g, or t
  misc_feature (736)..(736): n is a, c, g, or t
  misc_feature (747)..(747): n is a, c, g, or t
  misc_feature (768)..(768): n is a, c, g, or t
  misc_feature (792)..(792): n is a, c, g, or t
  misc_feature (811)..(811): n is a, c, g, or t
  misc_feature (828)..(829): n is a, c, g, or t
  misc_feature (838)..(839): n is a, c, g, or t
  misc_feature (841)..(841): n is a, c, g, or t
  misc_feature (843)..(845): n is a, c, g, or t
  misc_feature (847)..(847): n is a, c, g, or t
  misc_feature (850)..(850): n is a, c, g, or t
  misc_feature (861)..(861): n is a, c, g, or t
  misc_feature (866)..(866): n is a, c, g, or t
  misc_feature (868)..(868): n is a, c, g, or t
  misc_feature (870)..(870): n is a, c, g, or t
  misc_feature (875)..(876): n is a, c, g, or t
  misc_feature (879)..(879): n is a, c, g, or t
  misc_feature (980)..(980): n is a, c, g, or t
  misc_feature (1040)..(1040): n is a, c, g, or t
  misc_feature (1173)..(1173): n is a, c, g, or t
aaaaccccacaaaaaaaacaaaaaacaaaaaaaaaacaaaaacccacncaaaaaaaacaaaaanaaaaacaaaanaaaccaanaaaaaaaaaaaaaaaaaacanaaaaaaaccnacaaaaaaaaaaacaaaaaaaaaaaaacaaaacacaaaaaaacnaaaaaaaaaacaccccacaaaaaacaaacccaaacaaaaaaaaaaanccccnncacaaanaaaaanaancaaaacacaaaccccaaaaaaaaccaaacccaaacaaaaacaacnaaccaaaacncnaaaacnnccnacaaacannaaaaaaaaccaaaacaaaccaaaaaaaaanacaccnancnaanaaacaacaacacccaacaaaaaaaacnaaaaaacaaaaaacacaacacaaaaacanacaaaaaaaacaanncacaaaaaaacananaaaaancaanaacnaaacacnccacaaaanaaannaacacccanncaaaaaaacaaanaaaaacncnnaacaanccccccaaacaccccaccncnccccccccaccaccccccccccaccccccccncccccccaccccccccccccnncccccccnccccccccccccccccccccccccccccccccccccccccccccccccccccccccccccccccccccccccccccccccccccccccccccccccccccccccccccccccccccccccccccnnnnnnnnaaannnaannnnnanacacaactatnaccattacccctatttacgcncacactataccacaagctctctcnacaaaaaaccaccctcctncccgctcccgcgcacanncccgccatnncngnnnanaancacgccctccncccancncncccannccnccagacagccggctagccccactgcccgttccttttacgcccaagttttgctccttgagagcagattggctgatgcccctgcaaccccagcccaagctctncctcaaagaccgagtgacataagccattcccaccctcctaggttcacatccagggctgtntcttccttgggggaggagatggtgtcgtttagatcagggtaaggcagtcaggcgggtgttcaccactgccttttcttcctctgagcgtgagaacactgaacccagccactgcccctggtcccttcctgaaatntctaataaatccttttcccttcttgagcta

SEQ ID NO: 664750 - DNA, 969 bp, Homo sapiens
  misc_feature (5)..(5): n is a, c, g, or t
  misc_feature (287)..(287): n is a, c, g, or t
  misc_feature (307)..(307): n is a, c, g, or t
  misc_feature (314)..(314): n is a, c, g, or t
  misc_feature (318)..(318): n is a, c, g, or t
  misc_feature (338)..(338): n is a, c, g, or t
  misc_feature (377)..(377): n is a, c, g, or t
  misc_feature (408)..(408): n is a, c, g, or t
  misc_feature (410)..(410): n is a, c, g, or t
  misc_feature (428)..(428): n is a, c, g, or t
  misc_feature (434)..(434): n is a, c, g, or t
  misc_feature (436)..(436): n is a, c, g, or t
  misc_feature (457)..(457): n is a, c, g, or t
  misc_feature (469)..(471): n is a, c, g, or t
  misc_feature (502)..(502): n is a, c, g, or t
  misc_feature (612)..(612): n is a, c, g, or t
  misc_feature (615)..(615): n is a, c, g, or t
  misc_feature (746)..(746): n is a, c, g, or t
  misc_feature (806)..(806): n is a, c, g, or t
  misc_feature (939)..(939): n is a, c, g, or t
tctgngcccatttcgcaccaaccccagcatgatgattgatgacctcctgactccatgctcaccagggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagctgcttcacttgggcaatggtgaaggtgggaggttgattggggnaaaaccaggcactccccatntcaacanccanacagggcaccagggcatgtnccaatcaatacagagttccctctgctatctggccatctnccagggaaccagaaggaaggacctagcagcnanagagacactccactgccntggagnanacagtggacactgctcttccnacttccacaaannnaggatgctcatcagctccttctgccccccanccccctttttccatcttttgttcccctaaattaatgctgcttggattttcatcttatttataaagataaaatcacctggaagtgtcaaggagtggggcggggtggcgggnganaagcagccgtgctgccaggtcacccagaccccagacagccggctagccccactgcccgttccttttacgcccaagttttgctccttgagagcagattggctgatgcccctgcaaccccagcccaagctctncctcaaagaccgagtgacataagccattcccaccctcctaggttcacatccagggctgtntcttccttgggggaggagatggtgtcgtttagatcagggtaaggcagtcaggcgggtgttcaccactgccttttcttcctctgagcgtgagaacactgaacccagccactgcccctggtcccttcctgaaatntctaataaatccttttcccttcttgagcta

SEQ ID NO: 664751 - DNA, 449 bp, Homo sapiens
gtgcttgatatcacagaggaaactctgcattctcgcttcctggagggtgtccgcaagtgttgccagtgtctgtctgcagattggctacccaactgtgtgcattcagataccccagttctatctattcaacgcggatacaaactgagatccctggtccgtggtgtactgtggcaggactggcattacgaccatatccacacattggcctgcacacaaaggtcgaatgggcgcattctcatctggagccgtagaaatcgcatataccttggtcccggtgtatggggttggggatcccgtagagccacttggtactacccgcggcaattgagtttgggcggcccaataggcccttgggtgccaccgcaatgctccaaatccttaaagtacccatttggccctttttccaccctttgggggccctttaggtgcccttttggtggcctttagga

SEQ ID NO: 664752 - DNA, 989 bp, Homo sapiens
  misc_feature (5)..(5): n is a, c, g, or t
  misc_feature (287)..(287): n is a, c, g, or t
  misc_feature (307)..(307): n is a, c, g, or t
  misc_feature (314)..(314): n is a, c, g, or t
  misc_feature (318)..(318): n is a, c, g, or t
  misc_feature (338)..(338): n is a, c, g, or t
  misc_feature (377)..(377): n is a, c, g, or t
  misc_feature (408)..(408): n is a, c, g, or t
  misc_feature (410)..(410): n is a, c, g, or t
  misc_feature (428)..(428): n is a, c, g, or t
  misc_feature (434)..(434): n is a, c, g, or t
  misc_feature (436)..(436): n is a, c, g, or t
  misc_feature (457)..(457): n is a, c, g, or t
  misc_feature (469)..(471): n is a, c, g, or t
  misc_feature (502)..(502): n is a, c, g, or t
  misc_feature (612)..(612): n is a, c, g, or t
  misc_feature (615)..(615): n is a, c, g, or t
  misc_feature (766)..(766): n is a, c, g, or t
  misc_feature (826)..(826): n is a, c, g, or t
  misc_feature (959)..(959): n is a, c, g, or t
tctgngcccatttcgcaccaaccccagcatgatgattgatgacctcctgactccatgctcaccagggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagctgcttcacttgggcaatggtgaaggtgggaggttgattggggnaaaaccaggcactccccatntcaacanccanacagggcaccagggcatgtnccaatcaatacagagttccctctgctatctggccatctnccagggaaccagaaggaaggacctagcagcnanagagacactccactgccntggagnanacagtggacactgctcttccnacttccacaaannnaggatgctcatcagctccttctgccccccanccccctttttccatcttttgttcccctaaattaatgctgcttggattttcatcttatttataaagataaaatcacctggaagtgtcaaggagtggggcggggtggcgggnganaagcagccgtgctgccaggtcacccagacctccagacagcccccagacctccagacagccggctagccccactgcccgttccttttacgcccaagttttgctccttgagagcagattggctgatgcccctgcaaccccagcccaagctctncctcaaagaccgagtgacataagccattcccaccctcctaggttcacatccagggctgtntcttccttgggggaggagatggtgtcgtttagatcagggtaaggcagtcaggcgggtgttcaccactgccttttcttcctctgagcgtgagaacactgaacccagccactgcccctggtcccttcctgaaatntctaataaatccttttcccttcttgagcta

SEQ ID NO: 664753 - DNA, 401 bp, Homo sapiens
cggcacgaggagtaatagggtgacaagctggccttggagccaggctagtgggaaagacctgagcctgcagctttcaacagcgggctttcctggacttctacttcaattgcagagagccgttcgcagagacttccactgtagctctgtgccagggcggtagagagtccttggtgactttggccaggggccaggatgggttctgcgtggatctgagttgcttgggggagcaagtcctccaggcctgtgcctggggtcctggtactgaccgtcctcccccactgccctagtaagggcactgaacccacatcctggatcttgagaaaagctggggccgcctgtggttagcagctgctttctcaaatgacatatttgggatattttctttttcttcccaaacctga

SEQ ID NO: 664754 - DNA, 311 bp, Homo sapiens
atcgctgtccattttggaggtgggcactgagggcatgttctcaaaagcccgccttacgtcccaacggcccaaacgtattgggcccaatctaccggcatctacctgggaaatacagttgcacttgtgtagttatgggttatcgtcaacttcaggcaggagtagaaatcatatttcttttaattgaagctgcttctgacagcttggtatatgccttatgagttactaagtacatttcaacagaaatcagatggtatctgctctctcagaaatccggtctcccattcccgcggcgccgggcggccgcgcgccga

SEQ ID NO: 664755 - DNA, 380 bp, Homo sapiens
  misc_feature (32)..(32): n is a, c, g, or t
  misc_feature (184)..(184): n is a, c, g, or t
ctcggcctcccagagggctgggattacaggtngggaccagtacgccgggcctacaaggttttaaattatttttcaaaaagaatacattcatgagattcaaaattcaaaaagcacaaaaagataatgaggaaatccccctccaatacttggcctgccccccaagtaccacgagacccgagtccgncaaggcaactggcatgaggcttcttgaggctctctctagaaaaattctatggaaataaaaacaaatatgtggggaaaaaaccacacataaatctttattaataattctttccccttttggaaacaaatggacaaaatatacactatcctgcccctcaaataggttacacgaacaataaaacccgggaaatgacctg

SEQ ID NO: 664756 - DNA, 235 bp, Homo sapiens
gaagctggaaatcaccagggattgggtcagtggtcgctgctgtcgtagctgcattgaatccgtggatggatattgatgcgacgtcccgtcctagtcgattgccaccttggtagacgagggatggctccgcaccctcagagtaggagatcaagctccaggctccttcttggttgtcatagtgatcgggtaagcttattgccccctcttcttataccctatagagcttctagactag

SEQ ID NO: 664757 - DNA, 1163 bp, Homo sapiens
  misc_feature (698)..(698): n is a, c, g, or t
cagaaaggccatgtacaatgaggaagtactcacgccgctgaatgccgaaggtctgaccagaaaaagaaggagagaggttctcggcaactgtctatcatcaacccatgtgtggttggttgacaacgaactggcgtgtcacccggaggtgcggcttcacaactgtctggacacaatcgccgtagattattatcgctgactggaatgcatgtgccgtcgaacaagctgtatgagccacgggacaaaggaagaccgctttccagatcagaggaacggtgaggcaacacatttgacgataggtgcagggtggtgtattccccgcgcggtgaaccctgtttcctggactgcagtcgctgcaacctgggtacgcgtactaccacgcggtgtgcaaatgaatggggctggtgttgtgtccatgtatatgacagagaccgggctagggtggccattattgtaactatgttgatcgggtagccctcatggatcactcaaagtccgatgtatgtccatcataacgaatggaatctagcagcgaagaagatcttcaggtgcatggggccagtgttcagatccatagaattggatggactcacgtgagacggttgggagagaaatcctccagaaaagcatgcgttaatctgactgctatacgtggccaggaaacgacaaggaaaaggcatgtggcgcgcataggccgcggnattcaccaagggagagggctgatggaatccttcgataaaccttgaccaggatgatgaaactactgatggatataccgcgaagtcgaaggcggcaaaacgcaattgagtccgagaaaaggacgtggtgttgacttcaccaattagtttttaagcgaaaagattatggaaaagtcttaatttcccatcgagacatctccaggggggcataaccctcgcagaaatcaaggaggtaagcgattcctgggacgcaattgggcaaggtgtttgcctcctgcgaagattgggggtgttcctggagagatggtcctgttggggaaaacccttgaatctaagagttaagccttggagttgaactggaaaaaaggcacaacccccgagtttaaagggaaagagcacaaaaggacccgattggggtgagcgcgcgccctgcgtcccaccgggaaaaaaggactcttgctataccag

SEQ ID NO: 664758 - DNA, 808 bp, Homo sapiens
ctgacgggcagtttgacgtggcggaacagaggaccccggaggagcacatgaaggagaagatctgaccagatgggatctccattgcccagctcctgcccacactcccgcctgttgccctgaccagagtcatcatgcctcttgagacagaggaatcagcactgcaagcctgaccgaaggccttgaggcccgaggagaggccctgggcctggtggagtgcgcagagctccatgctactgagagagcaggaggcatgacatccgtcctcttcatactctagttgaagatcaccctgggggaggtgacctgcatgccagagtcacacagatcctccccagcagatccatcagggagccatccagcctccccactaccatgaactaccactctctggcagccaactcctatgagtgactccagacaaccaagaagaggaggggccacagcaccttccctgacctggagatctgagttccacagcagcactcagtaggacggtggccacgttggttcattcatctgctcctcaaagtatcgaagcaggggagcccggataacacaaggccgaaatgatggggagtgtcatcggaaattgcccaagtccttcttcccctgtgaatacttcaatcacaagatatcagattcactctgcaattgtactaagacctaggagctgactggcagtggacccccaacggccaaccgtgtacactctccgccacctgctgcagctctccactctggctgcaggtgaccacccgatcatgccactacggctcctgaatatactggcctaacgcatcagcacgtc

SEQ ID NO: 664759 - DNA, 818 bp, Homo sapiens
agatattaatattaactggctgctgctgttggttaggaacttgttgattagtcatctccgcctttttaaaatgcagtgtaacctgcacatcttttatgttaatgaatgcaaatggccaatgagtgtataaatacttttcagcatcaaaaaaaaaaaaaaaaaaaaaaaaaaaaaaaaaaaaaaaaaaaaaaaaaaaacaaaacaaaaaaaaaacaaaaaaaaaaaaagaaaaaacaagaagccgaacgagaagcaaaaagaagaatagaacacaagagagagacggagagcgagacgaaatataaatcacccacagagaagagtcacgacagacaaacgaccccccgcggacgtgtgaaatgcgccacgagagcacacctcgttcacctaaaaaacccccctaaatactcaagcggcgcgccagcccaccccggaactagaggagtcgaaacaacaactcagtcaccagtaaaaacaagagccgcaaataaccgcctacgacaggcagttacaaattaaaaaacaacaccactaacacggcgtcgccaaaaaagacgcacacaacaaaagccgcagccgcaagcaactaacgaaacagcacgagcgatctccgaaacgcgatgaggagagtacaccgggagaataaaacaaaagaaaagtgaaaaacaagtcaagaactacccagaagaacgccaacggccacacaacacgccgccacacgctcccgcacacgtacgcgtcagcccgacaagcaccagcagctcaagccataacgaaccaccacgcaaggaccagagtgccacacccacgatccgacc

SEQ ID NO: 664760 - DNA, 2139 bp, Homo sapiens
  misc_feature (780)..(780): n is a, c, g, or t
gtgtttgatgtttatgattgttgttaagtataggtggtgtggtgtgagtgctcgatgatacgttgtagttagtgatttatggtgtggggttgtgtaatgttttttatgattgtttgatttgttgttgtggttgtatgtagggatgagtgttgtttgtgagtgtgtgatgtatagtgagtgtatgtgacattgttaggtttctgagtggattgtttgtgttgggtcgtatggttttatgtggaataatgtttgtgtcgtgatagttatggatgtttgtagataatgatgtatgatggtgatgtatgaggtgagtgagtagtgtggttggatgaggtgtgatggtgtgtcgtgtgatagggtgagagagagtgtgtgggtgtgattgtgatttatgatgtgtaagtttgtctttgtgtgttgtttcgggtgccttgttggtgtgccgcgttgtcggcgtaggcgcgttttgtagcgtgggtgtgtgtgctgtgggtgtgctccttggtgtgtcgtggttgttgggttgctgtgttctgttggttgtgtgttcgtttgttgcctctggctgttggtttctggttgttttcttctggttttgttattgctaccttatttgtgcttggtgtgtgtgttggtttgtgtgtgcgtcggtggtgtcgtggtggcgttcggtcggtgtgtgtcgtgttctggttgttgtgtgtctcgcttcgtctgttctttgttatgcgttacttgctctctacgtggtcgcattgggtgggctggcgttcgcgctcntggtgtgtttgcttgttgtgtgtgcttggacgtcgtgatcgtgctgctgtgagctttcgcgcgtgtgtggctgttgtggcggtcgctcgtgtgctggcgcagcgtggtgatgcgggcgtgtcgcctcgctcggtgtggtgtggcgactctgcgtgtgtgagcgtcgagggggacacggggtgtgtcgctgtgtgtgtgtgtacgcggtgtgtgtctggttgtgggtaggtcgcttgtgttgttcgtcatgcttgttgtgtcttgttgtgggcgggtatagcgtgctgcgtgctggtctgtgctgtgatggtgagtgtatgtttgttggtgagggtgtatagtgcgtgtggtgtgttgttgggtgtgttaggtgggtgatatggggctgtcgatcgtgggctggctagagtggatgcctcggattgagttgtaatgcgttgtaatgtagcttcgttgataatgtgttgtatggttttgatgtagtgtgtcgttgatgatctatagtgtatgtgggttcgtgcgtttatggtttggtcgtgtggtgtggccggttgtctggagagttggttattggaggtagtgggagtggatttcgtgtatggattgcaatatagtagaggatgttatattgagtggtggatgtgtgcgtgtggtgttgtgctcggtggtggttggggtgtgtgtgggtgcgtgttgtcggggtggcgcgtcgaggtgctgtcgttgtcgtttggtggccagtggtggcgtggagggtcgcgtgacggattgcctggattagtgggggtatgatctctcgtttggtcgggtttggtgtctgtaggtttgtgtggaggccggatcgcctggcgttggtgtgtgtctgggccgtcgtcgtgtgcgtgcgggagggatgggaggtgtttgtggcttttgtgttgtggattggcgggagggcgtgagtgcggggggagaggtgtgtgaggttgtagttgttgtgtttagatgggtatgtgttgtgagtggtagttgttaatggtatgtatggtagtagtaggtgagtacagagaatcgtaggtaagcgtggttgcgtggggttgtctgtgtggtcggtttgagaagtagtccgcatcatgctggtcagtcagaaagataaggccagttcctcagagccaatagtaggagtgcaggctacctggtgatcctctgaggggcaggagtgcttcctggtgtgtgtatgagaatcccttgccatgccttgtattcactggcagtgaaatgcctctgtggtcctgtccaagatcgtatcgttcactgatttctgaatcatgttctagttgcttgacctgccacatgggtccaaacttcatgggagcataa

SEQ ID NO: 664761 - DNA, 150 bp, Homo sapiens
catgttccggacattatccgctgggctcctacgacagctttgatgccccaagcgattacatcattacggagaagacagatcttgctagcagaagaaggacagtgaggggttatgggttcgtagctccgagggggccaaggacgcaagacc

SEQ ID NO: 664762 - DNA, 158 bp, Homo sapiens
  misc_feature (107)..(107): n is a, c, g, or t
  misc_feature (127)..(127): n is a, c, g, or t
tctccgtgtatcaaatggtcttgaaactcttaaaaagattgttattacctcaaatagaaagggtgattgtatttgatatatcctggggacactgctcgtatgcaccntcttaataaaatgaaagccnattaaataagacatcatttaagggatagagg

SEQ ID NO: 664763 - DNA, 156 bp, Homo sapiens
aaaccctaattacgcagtcagttttcttttaggtaagagcaataataccaaataataattcttgatacatttaaagaaacagcccctccgccctaaataatcatagttctttctttggtggtagagcagagtggttaaggatgtagactcgagaca

SEQ ID NO: 664764 - DNA, 483 bp, Homo sapiens
gtaacagttaggcaggagctaaaatcttcaggtagtgagggaatgataccacccatacttagatagctcctcattttcctactttcacagatactgattccatctttagacattttgaacaatgcaacaatgttaattttcttatactttgttcaatatactttcatgtgtagtcaggtactagcgttttcctttttgccccgttttattctggttattagtaattcactagtttctaaagctaattgtatcatcattgctttttacacttgaaatatccagtcactatttgtgcagagccaattcaatttttcttcttgaaagaatataactcttagctacaagaatggtccagcaatggtaatagaattattctccatggagaatacctttttgcttctctagctctcccttttaacattagccttaatctgatagcaaaatcagcagtcctaaaacaaaaggaaaaataatgatgtttct

SEQ ID NO: 664765 - DNA, 158 bp, Homo sapiens
cacacatattagccctggggcttctccagtgatccgaggcccggaccacgggtgacatatctggtggagaagctgaacctcgtgcacatgactcggacagtactacgctgactgaacacacgcgactgagcacacgcgactgaagcacacgcgactga

SEQ ID NO: 664766 - DNA, 326 bp, Homo sapiens
gtgtttcatttgtcgaggagaggaagatgcactggttcaccaagtaatctggtccctgaggaatcagtttatggtgagaagagagtctcgattatcgagaaggagatgacaaaattgagtacctgacgcctggaaccccttccgctccaagctagcagcatcaatcctgggtggtgtgaaccagatccacatcaaaccgggtggctaaggttctctacctcgaggggctgcctcgtggcaccacgtttctcccatcgtctctgaacatcgattgagtccggcacttgtctacttactatagctagtcgaggttcttcccatccgac

SEQ ID NO: 664767 - DNA, 175 bp, Homo sapiens
cgcgatgcgcggagaatgactggttctagatcgttgatccaacagattgtgtaatgcgtaaggttggctcttccccagcaccgtgggggccctggcacccctttcagatgttcccaggtcttgcctatgtggataacatgcaactctggggcattgtaggtacgccatttcttga

SEQ ID NO: 664768 - DNA, 367 bp, Homo sapiens
ttttttttttgagacggagtctcgctctgtcaccaggctggagtacggtggcatgatctcagctcaccgcagcctccacctcccaggctgaagcgattgccctgcctcagcctcccgagtagctgggactacaggcgcatgcaccacgtccggctaatttttcgtattttagtagaaacggggtttcaccctgctggccaggtcggtcttgatctcccgaccttgtgatccgccggcctcggcacccaaagggcctagattgcaggtgtgagccaccgcacccggccccatatcagttcttttagtgaattgtagctagcagaagcacgtagagaaggaataagtagaataaagtgtcatagaaata

SEQ ID NO: 664769 - DNA, 1001 bp, Homo sapiens
  misc_feature (424)..(424): n is a, c, g, or t
ctgcaacctctgcctcctgggttcaagcgattctccatctcagcctcctgagtagtcatgtgcaactacacggtgtgtgccacgaggccatggctaatttttgtgttttatgtgtgtgatgacggggtttcatcagtgttcaccagcgcgtggtctcgaacgtccatgagactctaagcctatcctaccctcactcatgcttctcaatagtggctgggacttacgaggtcatgagcttatcatagccttgatcctcttatgtcacgaattctcttgcatcatgtctaatgcgtgttttgttcgcccatctgagctgtttgtccaaaattcatatccatagccacttcatgggttcctaatcctgacaagtgtccgaagcatttacccagtgataagggttcttgcgtgcatttgtacccgtgcnctatacgttacatattcggtcgttcttgcaccattgctgattagacttcagggagcacgtctattagaggtgttcacgtccgcgatatagcatttggtaatgggtttccttagaacaatgacggcaccgtcgattcgatcggtgccaatatcgcttttggggctcatggcacaagactactttgtcaaatattatccaagctcatatagcctccttttgttgtggacagttgtagaagtccggacttggacttgacgtgtgtcaaggctgcatcgctctgacgcttccgttgttgtcctgtggctctgggcgagatcaagccagcggttcccaaatgtactatgtagtttaacttgtaatatggcgtctttttatggggcttgggtttctctcaaagaatcacgaatttaactggcactgtttggctattacaaattaccgtggaccatggcttattttattggccttgggaatgcccttagtaaatgaaatctaaaatgtgacatttttgtgggagaccagaaattcaatctaaattgaatctggcctgagggtttaaaagcatttttcgaggaca

SEQ ID NO: 664770 - DNA, 455 bp, Homo sapiens
gcgtcgacgaggccttgacctcccagacttaggtgagcctcccgcctcggctgctcagagtagctcagactgcaggtacaagccacggctcctggctaatttttaatttttttgtagagatgggatttcactgtgttgcctaggctggtcttgaactcctaggctcaggcaatcctcccaccttggcctcccgaagtgctagaattataggcatgagccccccaccgcatctggcaataggaatctttataaatgatttcagctaattaatattcctttgaaatttagaccttatttgagtatcagttttatactttggacatataaaatacattggatagatttgcttttcatataaaagataatcactttgggaggccagcgcgacggatcacgaggtcaggagtttgagaccagcttggccaatatggtgaaacctgtctctactaaaaata

SEQ ID NO: 664771 - DNA, 261 bp, Homo sapiens
cattccccgtactgaaggccaggagaagaagggtttttttgaagatcgtcgcccttctgccaactgcgacccttttccggtgacagaagccttcatccgcacgtgtcttttaaaggaaaccggcgatgagcccttccagtacaaaaattaagcggcctagacctccagttgtggagcccttcttagtttttaatccaactccaactcttccccttctcccagttgtcccgattgtaattcaaagggtggaatatcatggtc

SEQ ID NO: 664772 - DNA, 433 bp, Homo sapiens
taaatttaaaacttctccatagtagtttggcaaacgtgacacatcagctaactgctatctcctttatactttaaaatggtaaagtctgaataaaacactgactcaggagggcatgaatcttatctaagctttataaagaaaaacgaagcacactaatgtaaaacattaataattccaacagttgaatggggcagacactttaaaagtgatctattatttttgctgtcagtcactcataaagccagacagaaaaatgtaagaattatcaaacttccaaaccacctttttccctgttcatgcacatatctccctcgtacgttgatacttcctttgatgagttaccataaatgtcgatcttgtgactgaagtgttttttagtcaaggaaaactgattatcccaaaattaaagtgcaaaacgatagcatgcctgagt

SEQ ID NO: 664773 - DNA, 180 bp, Homo sapiens
gcatgttatcattctctactgaaaatccggcgctacttacctgccaccggtacatattttgtatggcgcgcatgtatacctgctgcttattttaaatcgcagccaaaagatcgtccagcgcttctgcattactgtaagggatcgtatccccggcgtattctggcgacgggatgttaatcg

SEQ ID NO: 664774 - DNA, 166 bp, Homo sapiens
ttcaaagttgcacctgtgcgtatatctttaacttatcaacatctaagtttcagatttctggagtagaaattgacttgtataagccggacaattgtatatacatagttgttttgactgcatagagtaaaattccgatgtctcgattttctacctctatcagtctgga

SEQ ID NO: 664775 - DNA, 843 bp, Homo sapiens
  misc_feature (458)..(458): n is a, c, g, or t
ggccgggcgcggtggctcacgcctgtaatcccagctctcaggaaggctaagaggcaggagaatcgcttgagcctgggaggtggaggttgcagtgagccaagatcgctccattgcactccaggcctgggtgacagtgaaatcgtccatctcaaaaatatatcacagaataagagtatgtcttgtcatccagctcctatgtcctgttatccagctccaagtacagctgtgtgtatatcaagcgattttcaaaaacctttaaactaccaggatgaagatccagatgtttttccatgggttaagaagacgaataccatcatagcagaaatcatgaaaaaaaacgctgttgtcggccggcggcgctatagtgccaccgcagttgaagagcgatgtgtttgtataacactcgaatccgggggagggggcgcgcggcccctcggaaaaaggacataggcgtggcncttgtgcgccagaaacgagggttcggcctgagaaagggagcaaccgtgggggcgatgaaaagaccgccggcttgggagttttgcttcgcccagatgaattaaaaaaaaccgcgctggggggggaagaagcacgaagagggtgtttcttgaagcagagttcccccccatcagtgggcgggctgccaagggaagaggcagcacaccgggaattttttattcacaaacgtggggtttcaccaagaggagacgctcagggattattacaaatttatgccgcgttcttgggtggtgacttggaatttcggctcaacatcggcccattttggtactttgggtttactccttggaattctattcacacagcgcaacaaaatcacttattatc

SEQ ID NO: 664776 - DNA, 1012 bp, Homo sapiens
gggcgaggctgcaccagcgcctggcaccatgaggacgcctgggcctctgcccgtgctgctgctgctcctggcgggagcccccgccgcgcggcccactcccccgacctgctactcccgcatgcgggccctgagccaggagatcacccgcgacttcaacctcctgcaggtctcggagccctcggagccatgtgtgagatacctgcccaggctgtacctggacatacacaattactgtgtgctggacaagctgcgggactttgtggcctcgcccccgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgagaaaaaaaaaaa

SEQ ID NO: 664777 - DNA, 821 bp, Homo sapiens
agcaagaagtgactagccctttttggggagagtaaggcatgggaagtttttacagaaagaggaacaactgaatggcctttgaggataaccaagagccctacagttgcatatggactccgtgaccaccttcagtaactttcctgctcattgcacatctttttcaggatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgagaaaaaaaaaaa

SEQ ID NO: 664778 - DNA, 1302 bp, Homo sapiens
  misc_feature (64)..(64): n is a, c, g, or t
  misc_feature (868)..(868): n is a, c, g, or t
tggcctcaaaaggtgactttttttcaaaaaaaaaaattgacaaaatgtgttccatctcccttgngcctccctttcccttccccccttcctgtgctgtgcctccttcagcccccagagatttgaccccgtggcgtggggcgtgggtgtggcaggacagccccttcagatgtgaggctcagcaccattgtgaggggcatttccctcaagtggagggtgttgtgttagaagaggctcctcaagtgttctctcgaaagagagtctccctcgtgtctcttctcttctcgtgctccaccgagtgtttaatacccaccacctttataggggccaacaccgctccaccttcgaacgcgaatctcgtggtggacatttatagttttccccctgtgttggggtgtgcgggaagaggctcacataagttgtgagagtgacactataaagagaaaacacctgtgtgctgtgccactatctcaaaaagtgcactctctgtgggccccagaggcgagtgtctccgagggtgggtataaaatctccaagacactcttctgtgcttgagagacgcccgaagaagacggaaaaaactctcccctctcgaagtaagaatcgtcgaggggatctcatcgggtatcgcccctttgtggagagcggctcccaataataatgtctcttcacaatggttgacgagtgttgggcgaggagataattaccagcgggatgaagatcgtccttgtcgagaagcgacatgtcgcaatttcttttctctctcgggggagagaaccgccacaagtgtgttcacaacctctttcatccctctccagaggggagggttgtctctgacgatctagaaagagacatgtttggaacctgtgcncccctgttgggagcgaattagaaatgttcgggcctaccgagggggggtaattctccacgatcatacaaccaaatggtctgcaaccaattatgacgtgttgtgtgtcatccccaaggtgtattcctccacaacatctaccctactctgatggttatccaccccccaggtgttgtcggccatgttgtcctacacacacttgtcggtcgcgggagaaattcacgcccctccgacgagggtgggtatcaacaccacttttatctcccacttcctatgtgcacccacaagacaatttcccggagacactgtgggggcgtccccccctatcatgtaaacactctatctagtggggccaccaccctctcaaagcgacaacttattcaacaaaaaggcgccatatcagtcacggcctttgacgcaacgacaaacacaccaca

SEQ ID NO: 664779 - DNA, 188 bp, Homo sapiens
ctttctttttggtagagaagggattcactcggttcccaggcggtctcaaacggcgggcctcaagcaatcctcaagcaagcctcccaaagggtggggattacaggtgtcagccaggtgccgggcctctttatttacctaggaaaactggcagcacggaggtcctggtcctttaagtggactagagtggg

SEQ ID NO: 664780 - DNA, 967 bp, Homo sapiens
gggcgaggctgcaccagcgcctggcaccatgaggacgcctgggcctctgcccgtgctgctgctgctcctggcgggagcccccgccgcgcggcccactcccccgacctgctactcccgcatgcgggccctgagccaggagatcacccgcgacttcaacctcctgcaggtctcggagccctcggagccatgtgtgagatacctgcccaggctgtacctggacatacacaattactgtgtgctggacaagctgcgggactttgtggcctcgcccccgtgttggaaagtggcccaggtagattccttgaaggacaaagcacggaagctgtacaccatcatgaactcgttctgcaggagagatttggtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgagaaaaaaaaaaa

SEQ ID NO: 664781 - DNA, 634 bp, Homo sapiens
tccaattccaacagtatgagctagttacacatcacagaccttggatcaagtgacaggttctgtgtctaacctgagtcgactcaaccatgtagccatagcattgcctgatgtggaaaaggctgcagcattttataagaatattctgtgggccacatttagtgaagcggtccctcttactgaacatggagtatcatgatggttatgtcaacctgggaaataccaagatggaactgcttcatccattggcacttgacagtgcaattgcgggttctttgcataaaaacagcgctggaggaatgcatcacatctgcatcgaggtagattatattaatgcagctgagatggatttgataatataagaagatgcagcttctacctgaagaggtcaaaatactatcacatggcagaccactgatgattctgcatcctaaagactgtggaggagtccttgtggaactggagcaagcttgatttatatttgctagcaactcaattaattgacctgtttcatcatggtaaagtgtagcagtcaaagactgatataccgaaagatgaaaggtagacatatgtaagaacatacatatgtgtatgatccagactagcaaacatattagtagaatcgaatttgaagaaa

SEQ ID NO: 664782 - DNA, 833 bp, Homo sapiens
gggcgaggctgcaccagcgcctggcaccatgaggacgcctgggcctctgcccgtgctgctgctgctcctggcgggagcccccgccgcgcggcccactcccccgacctgctactcccgcatgcgggccctgagccaggagatcacccgcgacttcaacctcctgcaggtctcggagccctcggatattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgagaaaaaaaaaaa

SEQ ID NO: 664783 - DNA, 389 bp, Homo sapiens
  misc_feature (119)..(119): n is a, c, g, or t
  misc_feature (339)..(339): n is a, c, g, or t
  misc_feature (341)..(341): n is a, c, g, or t
  misc_feature (384)..(384): n is a, c, g, or t
  misc_feature (386)..(387): n is a, c, g, or t
tccaatttatttcccccctgaagttctgtttaaagatgaagaattcattctttgaaatagggattgaacctagaattatgacctaagaaatcctaatgccataatggcccgggcacggntgtcacgcctgtaatccccagcactttgggaggctgagtgggcagatcacgaggtcaggagatcaagaccatcctgtgaatggtgaaaccccgtctctactaaaaatacaaaaaattagctgggcgtggtggcaggcgcctgtagtccccagctactcgggaggctgaggtgggagaatggcatgaacctgggaggcggagcttgcagtgagctgagatntngctactgcactccagcctgggcgacagagtgagactccatctntnnat

SEQ ID NO: 664784 - DNA, 100 bp, Homo sapiens
gcccagagttacggcgcctagcaactcccatcttttatctatctggctggcagggaaggaaagaacttgcagtgttgctgaaggaagttgctagggggcc

SEQ ID NO: 664785 - DNA, 624 bp, Homo sapiens
  misc_feature (507)..(507): n is a, c, g, or t
cccggtaagctgcagtgcatctaccccgggcacaatggctacggaaaatggcgcatcgtgcatgccggtgggccgctctggcgacccctttgttttctgcaccgaaggcatgccgcagcactgctgggtggcccttaatccgctagccggcaccaccatgaaaatttgcaaatactacaaccgcatgtggatagagacgtatagaaaaatctgccccaaagccatgcgcatggggcattggcaaggcaagggcgcgcctaacacaacgccgtttgtgcattaaacgctggcccttggcttatgcgtgacgtttgcctgccttttattggccttacctcagagctttcaaacaggaacaccatcatgaaaaacaaaacacttcattcttgccgcccggccgcttgggcgctggcggtgggcgcatgcctgttgctgctgggcacgcccgcgcgtgcgcagtggctggtgcaagacgaaaaactgtacaaactggtaaaagagggcatngttgacaagattgctacatcgggcaacggcaaaggttcgtttaaaaaagatggtacggttaaggacgatagccacgaattccatgcgctaacgcttactactaaagagctattgact

SEQ ID NO: 664786 - DNA, 244 bp, Homo sapiens
gtagagacgggtttcaccgtgttagtcaggatggtctcgatctcctgacctcgggatctgcccgcctcagtctcccaaaatgctgggattacaggcgtgcgacctcgcccagccgaaatctctgaattcttgagagagagatatctggtcatttcagtgggtgcccccgggtgtggtggctcacacttgtaatcccagcactttgggaagccgaagcaggcagatcgcttcagcctagtcgacg

SEQ ID NO: 664787 - DNA, 496 bp, Homo sapiens
  misc_feature (287)..(287): n is a, c, g, or t
ctctgggtgcctgccttctccttactgggacagtaggtataagagcttggttaggccgggtgccgtggttcatgcctgtaatcccagtgcttggggaggccgaggcgggtggatcacctgaggctgggagttcaagaccagcctgaccaacatggagaaaccccttctctattaaaatacaaaattagccaggcatagcggcacatgtctgtaatcccagctactagggaggctgaggcaggaggattgcttgaacccgggaggcggaggttacggtgcgccgagantctgccattgcactccagcctgggcaacaagagcagaattccgtctcaaaaaaaaaaaaaaaaatgctgggcgtggtggtgcatggctgtagtccagctacttgggaggctgaggcaggagaatcacttgacccgggaggcggaggttgcagtgagctgagatcgagccactgctctccagcctggctgacagagcaagactccatctc

SEQ ID NO: 664788 - DNA, 966 bp, Homo sapiens
aatctgcgctcgtgcccttggccgaccctctactctatgatgtgtgactgctctcatcatccaggtgctgagcgcaagatcgggctgtgtacccatccagacctgtaccccgtcgtgctacatttcctgccccgtgcataactcgaaatggaggtagtgcgctcggatagcccaaactggcgtgcagctcgaattgttggaacgttcgaccgcaagctaactgaatacgataagtcctagcttaacatggcgtatcgttcttgctgataggtcatcattcctacacggcgggatttagatccccatgcatcactgtgctgaccaggtctgtgttctcatccacttcactagctcgcattgtccgttgcatcagagactccaaactcatcgccttccttaaccatgttaatgtctagcaatctctttgtgattggctcagtgccagtgtcctcctcgcattgcacgttctctggggtccttgttcaccttgagttttgtacctctgctgctgacgtatttctgttctcctctcgtcgtgcacgcagggcgtcagacgtttctctttttcttctcctcaggtccatatctcgtcggtcgcaggccgttggggtcgcatgaagctcagtgctccgttggaagcaggttcttaggtaacttccttcctttacccctgtaaggttcggttgtgtgggtctcaacgcgcatttggtttgccttctaggcttcacctggtctgtggattattccctgtgtgacggttcctggtactcgtggttcttccccgctcgagggctctgtagggttcgttcgaggggccagggactgttatgcttttcgaacacgcttgctgggcttcccggcccggcatgggatggcccccgtcagggaacttccggttgaccccctcgctgttgggacacttgcccttccgattgggttcgcagatgtttcggttaagcaaccctg

SEQ ID NO: 664789 - DNA, 199 bp, Homo sapiens
tgatcctgtcctgttcaagtccagtggactctccttcccaactgtggaagaagccagtgttacctctgtgcacattcatttcaatattccctgacctacagatgtcatctgttctttgcctccttctttgaactgcttgtaacatcttactggttccttcattaaccatgaattaagtaaaatcatcagtgagaatgta

SEQ ID NO: 664790 - DNA, 365 bp, Homo sapiens
tcacagagccggaggtgagcaacaggtgaatgaggggaaacttcttctgtatttctagccctcccatcacttgcatgaccacctaagcaccatgtcctgtcagatcagcagcagcattagattctcctaggaacatgaaccctgttatgtgcatgtgagggatctaggtttcactctccttatgagaatctaatgcctgatgatctgtcactgtctcccatcaccctagatggacagtctagctgcaggaaaacaagctcagagatcccactgagtctgcattatagtgagttgtagaattatttcattatatattacagtgtagtaataatagaaataaagtacacaatatatgtaatgtaaaa

SEQ ID NO: 664791 - DNA, 107 bp, Homo sapiens
gccttcttacaagtaggctctcctgtctctagccctcgtgggctgtcttgagttctgtggtctctggaaccagggggggaaatgtttgtaagtaccctaagctctca

SEQ ID NO: 664792 - DNA, 341 bp, Homo sapiens
  misc_feature (91)..(91): n is a, c, g, or t
  misc_feature (159)..(159): n is a, c, g, or t
  misc_feature (232)..(232): n is a, c, g, or t
  misc_feature (237)..(237): n is a, c, g, or t
  misc_feature (258)..(258): n is a, c, g, or t
  misc_feature (319)..(319): n is a, c, g, or t
cccctcctttctttcaaggacagtgttttttgtagtaaaatccctggtttaaacaaagctttatttagggggtaaagttaagctgctaaanccccatgttggctgctgctgttgaaaaactgggctttgggagtaaaaaaaaaaagttatttttttgtnttaaagaatttttaaaaaattagtcatgagacttattcttctttccagggaacaaactgattggttttaaaanactanccagttaagtaaaaggggggnggaacatttttttttttccaaaactggaaaaatgaacctggttttaaaagaatgtcccccnaaataaaacatgtgaaccagta

SEQ ID NO: 664793 - DNA, 240 bp, Homo sapiens
  misc_feature (4)..(4): n is a, c, g, or t
gatntacgtcgtagtcgacataacgatgcgacgtgatgcgcggttattccatgacccgcggaagcttcgggaaacaaagctttgagttctgtgggagtatggttgcaacgttggcaacttaaaggaattgacggaagggcaccaccaggagtggagcctgcgctttaatttgactcagcacgggatacctcacccggcccgtatattaatctcataacgaagacaggggtactgagctcg

SEQ ID NO: 664794 - DNA, 354 bp, Homo sapiens
  misc_feature (37)..(37): n is a, c, g, or t
  misc_feature (114)..(114): n is a, c, g, or t
  misc_feature (130)..(130): n is a, c, g, or t
  misc_feature (245)..(245): n is a, c, g, or t
  misc_feature (294)..(294): n is a, c, g, or t
  misc_feature (318)..(318): n is a, c, g, or t
ttgaagtatcgtatcacagcaggttacaataactttnggataaaaggcaattggtaaactgtccaaaacaaggttccaaataacacctcttactgatttgaccgctcacccatnacattattcccaaatnagtttttgattcaaaaacatgaaattagcattctcacctgattattttaagcatattgaaaaaggaaactaattggaccattttctatttgtctattgttatacaaaaaggctanacaattgttacactttattcaaaataaaaataaataagagagtggtttnagaattaagtgttctacaccattnctactaattcttcaaaaagtgagaaatgtagctggt

SEQ ID NO: 664795 - DNA, 522 bp, Homo sapiens
  misc_feature (17)..(17): n is a, c, g, or t
  misc_feature (43)..(43): n is a, c, g, or t
  misc_feature (53)..(53): n is a, c, g, or t
  misc_feature (70)..(70): n is a, c, g, or t
  misc_feature (150)..(150): n is a, c, g, or t
  misc_feature (185)..(185): n is a, c, g, or t
  misc_feature (242)..(242): n is a, c, g, or t
  misc_feature (463)..(463): n is a, c, g, or t
  misc_feature (465)..(465): n is a, c, g, or t
  misc_feature (518)..(518): n is a, c, g, or t
acatcaggttgtggaancagttacaaaaggttcattttatccncagatccccntgtcaaagggtgagacnaaagttccatggtaagtccttgttagagttagcacatcctaaaaaaaaacttggagactgttccagtagcccattctgantgtgtgaccttcatggtagctttgaattacagtcncccaaatagagtatcccatgagactttaaagaaaaataatagcaggggccgggcgcnggtgcacgcctgtgatccccagcctttgggaggccgaggcgggtggatcacctgaggtcgggagctcaagaccatgctgaccaacatggagaaaccccgtctctgctaaaaacacaaaattggccgggcgtggtgcgcatgcctgtaatcctagctactcaggaggatgaggcgggaaaatcacttgaacccaggagacggaggtgcggtgagcgtagaancngccactgcacttcaccctgggccacaagagagaaactccgccaaaaaaaaagnttat

SEQ ID NO: 664796 - DNA, 985 bp, Homo sapiens
  misc_feature (565)..(565): n is a, c, g, or t
gatccattgtggaagagctgctggatcatgtgcctggcaccagacacttctggggatggtacaggatgtgacaacagtgacctgcatcatcatttgcttcaggccccgaaagcacagcgagagtcgtccaggccagagagtgggcgaaggcgaaaactagaggagggtgcgtcgtcgtactgagggggcgtgagagtaacaagtgggcggacagcgtacagaagaagaaggccatagtcgaggactagcagtcatccagaccccgtgcccacctagactgttttctgagccctccggacctgtagactgagctttagtcgttgtcttcctttaggccttagcaggggggtatgaggtgtgcaggggcgagctgggtgggcattccactctcgcctcatgccaatagagtggcatcatcgcgctccaagacttgcagccggagtagctcgtctgcttgtccgttacgccaggccgaactgcatgctcctcgtggctcatcaccgggttctgtgcctgtgtctctgtcgatgttgagcagggcaaggactggtcgggttctgggttngttatactcctgtgaaaccttctattgtaaggaccattctttttgttatatggacggtctcccatgggcccgtcggggcccgacgttgtcagccgcgagtctcatgttggtaacacttttcaaatccaaaagaacgttgtattgcaggaacttaaaaggggccaaaaaagcttataaatgaagacaaataatggagaataacaataaagaaaaaaaaaaaaaaaagtaaacaagaaaataaaaagggaaaccaacaggggggaagaacaagaacagatgatgaaggtgacaaagaaaaaaatagattacataatagtgaataatggaagtcaattgaaaatgataagtaacgaacaaaagtattatgtagaaacagacaagaggaaaacaaagaggggaaggatataaaaagtgtgtggg

SEQ ID NO: 664797 - DNA, 590 bp, Homo sapiens
  misc_feature (286)..(286): n is a, c, g, or t
  misc_feature (388)..(388): n is a, c, g, or t
  misc_feature (402)..(402): n is a, c, g, or t
  misc_feature (411)..(411): n is a, c, g, or t
  misc_feature (486)..(486): n is a, c, g, or t
  misc_feature (500)..(500): n is a, c, g, or t
  misc_feature (506)..(506): n is a, c, g, or t
  misc_feature (525)..(525): n is a, c, g, or t
  misc_feature (539)..(539): n is a, c, g, or t
  misc_feature (584)..(584): n is a, c, g, or t
  misc_feature (586)..(586): n is a, c, g, or t
aattcgcggccgcgtcgacgtgatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccagggctcccttcacctctcctggtccctcagtcacatatgaaagcnttttacaagataggaactggaatcctcattctcccagttcctgctgttcttaaactcaggagctattttccagcctaggggtagtctgctccataagaggancctagtgtcataancctggagcngggtttggagaagagatctccgggcctacagacctttccaacgaagtgggaagactgcttaaacacgcacacaancccccaataacagnctaagnggtcacacgaaacggccangacttaggcttcgnatgacataatacatttccaggggggggggatacccgttaatttcncntttt

SEQ ID NO: 664798 - DNA, 207 bp, Homo sapiens
ccgaggtcgcacccctgtactccagcctggcgacagagcgagactccgtcaaaaaaaaaaaaaaagaaaaaaaaaaaatagctttaattatcattggtcccttctttatttcctctttagccaattcctgcctttggcttgccaattataatagctgaattctacgcagccttcttaagctcagtcaaccggacgggggaatcctct

SEQ ID NO: 664799 - DNA, 82 bp, Homo sapiens
cagatgtaaacaggagcagcttcaacaattccaattagtctgttacggagtcatccacaagcatgccttgcttttaaacaac

SEQ ID NO: 664800 - DNA, 336 bp, Homo sapiens
ttatacctgtgggtatcatcagatcaggaagggtccagcgttggggacgagccccaagttgagaacagtaagtgaacaattattgtactgaaccacttagttacatgacagctaatcataaacaacctgtgtgtaatatgtatttccttacacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 664801 - DNA, 1814 bp, Homo sapiens
  misc_feature (470)..(470): n is a, c, g, or t
tcgtcagtcgaccactggcagtacgggtcagagtcaggagagcagccatctatgggagtggaacatccgctcaataacgaagtgaaccagtacaaggttcagagcggtccaagagagccactaagtcagcacagagtatatcatacgcgtagaggcatgtagcggtcgaagtcttataacaagctttcagtggaccgaagaagaaaccgatactcacaacattcgaatccagtgtttagtgtatgaatcagcgttgttgtgatagagttcatgcacacaaagcacaggcacgccgtcttgatcccaatttcaccgggagtgagtccgagaaacgtatgaaaagcgttccataggggccaggtgaaacaacaagacagacggacacagtgtggtatgtcggggggctacctagtatacttgcaatgcactagtcgcagagtggttccaagagcacgtgatagcgcacaaanagcgtaggatatgggctaattgtttgcgacatgacagcctgttgaacacaaggcacggggacctctgcgaaggctcagacatccatctaggggacgaaaggcgtggaaagaagtgcaatacaaatcttttcgaaccacaagggcttgagtcccgcatgggcaccttcccgcactttattaggtgtgcctgaatgaggcgacgttgtgtcccctttgtgcctcgtacggaggtctcctttctgtgcgaaatgggcgcgccagatgaagcgctggatacccctgtggacaatatgtcggcgctaagggccccacgcaagtttgaaaacctcccggacaacaaggcctaatgtaacacaatatattctctttaacagtttccctgtctcaccgcaatacgtgggggctctaggcacaagttttgcagacagcctgtttggcaagaacgcggcgcggcatccgggagctccatgtctccggaacgggcataagataattaagagacttaaaccacccttgtgggagttcccttaagcatggcttccttctaattttcaaaagagccaccgtcaatgtcggcctgggcccctgtcaggcccaaactgacaataaagcccgacaggacaggagtggcgtgggcagggcgcgcagaaagccaaaggaaagaagtgactccgacgctcccgagaaggggcggcgcccgaagcgaccaaccaccggggcgtaagcgcagaacacacggagcggcggtcgctacccagaacagacgaggcgctcccctcggatagtcgcgctgatcggagccagctaaaaacaatatagggacgccagacgacaacacgatgtgaccagcgagtgtttcagcaaacaaacgtgcgggataccacgagagagtcacaacgagcgacaacccgtggcggcacccacgtggagccgcgaaccataaccctgcgggtcgggtgtgggcccacagtgggcccaggggactcaacaaggaacgaactagaacggcgaagccgagataacacgaactcgcggcgcaccgaggtcgctcaaccaggcccagtcagctgcgtcagccgcaggacgagtcgccgggtatacgcacaataagagaagccaagccgcagatacagcagtacacccaatgccagagacaacacagcgtgagatcacacagtgcgtaacacgatcgagcaaagcgcaggcaaacggacgaagtgagcgagggataaagcgacacagcgcgcaaatgcgtgccacacaaacgcgatgagacgctaagctcgactctatcactacaatcatccacgacaaccccaaacacacacgcaccacgccgacccc

SEQ ID NO: 664802 - DNA, 968 bp, Homo sapiens
cttgtcgagtagctgtactctctagacgaagtctatgtagttaccaattaatactgagatattttaaaaacatgttccttaagtttaacagtaataaactaataactcgctaacatacaataccattttgataaaaataacttttccaaaacaaaaactaatgagaacaggaacatgtatacatttatgcatttaaatctggcttaataaaagcaggagattttcatgctgctttgcattccaacttaaaaattacacagcatacacacgctggaaaactccactgtgcacttgtgagatcaggagaatgaaaactatgtaatatctcagtagtacaatgaaaatagtttgacttatatcacagcctttcacagaaagggtgtacgggaccattacgggtctccagacctctttgagaaccactaatactttaaactagtgtatttctagaacagtatttaactatgtcagggcacacataactattccctgggtttatcttgttcgctagtgagacactgacacttcgccgacctctttcaaccactaccttcacacggtactacatatgcacgggtataatgggctggttatgcgatagtccatttgtacacaccaatcttcatattctcaatctccttacaatccccgcaggggacccgaactaacttcatagggattgaaaagcaccgcaaacggcaacagagaggtctaagctaggacaagccacgcgtcaggggggacacggactaggactatacatgcaacaccatgaccactactcaccgccctcccctcccaacacgaccctcaccaaactcaacgcatgctagaacaccaacaaccgcacactgcacacctccaccaggacacacacccagcaaaccgacacgcacacaccaacacagcacgacaaccacacaccagccaccagcacaacaagacacagcgaaccaagaaccaaccac

SEQ ID NO: 664803 - DNA, 162 bp, Homo sapiens
gacctgtggctcttggaggtaaagcagtcctctatgactattagtcctcatcggacaagttcttggatccagtggaataaagcatgaacatcacatctgggccgattaggggacacaggggatgtgcctggaacgtacccacaggtcttcgtcctgatgtgt

SEQ ID NO: 664804 - DNA, 235 bp, Homo sapiens
  misc_feature (109)..(109): n is a, c, g, or t
  misc_feature (209)..(209): n is a, c, g, or t
gtactgagtcaccatgtagcctttgtggccttgagttcctggttttcactattgaaaatgggaattataaaatccagagcaggtcactcttacctgtgaagcctccggngaccccattccctccatcacctggaggacttctacccggaacatcagcagcgaagaaaagactctggatgggcacatggtggtgcgtagcaatgcccgtntgtcgtcgctgaccctgaaggagcat

SEQ ID NO: 664805 - DNA, 233 bp, Homo sapiens
tgggtgggatgtgtattggaggggtttcagactgctcagtgggctctctgccaacagcaaagtgaggaaacagtagctagtggatcaagtccaagtgtgctgcccgtgcccccaggtgcccctcccagtgtcacggagccacagagggacagacactcaggcagtggccctcgtcccaggttactacatgttgcccctctggccctgattttctggccaccccgtcggtggag

SEQ ID NO: 664806 - DNA, 409 bp, Homo sapiens
  misc_feature (27)..(27): n is a, c, g, or t
  misc_feature (79)..(79): n is a, c, g, or t
  misc_feature (157)..(157): n is a, c, g, or t
  misc_feature (356)..(356): n is a, c, g, or t
gtaataaggctaactgccaaaattganaaagactttaacccaagttcctgtccattgacagggacattatatataaagnaatatacatactgtaattcaccctcatcaagagttaattttatggccgggcacaagtgtcacgcctgtaatccctaanacttcgggaggcagatcactttgagctcaggagatttgagaccagcctgggcaacgtggcaaaaacccatctctacagaaaaatacaaaaatgagctgggcgtggtgactcccgcctgtagtcccagctgtatacatgggaggctgaggctggaggattgcttgagccaggtagcggaggttgcagtgagccgagattngccagtgcactccgccctgggtgacagagtcaagaccttgtttcaaaaaaaaa

SEQ ID NO: 664807 - DNA, 581 bp, Homo sapiens
tctcttcttgtctgcatgtcttatttcagtaaggcagtcttcatcttttctgaatgtcttatttcagtaaggtggtcttcacactctgatatcctttcttccacttggtcaattcagctgttgatacttgtgtgtgcttcatgaagttctcatgctgtgtttttcaggtccaccaggtcatttgtgttcttctctaaactggttattctagttagcaattccttttgtagcaggaggagccacagacaaaactcctcagacaccgggttaaagagggaaggagctttattcagctgggaacttcagcagacttgcgtctcaaaagccaagctccctgagtgagcaattccgtcccttttaagggctcacaactctaagggggtctgcgtgagaaggtcgtgattgattgaacaagcagggggtatgtgactgggggctgcatgcactggtaatcagaacggaacagaacaggacagggattttcacaatgcttttttatgcaatgtctagaatctatagataacacaaccggttaggtcaagggtccatctttactaccagccccaggtgtggcacccggc

SEQ ID NO: 664808 - DNA, 119 bp, Homo sapiens
cgatctagaggatcccggaaggaggtaaggactaagctcaggtcgctctaagcacaaaggtggtctttctacaaccagatgcaagcggagggatttccctaccacccctttttccccag

SEQ ID NO: 664809 - DNA, 1197 bp, Homo sapiens
ggagtccccggtgttcctttgtcttagacatcactctgatttgtacacgccatggtttcttgctctgttacgtgtcctgctgctccagctcttcagtaagcccatcgcacactcaccacggtgtttctgtacatttcctatagtgttaaggtcatcttcatcatgatgtcagtgttcaaaaagtttcgaactttggaacatttgtgatttctaatttttagattacagacaatcaacctgtatttgtatttcccaataaaagattaaaaagtttgatggttgatagttgagtgtcaacttaattagagtgaaggatgcaaagtattgttcctggatgtgtctgtgagggtgtcaccaaaggagattaacatttgagtcagtggactgggaaaggcagacccatcctcaatcttggtgggcaccatctaatcagatgccagcatggccagaataaatgcgggaagaagaatgtggaaagactagactggcttagcctcccagcctgcatctttctcccgtgctggatgcttcctgccctccaacatcagactccaggtgcttcagctgtgggactgggactggcttccttgctcctcagcttgcagaccacctattgtgggaccctgtgatcgtgaaattccccttcatatacacatgtatcctattagttctgtccctctagagaaccctaatacaaaaagttaaagaatataaacgaacaacccaatagaaaaatggacatgagccatgagcagttgcctcccagaagaggagacaaagggaacgaacaatggctggggtggtcgcggccccaacatgagaatgcagaacacaagcaagccagggtgtggctgaggatttgggcccgatcagagccatacttttaccctgaattctactagttactccaattccattttctcccatggaatcacgaagagcaagacccactctgttccagaagacctataagctggaggtggacaactcgatgtaaatttcatgggaaaacccttgtaacctgacatgtgagccactcagaactcaccaaaatgttcgacaccataacaacagctactcaaactgtaaaccaggataacaagttgatgacttcacactgtggacaggatttccaaagatgtcagaacaagactccccatcatgataagggtcccacccctcttaactgtccttgtt

SEQ ID NO: 664810 - DNA, 700 bp, Homo sapiens
ttccttatcagtaactggagttctcctgcttgcactagagaaggtaaagagagaatcagtattcttatatggcaatctggggaagcagcaatatgccactgtacaaaactgaagaaaagttcctaattgtactttgtgaagggagatgaaaggacgtttaaagtatatatattctgtcaagaggaaagaagataaaactatgccagttttatatcaatagcttgtagaagctcagctcttcttggtcttggtagactgcctagattcccacagcagacaaggttgagaatccattggctggaatctgtggtattgatgagttacagtgatggaacatgtgcttggccacaggcaggtccagtcactgcaaaagtgaccaaagccagcaggtcacccttaacttcagaaacaattatggggtggtgaactgtactttaaatttgcagagaaaccgtgtaagtaatgggcaggtaaacggaacaaattttcccgcactgggcacaattaaatattttgggccaagccaaacaaattcactggagaattcccaaaagttatatttaaacacaagaagatagctaatgagttccagatctatcctctattggcttttaatatttacaaacaatccttaattttcccctattaaggaggggattactagattggttacctttctgggaggataacctgggcatca

SEQ ID NO: 664811 - DNA, 764 bp, Homo sapiens
aacaacacgttcctctttccccatatattcatatatttttgctcgttagtgtatttcttgagctgttttcatgttgtttatttcctgtctgtgaaatggtgtttttttttggttgtgggtttttatttcttgttttttttaaactggggaaccaaccaagttggtaaagatgtgatgttttaacctgacgagttatcaccacgaggtagacggtcaagtgtgagaagagtgatatcaataactggttttggtttctaaaatcttaatataaatcctgtgtataaggagtggcttttttttttaaggagtaagtcctgggaaccactgagttggattgcccatcctccaattttggggggtgaccgtggttctcacccagaggggccggtttaacctcctccatgtgaacataagcgtgggataggttggcttaacagggtggaaataaagtggcctttcctaacagaaaaaaaacacacaaaaaaacaaaaacaaacaacacatgtgtgtgtgtgcggcgcgcgcgcttgcggccccatcagaaaaaaagcgtttttttatacgacaactcttggtgtggggggggggggccccccaagtggagtttcgtacacctcggccacccggcgttccaaaggagaaccgtgggccacaaagacgggggggggggctgtcccccaaataaaaacgcgggcggacgccgggtcttttgaacacctcaggggcgtcgggccacggggcttaagagggcaaggcagaaaagg

SEQ ID NO: 664812 - DNA, 956 bp, Homo sapiens
atggcccccttatgttcagcatctgccgagtgacatcatctgccatgccctcctggaccctgacaatgggaacaatggctggaagctctgtttagattttcctgatgatctggcatctgacaatgagagatccaaggcagtcgagtaacatctcacaatctgctcctattgatatgtgtccttgtatttgtcgtgctggacatgcctggcctgcacgggatgtgttgccaatctgggtgctgtgtatgcccatgtggcattggctttgtgttgctgttgcagctcatcccatctggtgtggactgttggctcagcaatcacatcgaacacctgtgctaccatgacttgctgacattgcaagacaaaaagcccagatgaacctccatacacaattgacctccaatacagtgatgaactctgtggccgaagttgacctttgcacctgttggttataacatgtgaaagaaacaacacatcatattcacgatgatgggcatagcagcagatggaccctgaagaccctcgagagaggaagctggcatctgaaagcagcacacttgacctctagagaccacggtatcacacaacaagtaggagcctgtgaaaaggacccaataaagagggaagccgcgccaaggtagggaccgaagggacgcgcccagagagaacaggtaaccacggcatagagagtgagcgaatagagtgaaagcgaacgggcaaggacgactaggacacttacgaaacgagtgggaagcatacccagaaccaagggaccggggccagacaggaggccgaccgaggacgcagaaggcagaagcacaagcggagaactgaggaagaaaccaaaagcaccgagcccagcaagagacaagacgaagaacacggtgacagacatagacactaccctaccacaaacatgcagaaatacacaacaaaaaagaaaggagagccgcaaa

SEQ ID NO: 664813 - DNA, 174 bp, Homo sapiens
cggatctatggaccaggctgacttcaagagatctcaagggaatacacagactcacttcccagggggccaggcccacgtgaggagctggaggtatcagtcaaaaggactcttagtcccaaggggtggcaagagcaaaagcaagttactgtccttgctggggtccaatgggtaccg

SEQ ID NO: 664814 - DNA, 483 bp, Homo sapiens
tcccaagtcacggaagcgtgttaggtcgtcacgtctcagggagaccccacattccctgacgtcggttcctggcgcctgcggagggtggccccacagagagaggcacacgcacccagatgcgagtcacagccagtgtctgacaagcaccaataccctgaatgagatgaggtcactgctatggtgtgggcatctgtctcctgaaatgctgaaactcacttgcccacgcagcctaattaggaggtggcatcttcagaaggtgacttgaccatgaaggctttgccctcactaacagcttaatgctgtcaccaagggacaggctcatgattccaggagtgagttcattctaaaagggtgaatatgccttcaccccatcaccacgtgagcacacaggaagaaggcccttgccagcctccagaactgcaggccaatccgtttctgttcatgctaaagtcttccatcttgggtgtactgttacggcagcac

SEQ ID NO: 664815 - DNA, 799 bp, Homo sapiens
  misc_feature (14)..(16): n is a, c, g, or t
  misc_feature (629)..(629): n is a, c, g, or t
ggggcgaccctcgnnnggcgcaaacggtaaccgaaagaggcggttagaaacgatggttaacaaggcaaaaggggcaagagccgatatatgatacgttataaacgcaccctggagccgtcaagttagtcttcgacacatgacccactcgtaaaaagggaacccaaagtttttaaccggggggatgcgacgtactaccgccccaacagcagaatgtttcaccacgaatcacatacaacctcgactttagaggtacttacaaatttaacaccacggacaatagtttgaagcctcattataatgaacaaatccgggcctgcgcggctttagcagaggaccccaacttgagcgaaaatttcatgatgtgtcagggccgcggtcattggtacgatatcgaaagcggatcatatggccggaatgtgtcatgcctccaaaaagcagcgtcggtctgttcgttatcgctctgtatgttttcataggagatcctctaacttttgatttgtaatactcgggggactcccacacacagcgagggtgccagggtaacggatggttatctaactaagtagaaaggtaaattatttagagatctgcgcgtgaatgtagtttaagatacacataatgtaagacanataaatatattattctctcagtggcaagaatttcttatttcacagctagaactcctgtgaagagagcgatcagaaacataaccatgagcaattggcgaacaacacttacacaatggctcacgcacgtccacgtgtcaatgatactacaggaaacatggacttcttaatat

SEQ ID NO: 664816 - DNA, 330 bp, Homo sapiens
cataaaccaaattttttacttaacatgagtgcactttactaatcctcatggcacagtggctcacgcctgtaatcccagcacttgggaggacaatgtgggtggatcacgaggtcaggagttcgagaacagcctggccaacatggtgaaaccccgtctccactaaaaatacaaaaattagccaggcatggtggcgtacacttgtaattccagctactcaagaggctgaggcaggaggattgcttgaaccctgaaggcagaggttacagagccaagatagcgccactgcactccagcctggatgacagagcaagactccgtctcaaaaaaaaa

SEQ ID NO: 664817 - DNA, 351 bp, Homo sapiens
  misc_feature (75)..(75): n is a, c, g, or t
  misc_feature (145)..(145): n is a, c, g, or t
  misc_feature (165)..(165): n is a, c, g, or t
  misc_feature (190)..(190): n is a, c, g, or t
  misc_feature (202)..(203): n is a, c, g, or t
  misc_feature (216)..(216): n is a, c, g, or t
  misc_feature (224)..(224): n is a, c, g, or t
  misc_feature (227)..(227): n is a, c, g, or t
  misc_feature (235)..(236): n is a, c, g, or t
  misc_feature (242)..(244): n is a, c, g, or t
  misc_feature (249)..(249): n is a, c, g, or t
  misc_feature (256)..(256): n is a, c, g, or t
acttaaaagccttcttcacagtaatctagccacagtgtgtatgtggacccttgatgtagtattaatgacccgtcnacttcctgcctgaccatttcaagtgatgcccacattacttcacagggtggctctttcattgtcgaacacntctaacagttagaaaaatanagcccccagctagtataatggtcanaagcacaggttnnaaatcagaccacntgaattcntancctttctnntcctcnnntgagntaggtanatttgggcaaggtatgtaatctctccatgactgtttactcatctataaaataaaaatgttacccgggcgcggtgggtgtgactcagagtggtgtg

SEQ ID NO: 664818 - DNA, 592 bp, Homo sapiens
agcggagtgtcagcagtggcaacctggtagggtccctttccataccgtggaagcttcgttctttcgctctttgcggtaagtcttgctactgctcactctttgggtccgcactacctttatgagctgtaacactcaccgtgaaggtctgcggcttcattcttgaagctagtgagaccacgaacccaccgcgaggaacaacaactccagacgcgccgccttaagagctgtgacactcactgtgaaggtctgcagcttcactcctgagccagcgagaccacgaacccaccagaaaaaagaaactccaaacacatccgaacatcagaaggaacaaactccagacatgctgcctttgagaactgtaacactgcaagggtccacagcttcattcttgaagtcagtgagaccaacaacccaccaattccggacacagtgttttcctaagagacctcgaaagtagcacaaaggcaagatttagtagagaagattgctctagaaagcttcattttgatttttaaaatattaggttggggacggataaactgcattaaatacttgtctgtctttggggacaactttaatctcatggaatgtt

SEQ ID NO: 664819 - DNA, 394 bp, Homo sapiens
aaccctgtgttggagttcttctccgcctcatgcatgcgattgaataagaagtcatgtgaagtcccgtgcggaattgggctccagcgtgagctgcttgtgatccgccttagtggatataaagtcttccagccctgccagcacttaaagagactggttctggtggtcctgcaaggtgtttcatcgcggaagagtacatctcatagagttgcactgtggaggttagcttgacctgcaagtttcctagcatcatgcgccacagtcagaggcactctttgtcgttagagtcaaagcggtccccaaggacaatgtaactgagtacattacagactgtgcggctcaggaacacggtaggcccgatagcggctccgccagtgctctcgagggtgtatatgcg

SEQ ID NO: 664820 - DNA, 136 bp, Homo sapiens
aggagtggctatggcatgaagcagatgaggcggactggaagactggaccacagccgacttccgaaccaagaagaagaagagaaagcaggtcggcagtcctgatgagccagatagcatagccaccctacgatagcca

SEQ ID NO: 664821 - DNA, 123 bp, Homo sapiens
actctacaggatcctttttcttgccaacgatcgagtgtcctcatgagtgatcacttcacattcctcccaaatggagagctcaccactgtggctatttttcccattggaaaagtgtggttattt

SEQ ID NO: 664822 - DNA, 458 bp, Homo sapiens
  misc_feature (255)..(255): n is a, c, g, or t
  misc_feature (261)..(261): n is a, c, g, or t
  misc_feature (364)..(364): n is a, c, g, or t
  misc_feature (397)..(397): n is a, c, g, or t
  misc_feature (423)..(423): n is a, c, g, or t
  misc_feature (454)..(454): n is a, c, g, or t
tgagacagagtctcattttgttgcccaggctggagtgcagtggcatgatcttggctcactgcaagctccgcctcacgggttcatgccattctcctgcctctgcctcccaagtgggactacaggcgcccaccaccacacccggctaattttttgtattttttagtattttttagtagagacggcgggggggggggcgggtttcaccatgttagccagggtggtctcgatctcctgacctcgtgatccgcccacctnggcctnccaaagtgctgggattacaggcatgagccaccgtgcccagcctggagctggttttttgaaaaaaaaaaaaaaaaattaataaaataggctactagctagactnttaagaagaaaagagagaagaatcaaattaacncaatcagaaatgataagggggatatnttactgaccttaaagaaatttcaaacaacgntcaa

SEQ ID NO: 664823 - DNA, 105 bp, Homo sapiens
cctccaaagtgctgggattacaggcgtgagccactgtgcctggccaaaaaaaatttttttaattgccataatttgtaaagtaaaatctgcatgataggagggggg

SEQ ID NO: 664824 - DNA, 219 bp, Homo sapiens
ctaccttctttactgtgacttctcagtcctgctacataatcagttatagtgttaaatatcaactcctctgtctacctttcgaggcctaagtgatctgacccatctgcccaatttatctgtcacctcttgctctacgaggtctcctcacagtcgctcacaaaacacagtcaagttcaatgggcttactctgactgtacatacttctcgagagtttccctc

SEQ ID NO: 664825 - DNA, 272 bp, Homo sapiens
gggggggggggtaaattaaggaaatttttttcccccctctccctttttttttggggcctccctcccctcctttttttgccaggtaaatgggggatgggctatgggtttgcaaacagctggacggtcagggggctttttttccagagggtcctcctaggcccccccttctccctcctttcccctccttttccttccttccttcctttccttggggcaatgggccccatttggaaggttgagagaaaccaaaattaaagagggaaagaggggga

SEQ ID NO: 664826 - DNA, 432 bp, Homo sapiens
  misc_feature (10)..(10): n is a, c, g, or t
aaaatcctanaatgtttctttaaaaaaaaatcccttgccaggcatggttgctcacacgtgtaatcccaacactttgggaggccaaggtgggaggatcgcttggcccaggagtttgagaccaggctgggtaacatagtaagatcctgtctctacaaaaaataaatgaaattagccaggcatggtggcacacacctcagtcccagctacttgaaagattgaggtgggaggatcacttgagcctgggatatggaggctgcagtgggccaagatcctactccagcctaggtgacagagtgagatcctatctcaaaaaaaagaagaaaaaaatcctgcagggcacagtgactcacacctgtaatctcagcactggatcacttgaggccaggagtttgagaccagcctgagcaacatagcaaaaccctgtttctactg

SEQ ID NO: 664827 - DNA, 242 bp, Homo sapiens
gcacgagaacggagtgagattccatgtcaaaaaaaaaaaaaaaatgtacatttttaaaaggggatttatttgagaagcaaaaacaacagaacacttcacaggctactttacccaataaaatagaaaataattacaaatttctgcaagcataaacactcaggtatgctaacaatagtcacaggattataacaattataaacagacaaccccacttcataaataggttaaaagcaaactgtata

SEQ ID NO: 664828 - DNA, 1093 bp, Homo sapiens
  misc_feature (848)..(848): n is a, c, g, or t
tttattttttaaaaaggaaaacccggaaatgatttcggggtcgagggataggaggaaaatgggggataggtgtataaacctgagggtgttctcctcgggtagaatgagggtaaaggtggtacaacggtggggggatcaatgacccccaatgggtgtgtcggtggctacactattgtaaagggagatattcgggctgtgacccaaatatgtggcgccctgtaacttagcacagtgattatttgtcacaggacaacgttggtcacatccgcccagagaggttctcccacgataggtaaataggtggggggctaacggcgagcgttaaagcgagcctttgccagaaagtctctctcaacaaagctataagtgcggcagatcgatgtttggcaccgtccttgaagagaggataatcgatgcacacctggtcgagtgctgtctcagcacgttctggatgtttggcaacggcgaaaataattaattgaggcgatagtaacgccccgggggggccatatttctgacgataacgatcttggccgggaaaacaaatacaaagggggctctgtcttgacacaatggtcgtgttaccacaccaacagggctaattgtgggcttcattggcgcgacttttcccactgcgagccgatataaagggcccttgtcgtcgtcactaacggccagcattgaggcctgggttgaatatactcacttgcgccccaatagggagtatagtaacccagcaccggggtaaccgcaactgtgttctgggacacgggggttcgacaaatgtacgttgttgacggggaatataaccaaaagccgggcaaggttgttaagaaagatccggcggncagtacaatattggccccaggaagagggggctctacattgggatcaccggaatcataaagggcgcgcgccagagagagatctttcaataaaaacgacgtggtagcaccgcttataagttcgggccacgcgtgaatattcgtgtcgggcgcgacagatcaacagttcgcccagcgtggtggtataccgcacagcggagcgccatactgtgaagacatatcgtcgtgcagtgctcgtcacacagcag

SEQ ID NO: 664829 - DNA, 545 bp, Homo sapiens
  misc_feature (44)..(46): n is a, c, g, or t
ccaaggcatccagtcccaccccactacctcacccgtcccccccnnnttttgtgggcaaccagcacctctgttttctggtggaacttcctcttaaatggcttgacaataaccaccaaccagcactgccatacatgtgtcctgtacctatcagaggcactagggcagttttggaacagagagcccatagaaaggctactgcttagagatagccattttcttcttaggagctcggacccagctgaatctcagaccgcatcggcaggagagctcggaaaatctccttcttttttttgagctacacaaaaccaaaatttggaattcgtagctaataaccataaaaattaagaaatgactgttggaagagcactggaaatcacctgattaagttaagaaaaaataactagctcatgagacaattattttcaggccagctgtagcctgtacccttttgaaaatcccctgactagtgagctcattttttgttggaatatagaatttttcttttctaaaaaacaaaaaaaatggcctccctggactacagggtg

SEQ ID NO: 664830 - DNA, 103 bp, Homo sapiens
agattttaagtatacgggttcttcgaatgtgtggtagggtggggggcatcgaaccccccaaagctggtttcaagccaaccccatggcctccatgactttttca

SEQ ID NO: 664831 - DNA, 797 bp, Homo sapiens
  misc_feature (284)..(284): n is a, c, g, or t
ggcgtacaccagcctctcggacacccctcagtaacaaaagcccatcagttcctctgggcatcgaccgcgcaccatgcaccgccttccccgacagtgtcccgggggcgtgtggctatcagtttgtgaaggtaggcgtccagccacagtcttcccagacattcttcgagaggagcctgatggatgtccgaagcagggtctcctccagtgagccggcatgtgctcgcgtggtaatgtcgagagttgccaattgcttgtgcacaatgcagagcactatcactcggagncggaggcgatccttgtggatttaacgctagtgccggggcgctaagtggtggccggccaaagacggtggttgcttccaactcgcggggaacgtgcacacgagtgtccccacgtgtaccgtacgatcgttctcgtacaggacaacggagcggtggttcgcgaggatatgctacgagtggcatgtgccaggcttgggctgaagtgacgaccgaagtgacgacggtgacggaccttcgccgtggtgccaaagtcgtccgagtggcagcgagtgattgatctccagtctgcgttgtggatagcccaacgaatgaataggctagttgcgggtgcttccgaaggtaacactggatgcaaggttgcgaggaacatgggcatgggttcgcagggatggcgttaggaatagggcaatgtgcggtggattgacagaactcgggattgttcaattaggttgacgggagcaagggcgggttgagcctagtttctgtttgggggatgatggtttcttgatgacttgg

SEQ ID NO: 664832 - DNA, 1611 bp, Homo sapiens
cacttatctccagtctacccattttccagggcacgcacaaatgcaaatcatgccacacaagggcaacaaacaattaagtgcatggacaacacacagttatactcacagcaatcattctgtaaagcaaatccaaacaggggccgggcgcgatggctcaccctataatcccagcacttatggaaggccaaggtacggaggatcacctagaggtcaggagtttgagaccgctactggccacacatggtgacaacccatatctctactaacgacatactaaacaactagtgccaggacgctgtgtggtctacacagccctgtgagtccaaagcactatagagacagtgccacaggatgagtgcgtgagcaagtaagggttcaggcaggatccatgacttatcctggcacaaacatggttggaaatcccccttgatcatcttaactttaaaagaaaatatacagaaaagaactaatacatacaaagaaacacacagtgtgagagggacaaagcgaagtaggtccactatagataaatgatgtatttctatgataacaaccaagactatgtgatgtgtaacagagagtatagccagtagcactggttgtctagagtagaaaagcacaaacaagaggacaacaagaaaagaagtggtcatcagcagatagagagaaggtgaacaccgctgagcgagctgagaaacaacacaagcgcaaccaaggagacaatgcgacacagacacagagaaagagaaaaaaacagagccgccctaggggggacaaaacaaagcagacaaacaggaaaagacaaacacaacgaacacacaggctaggaggagagcactgcaacaccgacgaccaccacaaagcgcaggagagcatcactcacaatcgagggggtagggtcttcacaaaatagtgagatttgtagtaatgtaataacaaaaaattagagtactcggagttgagtgtgttgatggtaggagatagacgaaagaggaagagtagggtgcaggcagaagagaataggagagagacacaggatagaagggagtagaagtaagaaaggttagatcagaagaagtcgagtgatataatacggaaagagtgatacgtgtagagtgaaggaagaatagatagatgtgatgagaagcgatggcgtgcgtggaagagagataaggggtgtacagagggaaagagaggaaaagaagagaagacaacaaacgacagagggaagaggacggaggagtgagataaggagagatagggagaagtaggaggagaggagaggggaaagacgaacggacgggcacagagagtgcaggaggtacggtgggggtcgtaggtgaagagaggtgtgagtgtgcattggaagtgtagagtaagaagagttgaggatgagtgaaggatgggagtggactgcctgacgcggggggagcggatggagaagagggtgaagtgggaatgaggaacggagagggggacggattaggaagagggtgaggtgacgtgttgagggagagatcggaggcgcgagcagaaagagaggacgtgaggaggtggtgggaaggaggcaagaggggggcgtgcgatgtgggactgagcggggagcaggga

SEQ ID NO: 664833 - DNA, 739 bp, Homo sapiens
catgagtggacttcctcctggcccagagaagggtccaacccgtggccccttctccccaccctttgcccccagcttcttcctctgcccctgggcctccaatgcgatatccatattcatcctccagtagctctgccgcagcctcttctagttcctcctcctcctctgcctcccagtaccctgcttcccaggccctgcccagttatcctcattccttccccccaccaactagtatgtctgtctctaatcagccacccaagtacacccagccttctctcccatcccaagctgtgtggagccaggtccacctcctcctcctccctatggccgcctcttggccaacaacaacacccatccaggccctttccctcctactgggggtcaatctacagcccacccagcagcccctacacatcaccatcaccagcagcagccacagcaacaacatcatcatggaaactctgggccccctccacccggagcgtatcctcaccctctagagagcagtaactcccatcatgcacacccttacaacatgtcaccctccctggggtctttaaggccctaccccccaggccagcacacctgcctccacctcatggccaggtgtcctataaccaagcaggtcccaatggtcccccagtctgaaagctcagatccaggtccctgtcgctgtggtagaggggataagggacattgggacctcagagttgggaaaaagaatcaatctaaaggagtgatg

SEQ ID NO: 664834 - DNA, 719 bp, Homo sapiens
gggccttgtgtttgattcatggcgttggctgcaatttgcagggctgggaattcaggagactatagcgtacccgaccccgggtatgggaagtggagaagtggcacaggagactaggatccagaagcccagaggctcagcggtgcttctggagttccagtgatcccggagtctgaaccggcagtgagagtggggaaagagggatgccgatgcgacatgctcaaataccctgcagaccaatgccggctacctggagcagcgtgaagcagccagcggggtgacccatcagaaagacagtttggaagccatggaactgtaccatggcacggagtggagctagacaggtggaggactaggaccaggatgaacatcatccacgtcactgggacgaaggggaagggctccacactgtgacctaacacggaatgtatcctccgaagctatggcctgaagacgggatactattagctactccccacctggatgcaggttacgggagcaggatccgcatcaatgggcagcccatacagtcctgagctacttcaccaagtacttctggcgcctctaacaccggctgaggagaccaaggatggacagactgtgtctccatgccccctacttccgattcctgacactcatgggcttccacgtcttcctcaagagaaggtgactgcagtggaggaggtgcacattgacggggctatacgtgccacgtatcagag

SEQ ID NO: 664835 - DNA, 271 bp, Homo sapiens
  misc_feature (161)..(161): n is a, c, g, or t
  misc_feature (170)..(170): n is a, c, g, or t
cgtctttggctacccgaatatcactggcgcccagatgaatcgcaatgccctcactttcgaggatgtccttgatggcggcgcagacatcgtcgtcttcgcgcgaggccagtctgggcccgcgttcgaccaccgtgacctcggcgccgaaccggcggaacatntgcgcgaantccaggccgatgtagctgccgccgatgatgaccagatgctctggcaccgtgtcgagttcgaggatgccgacattcgtgaggtagtcgacgcggccgcgaag

SEQ ID NO: 664836 - DNA, 460 bp, Homo sapiens
gtttgcggtgcttttccctgtttttaattcacagctctcaagtgagcacctgaaattacctttttatcaacacgagcttcttgagagaggcccttacaaatcagcacacggctgggcacggtggcccgtgcctgtaatcccagcactttgggaagccgaggcgggtggatcaccagaggtgggagttcgagaccagccttggcaacatggtgaaaccccatctctactaaaaataccaaaaattagccaggcgtggtggtgcatgccttgtaatcccatgctagtcagaaggctaaggcaggagaattgcttgagcccgggagaaggaggttgcggtgaaccgacgattgcgccattgcgttccagcctgggcaacaagagtgaacttctgtcccaaaaacaaaacaaataaacaaaacgattgctcatttcctccctggattctctccccaagccccag

SEQ ID NO: 664837 - DNA, 375 bp, Homo sapiens
  misc_feature (41)..(41): n is a, c, g, or t
  misc_feature (115)..(115): n is a, c, g, or t
  misc_feature (209)..(209): n is a, c, g, or t
  misc_feature (255)..(255): n is a, c, g, or t
  misc_feature (342)..(342): n is a, c, g, or t
  misc_feature (347)..(347): n is a, c, g, or t
aaatattaattttataatttgtatatattcattatttaggntcacatatgtttatgtaacatacccatttgcttgggtatcatttcataccagcaaactaataggaataattttntgaatgatcttctattttgctaaatttgctaattttgctaaattttgctaaatttgcgagtgatcttctattaagtgggagtccatagagcagntcctcttgggtaaggaggaaaaaatgggccagccatgggtggcctncacacctgtgaatcccaggcactttagggagggctgagggcagggcaggatccacttgagggttaggggggttccaaggaccagccnggggnccaacatggggtggaaaccctggttctc

SEQ ID NO: 664838 - DNA, 367 bp, Homo sapiens
  misc_feature (367)..(367): n is a, c, g, or t
cccgagtgacacgttgaattcgccataatgaacggaaccttttgcgggcggcgatctctgaaattacttagcgagcaaccgtaattaacctgactttttgctgatactcactgtcagtggaatcacatgacaaatccggggatggattgagcggcactcagtaggaagcagcccttcgagcactggtccagcgcacaggatatagctgggtccatgaaataggacagaggtgaagtcattattcggcaactctcacgctaccttgtatgggaatagcttataccattctgcgagatgatcgtgtatatttatgtgtgactgatcatgggtccttgggcacattagcggatatgcatgtgtcacatgn

SEQ ID NO: 664839 - DNA, 447 bp, Homo sapiens
agatcccgccccctccggtggcaagaggacccagaacccgaggacgagaacttgtatgagaagaacccagactcccatggttatgacaaggaccccgttttggacgtctggaacatgcgacttgttttcttttttggggtttccatcatcctggtccttggcagcacctttgtggcctatctgcctgactacaggtgcacagggtgtccaagagcgtgggatgggatgaaagagtggtccctccgcgaagctgagaggcttgtgaaattccgagaggccaatggccttcccatcatggaatccaactgttttgaccccagcaagatccagctgccagaggatgagtgtccagttgctaagtggggctcaagaagccccgccttccccaccccctgcctgccattttgaccttttttcagagcccctaattaaaggggctgaaagtca

SEQ ID NO: 664840 - DNA, 102 bp, Homo sapiens
aaatgtaagaattagccgaacagtgcatatttctccctcctaagtatgcaatggacgtgacctgatagatcacgattgaatgaattgacaattgataggatg

SEQ ID NO: 664841 - DNA, 113 bp, Homo sapiens
gaacagggctgtcaaagcgtcgggcgttgattgcgcaccggcggctcacaggtcgggtggtgtggctggtggttcttgggcgcttgtatttctagctaggttctcaaagtggc

SEQ ID NO: 664842 - DNA, 302 bp, Homo sapiens
agaggtacggtacttatcgactctgtttctctctgcgtaaatgaagcctcagagacagattgagtgcttcttcacctatgttatctgtggtaggtggaattatagcccgccaaagataccctagagcagcagtcccttacctttttggcaccagggagtggtttcatggcaagataattttcccacgattggggtaggggtatagaggtatgtttcagtgatgaaacatgttcaagcgtcagatcttcagtttattagacttctccataagaagtacgcaagccatgatgcttggacatgtg

SEQ ID NO: 664843 - DNA, 204 bp, Homo sapiens
  misc_feature (43)..(43): n is a, c, g, or t
  misc_feature (91)..(91): n is a, c, g, or t
gtggttagagaacccagatacttaaaatgtaggtgttcaatangggaatactgattgtgcattgtatatggatagcatgcctaattgtgcntttgtgaaagttgccaattcaaaatgtaattggaacagttatctttgattagacaaacttgggaagagaatgttgaggtgcagagctcaccattctcttcccaggcttgtcta

SEQ ID NO: 664844 - DNA, 466 bp, Homo sapiens
tgaagacaaagctagctgacagatatgctacccagcgttcattaaaccagctcggtgcggagtagtctgactagctctaaggaggactggccgagagctcctgccgaaatcaatctgtaaatggaaaagcaccacttgctactggagaggatgatgatgatgaagttccagatcttgtggagaattttgatgaggctccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctta

SEQ ID NO: 664845 - DNA, 165 bp, Homo sapiens
tagctcttattctatttctcaggttgccgtggaccaaatgaactctcagtctatttgtctatcagattgcagtcttcagcaagtgtctgagtaacttggtcaggaccttccttccaggagagcctggtgaccctctgagagcagccatgtactggggagttctcc

SEQ ID NO: 664846 - DNA, 374 bp, Homo sapiens
agcatcctggttagcaggaagatttcgacgccttcggcagttcgcattctctctgcatacctgtgaggtggctcaggcccagcattgtacgcacactcggtggacccagtggggcctccagagttcctatcatagccagcttggcattcatagaccaatgtgtcgtgcagcttgcaccatgtgtagtcattctcagttctggcattcatcaatgcttgggtatctcgtgatttactgcgcgtgggttgaactgaccatccatctttcccacgtgtagttgatccctatgtctcgccatctagagagagagagagagccacagagagagagagagagagagagagagagagagagagagagagagagagagagag

SEQ ID NO: 664847 - DNA, 690 bp, Homo sapiens
tcaaaggggggtactggcaactcggttttataattagggcctccatttaaatctaattttataatttttatttataagcagcaaatgaacacaaaaagggccagtttaaagatggtgtggccggtaacacaaaagtgttacgagggtttcaggaaagcctcttggattttggttgggcctgcatggcctgggtaccgtacagaggaaacagctacactgggagctaggaaaccaaagcaagcttggtggaaaccgggcacagggatagagaatggcgggggagagtcatacgagcaaaggggaggggtcctggaggccggccagggtcgtaaaggcgtgtccaacactaaaggggcggtatccctacaaggtaacattcaactggtgactctcaacacttccagagtcttaaggggttcctaggtgttatcagggtaactagtgttttaccaccaatggcctttcttggtccctagtaccgtgaccacaatatttgctgactaggaggtttaataaccttcggttactccaagaaccattaattaattgggtgtggtcttatgtcactcaaatacacttcgggtacctgttatggtcagggatacacgctgggtattggcgccacgaaaaatgcgcttgaagaccacaaaggctacgaggcagctgggaccttcatataaccactcggtc

SEQ ID NO: 664848 - DNA, 164 bp, Homo sapiens
tactcgggaggttgaggaaggagaatccctagaatctgggagggagaggtcacagaaagccaaaattgtgccactgaattccaggctgggtgatggagtgagactccatctcaaaaaataaatataattaaaatagataaaaaaaaattgttgtttctttcttc

SEQ ID NO: 664849 - DNA, 133 bp, Homo sapiens
acatgtaggtgcctcgcaggagctcttcttcccactctgggggttcgctatcactgtgatcgaacactaacgataataataccaagaacactagcctgtaacttcctaaatacacaagcaacatagaacacac

SEQ ID NO: 664850 - DNA, 361 bp, Homo sapiens
  misc_feature (90)..(90): n is a, c, g, or t
  misc_feature (104)..(104): n is a, c, g, or t
  misc_feature (160)..(160): n is a, c, g, or t
  misc_feature (163)..(163): n is a, c, g, or t
  misc_feature (174)..(174): n is a, c, g, or t
  misc_feature (179)..(179): n is a, c, g, or t
  misc_feature (186)..(186): n is a, c, g, or t
  misc_feature (204)..(204): n is a, c, g, or t
  misc_feature (238)..(238): n is a, c, g, or t
  misc_feature (244)..(244): n is a, c, g, or t
  misc_feature (246)..(246): n is a, c, g, or t
  misc_feature (254)..(254): n is a, c, g, or t
  misc_feature (258)..(258): n is a, c, g, or t
  misc_feature (260)..(260): n is a, c, g, or t
  misc_feature (292)..(293): n is a, c, g, or t
  misc_feature (299)..(299): n is a, c, g, or t
  misc_feature (302)..(302): n is a, c, g, or t
  misc_feature (304)..(304): n is a, c, g, or t
  misc_feature (307)..(309): n is a, c, g, or t
  misc_feature (314)..(315): n is a, c, g, or t
  misc_feature (346)..(346): n is a, c, g, or t
  misc_feature (356)..(356): n is a, c, g, or t
ccatcaaaattttagggaaggggggtatatgtgtagtagggatcccgtttgaaaacaggcacttttcccctgaggatgggaaaggagctnttcagttggagatntaggcagtgggttaagccagacccctaaagtgaccctttccttttttgccctattnttntcagaccctcngaaanacatccnatttttttaaatccctgnagctccaagcctggtttcatttgcttccctgccnggctcntngtgtgtanaccncntttgtgcccccctgacctgaaggttccatgtnnctgtanacncntgnnnacttnnatgccaacatttaaaataatttgataaagtntttgtagccnctcca

SEQ ID NO: 664851 - DNA, 177 bp, Homo sapiens
atccaggcctgagttgctgggcttctccatggccctgctgagttagggtgcgtctggtggcctgcaccgccatcccgcagtgccacgatagctcctttgcgggtgacaacatcatcacggcccaggccatgtacaaagggctgtggacttgatctgcgtcacgcggagcacggggat

SEQ ID NO: 664852 - DNA, 164 bp, Homo sapiens
  misc_feature (30)..(30): n is a, c, g, or t
  misc_feature (39)..(39): n is a, c, g, or t
  misc_feature (97)..(97): n is a, c, g, or t
tgatttttgccagaaatggagagctcgttntaaggaaangcggcgctcctgggagagaagaggcttttgggccaccttgaggcacgacgggtgccgnttcgtttccctgcgaccgctgcctgtttcgactgagccccttacaggaggacgtggcgggggcagac

SEQ ID NO: 664853 - DNA, 1021 bp, Homo sapiens
ggctgactggaggctggcggcacaggcgacagggacctgcggcagagtcttgctgcgacacccaggctggagtgcaatggcgctatctcggctcactgtaacctccgcttcccggtattcaatgctgattctctcctgccgtcgagacactctccgtatgtacgagaccagtacggagctgagtaagcagctaggatgaacttcaatcactccgagcgagtcaagtgtctagctggtaagtggatatacactcagcagggggtagcacgagtcacgtaacaagtagacctctggggccctaggaaaatggatgacccaagattgacgaactggtctgaaccgtcctcgagatgctcctgaaggacgggcccaatggtaagcatcgacgactcgggtcatgagaagacactcgcagtgttgtcaaggacttcttgaaaggcaacattaagaaggagctgtttaagctggccactcacggacactttacttcgacagtatcgtcaggccctcgcaggaggaacatggagcgcaagaaggaccatccagccttagcccctttgtacttccccagtggagctgtcaccggaaggaggcgctgaccaaggacatggagtatttctttggtgaaaactgggaggagcaggtgcagtgccccaaggctgccagaagtacgtggagcggatccactacatagggcagaacgagccggagctactggtggcccatgcatacacccgctacatgggggatctctcgagggggccagagtgctgaaggaaggtggccagggagcactgaaactccccagcaacagaggaagggaccagttctacctgttgagaatgtggacaatgcccagcaggttcaagcagctctaccgtggccaggattgaacgcctgggacctgaactttgaagaccaagagaggatcgggacagaagccaacaaggttttggagtataacatgcgagatattcaatgaacctgggccacgccgttcccatggcagaagacctggaga

SEQ ID NO: 664854 - DNA, 321 bp, Homo sapiens
tttttagtagagtggggttctccatgtaggtcaggctggtctgattcctgacctcaggtgatcctcccgacttggcctcccaaagtggtgggattacaggcatgagccatcgtacctggcctctttttttttttggaaacagtcttgctctgtcgccccagttgaattgcatgggcgcgatgtgggttcattgtaacctccacctctgggtttcaagcaattctcatgcttcagcctcctgagtagctggatattacaggcttgcaccattatgcctggctaatttaggaatttccataagagaggggttcccaccgtgtg

SEQ ID NO: 664855 - DNA, 430 bp, Homo sapiens
ggattagcacctgcagctctcaaccctgcacccaccctcctccagggaccatccaccatcatccttcatgtctgcgatggagcctccataagaatgcctggactatgggtcccgagcagttccaggttgctgaacacatccacgggccaggagggtgtgccccccactccacggacacagaagctcctgggctgggaccctttccgaccctgccctgtgccccggcccacctggctgcccatctgcggcctttctcatctccttttcctgcgttctgtgataattttgtgttgcactcttgatatttaaggctaatgtgtaactagaaaactgagttttaatatttaatgcccttggatttgggaaatctcttactacattatgtttggatatactttctctgaggggataaatattttttcgaggctgt

SEQ ID NO: 664856 - DNA, 135 bp, Homo sapiens
gagtactctagcaggatcgtttttcttgcccacgatcgcgtgatgtcgagtaacatctcacaggtgtcaaaaagctgaccaataaggccaccctgtggtatgtgcccctgtcgctgaagaatgtggaccacggtc

SEQ ID NO: 664857 - DNA, 150 bp, Homo sapiens
gtctgaggggccacagtaattacaaacttactatccgccatcccatacattgggacagacctagttcaattgaattttgaggaggctacttaagtagacaagtcccaccgtcacacgattctttaacctttcacttcatcttacccttca

SEQ ID NO: 664858 - DNA, 758 bp, Homo sapiens
ggataatcctatttattacctcagaagttatttttcttcgcaggatttctctgagccttttaccattccagcctagtcccttacctccccaattatgactggcactggcccccaatcagggcatcaccccgctagatcccctagaagtcccaacctcctacacattcatccgttattactcgctatctaggcgcagtatcacatcactctgtacgtctcaccgatagtctaagtagaagagaggaggccgaagaccaaataagttcacgcactgcttaattacattggtcactgggtctctattttacctctcctacaagcctcagagtacttcgatgtctccccttcaccatttccgacggcatctacggctcaacatttttgtagccactgggttccacggacttcacgtcatgattggctcaactttcctcactatctgtcttcatccgccaactaatattttcactttatcatccaagacatcacttcggttcgaagccgccgcctgatactggcattttgtagatgttggttctgactatttctgtatgtctccatctattgctgagggtctttataccaagcaaccacctatcacggaaaaaactctacctcttttttggggagttctgcccctcccgaaaaaacctttttttaaccacatctcttgggccgcggcggcccccatggtttcctatcacctgcgcaaacagggttcctccgaaactcgcgggctcaaccccgggggggggacc

SEQ ID NO: 664859 - DNA, 197 bp, Homo sapiens
cgtgcggggtgatctgaggacccaatgcagggactcggagcgacgagggtagctaccagcatggtcggtcatactggatgaggatgctttgatctccttcttggagctcatccacatatttcttggtatagtgcaccagtgctttggagatggactgacggatagcataaatcttgtgcacgtgaccaccacccttt

SEQ ID NO: 664860 - DNA, 672 bp, Homo sapiens
taaacacacaaagcagctgcggagcgatttaatggtcttctccttcgacagcttcgttgtacatagctgggcccccgaggccctgactgtcccggggaaaccaagccagcgtggggtgaagctactttgaaacctcacccacagttcacacggtgggtggaaaagaagaaaatctagcaaagtaaatccaacaacaacccaaattaacagtattattaatcttcctaccccaagtcgggctctcccccaggccctgaatctgggtctcaggaaggaggcaggaatagacgctgaccgagacagggcatctctccacccaaacatcccatcttcgtgaggtggtcccaaagctgtgcgccaccccttgtgtgggacaatcaggcactccgtgggctctctaccagcgtgtgatgagacgtacaaaaggagggtctgagcccagaaataaacaagagcatccgtgaggctggagaggcaggcccagggtgcccggaccacccggctctgcctgaaaggatgggcggggttccagagggcccggccgccacctagtgactgctggggacagtggagatgcatgacaggatgcccacctcgccctaggcagtcaaaagcggggtacacacaaacactctaaaagcacacatttagcaggaatccccagtcttccgg

SEQ ID NO: 664861 - DNA, 431 bp, Homo sapiens
gtagggtaaaggtgtgggtgggaggtgaagcagtgatcaggtagggacatgagtctttgcccaaaatttgtgcacccaattcagaattatattgccctaaatttgaacttttggggaatggcgacattgtttgctgacagattgcttttaaactaaagaacgaagaattggaaaatttttttctagggcagagagaggccacttttcatacccagtgtaatataaattccagtgtggatccggattgaactctacttacacagtatctataaattataactgtaggtggatctttggcaagacagttaattacagtgtgcaaataaaattttgtgaaattgctcatttaaaatatagcttttaggagcttgctatttaaaggacttctgtggtagatactttttgaagataaaacattttaaagcaattaa

SEQ ID NO: 664862 - DNA, 1403 bp, Homo sapiens
  misc_feature (458)..(458): n is a, c, g, or t
  misc_feature (542)..(542): n is a, c, g, or t
ccagagcccccttcccaggcagagatttccaggtacctgattattgtgctgaacactgttcccggtgcaccgaggagagggctctgaagaatgacagacacaaaacacagggggacgggtgcgcatccttcccccacgaagcagaaggcgactgggccacttcctacagtcgtatgtaccagtagtgaacgccgaataggagaggacgttcactggcatctgcgttgactagtgttgctagccccaatgcccatgacagtaatgtccccgcggcatggatacacggagtgcaatggatgtatccaacactcagactcgtgtcctcgatggagatgctgtgcttgcgtgcagctcgacgccacttggattctcgtcctcctatcggtgcacggctcatgaatagcccggtattgcaaccgtcgcttgccagcatgcattgcttgctcttactggccaanaccagcgtagaagcaattgtatgcaccaagtgcaaggagcaagaaaaccaggaatcctttgtatgtgggggcttgcagaagtcncgttcacgaggctattgcgcccagaattcgctggaacgctggttctcgaggagagatggtaccaatacatgatccactggtacggcatatttctagagccgtgcaacccaacgtgtttcataactcaagggtactccctctctattcacacgcttcatgccctgtggacctggctgtagtggggtgagtgcactgttctcccagtctggggagcgcggcacgtgccgtgcggcggaacgtactggtcgatccgctggaattggggttctgcctgatgcattgagcgtgcgtgccttgggcgtgctagagcttgaggccaatttccgctggcaaagttctgtgtaacacaggtatctttctccgagttgccttttgagatgttgaggcaccagaaggacctttacttcctcccagaggaccctccttcagaaccacgtgttgagactttgggcgcggaaccctggtacacatcgcactggggagaaattctgctggaggcccctcccagagggggaaaggcgctcaggcaatgccgtttaaccctggtggaggacagctgttttttcccaccctcttttagttcttccccataaaaagttgcttggaaaaattatccaccacaagcagttactaatgtacccgacaaatagtacttctcacacacagcaacaccgttgttttatccacccacggttctcatataaacacagactaccaatcagttaccaaaagtacatccttagtactcgcacacccacccactttgtcactacttcatcaaaccaccaaagtactatagtcacaataatttatcgtactaacacatacacacactacaactatctccccactcactactat

SEQ ID NO: 664863 - DNA, 792 bp, Homo sapiens
tgagggtctcaactttccagccatagcttccctcaactggatgaagcaactgtctccccggaccatcacacctgaccatgccccatactggtgtctgcaaggatcgtatgaccgtgcagggacctgctcgcccaggcgtgagctgcccgccatctctgcacaacggagctgaacgctgccaaaatctgagcaatgaaccgcatcagggtgaagggaagatgtactgcacagcatttatatttgagctcgaaatggatgagagagagcccacagagtctacccaacagcttaacaagccatgaggtcatcgagagagtgaccctgaaccgcccattcctgtttgcatggggatgatcaaagcgccactgccctgcacttcctgggccgcctgtggccaacccgctgagccacagcatgaggcccagggcccacagaaccacagtgacctggcaaggccgtcgtgcccatggcctttagaggacaaaggccagacagcagataacaaccccggacaaatcgagacgactgtgtcaccctccagtcgtcccgcgacctatttccttcataatgagctctgacctttgagcgtggaaagcagctcgctttctaccttggtcgtaagtaggtgactgcagtggagtgacgcagctagaagccatgcagcggcacagatgcacctcccagtttgcgtgggtttatttatagagcaatgaggggtggggaggcaagaaccagtgacttagcgacgcgactactgttccaagaagaattccaaccgaccagcttgtttgt

SEQ ID NO: 664864 - DNA, 103 bp, Homo sapiens
atccttagtctgactggggtgatcatgaaaatagacagctgtgtcagtagaaaattcattgcagaattggtgctgacaatggttgacattggttggttggtgg

SEQ ID NO: 664865 - DNA, 649 bp, Homo sapiens
aaaacgaaataaaggaatgctaggggcaaatttaaactgaaaatatcatttatttcacaagtggattcttggctctttttgcacaggtagcctaagaaaaaaatgtcatcaagtaggtaatgaacccttgtaccaacaaacagccttttgggaaacggcttattccagggttcagccaagaaagttagcaatggcacatcttatttgtattaaaaccaaagaaagctttcaaagatgaatgtgtgtctttttaaaagacacaggcagctagcagtaaggggttatactctgtcaaagttgtggtaagttgagcaccaagaaacataataattgtgtttatgaaaacacattaaatccatagaaatccataattccaaaatgacactataaaatgagagagccagagaacaattagcttgtcatctttagaggtagctgttaaaaccatttcttactttgagaattagaaattacagggaaggaatgtagcacttatcctgtctttacagtaagaactgtatttcatgataacctagttgcccagcttgggagagaaagccctcttacgcaagaatgccagctaataagagaagagcattcaaaagaattagaataacatcgtttctcagctctatgaaatattgaccag

SEQ ID NO: 664866 - DNA, 207 bp, Homo sapiens
ctccagaaatccctccttttaatgtgcaatacgattccatgataaggattttgctcagccatccattcttcagtcgggagtgcccattagcaagcttgttcgttcctggcttgctgactcatcccaagaccatacactgataagcagcagcctttggagtttacagaatgctgcacatatctgtcctttcccatttggaatcagctc

SEQ ID NO: 664867 - DNA, 111 bp, Homo sapiens
tgagagacgtgttgcaatgtgtgctgagctgtttttaaaagaagctgaaaatgccaagcgagagggtgaaactagaattcgacgaaatgctgaaaaggatttttgcaaggg

SEQ ID NO: 664868 - DNA, 184 bp, Homo sapiens
ctcccaagtagctgggaccacaggtgcgtactaccacgcctggctaattttttgtaaagacagggtttcaccatgttgcccaggctggtctcaaacacctgagctcaagcgattctggaggtaatttttctccccctcaaaaaaaaaatttttttacatatgtatatattgggtagttaacgtg

SEQ ID NO: 664869 - DNA, 490 bp, Homo sapiens
cgagacggatttcactctcgttgcccaggctggagtgcacgtcgcgatctcggctcaccacaacctccgcctcccgggctcaagcgattctcctgcctcagcctcccgtgtagctgggattacaggcacacgccaccacacctggctaattttgtatttttagtagagatggggtttccccatgttggtcaggctggtctcgaactcccaaactcaggtgaggcttgatcactcttttaggttctctgtggctaaggtgacgcccacacccgaatgaagttccccttccccagcctcaggcatccatggcaggaggtgaagttgtggggattgttgataatggatggaatgtgaacgagttgcatcaggaaatgcaggctgagcacagtggctcccgcctgtaatcccagccctttgagaggtcaatacaggaggattgcttgaggccaggagtttgattccagcctgagcaatatagtgaaaccctgtc

SEQ ID NO: 664870 - DNA, 311 bp, Homo sapiens
  misc_feature (32)..(32): n is a, c, g, or t
  misc_feature (246)..(246): n is a, c, g, or t
gtggcgtgatcttggctcactgaaacctcttncccctgggttcaagtgattctcgtgcctcagcctctgaactagctgggaccagaggcgcgtggcaccacacctggctaattttgtatttctagtggagatggggtttcaccatgttggccaggctggtctcgaactgcaggcctcaagtgatccacctgccttggcctcccaaagtgctgacataggtgtgagccaccaggcctggccccattnagtgggtctttttcttattgtgggttttctcgtgttatacacttcatgtaaaatgaaaagttttt

SEQ ID NO: 664871 - DNA, 125 bp, Homo sapiens
tgtgattagaggatcccatctcaggcaggacgaatgcctgtagcaagtcagcgcaggctggctgttcatgaataagggcttctgaagagagcacagttgtaccacaaggtacaagagaccacaag

SEQ ID NO: 664872 - DNA, 467 bp, Homo sapiens
ttctccaatcccactttccgcttaactgaaaagcttaaaataaatatctgaattatgtatcctgaagcttgaaatttctttattaatcgatgaaatatgaattctaaattctagcattgaagcttcacaaagatcctcaatatcttgagcaaggatatatgagtatgtgtaagatggtgattcgatatacacacacgtgcagattagacagatgtcggggtggttcccttcttctctctctgtcatctgatatacagcagcttattctctaaggtggaagcggtctcggaggacgtctcacactggtcacagtagtagctggctatacagatcatgctacaggtgtgctttgactgtgtatcagatctctaaaaaatatctgtaaggtcatatctatgactgatatgagtctagcatctcactgtcgattacataccatgtcagatatgcatcgttgatgtatgtag

SEQ ID NO: 664873 - DNA, 138 bp, Homo sapiens
  misc_feature (19)..(19): n is a, c, g, or t
  misc_feature (56)..(56): n is a, c, g, or t
  misc_feature (93)..(93): n is a, c, g, or t
gtcttgcagagtagctgcngtgagtgggcgtgtgccgaagcggtctggcccaaggntgggggcggccgagggtcttcgggagcaggccgcagngcggagagatcctgggatcgccgtccgccgctgctacccggcatg

SEQ ID NO: 664874 - DNA, 856 bp, Homo sapiens
tttgcttctcggtgctctgcagtcgctagaaatctgccagctgctacaatttgctactgaggtcttggaaattcctggctactagtgggctcgtggtacatgttccatggaaacataatgtcgtgatgcccgatcggtggtacagataaatgttcctgaaatcaacgtgtgattattacctgctttttagcacgggacagacatagcagtcattgatgtgttctgcacgtcgtcccttgcatatccattcggatgaggaaactatatgaaggagaagaccaagttccctgagtgaggaagaacaatatgggaaacattgtgaacactgtaggggaaattatatgtgtctgttcaccatgaatcgagattaagcaccatcatactcttggctgtggccctttcagttcctaaagtgtccctgacatctgtgctgcggcaccttgaacaaggtaattgcaactgttgccataagcgcggaaagctggtatctactcaagaagtctccgatgactagatggggacccttgcagggtcccccaggccgtggtgagagtccactgaaagggttaccgtacgccagggttgaatatataaccaacccgacactgaggtaacgccaaacgtgtttcttcgtggttcaatccgtggggataacacctatccacaggctatatattaagtatacaaccttttgcaacaaggggattcgcacagagtggatcatcattggttatcctttgtgggaccactctatggatatcccccgtaataatatgtcattttggcatggcggccttgccttccaaaccacttccccatacagcgcagcccgtggagaaattggcagcgtaaaacg

SEQ ID NO: 664875 - DNA, 1379 bp, Homo sapiens
gcaaactgaggagcccggagctgccgctgggtgtgatcggggccgtgggtgcacgccgggagagatgcctgctgccctggtgcctgacctgacctttgtacaggcctggcttcccttcccggttcctgggtgatggaaacagagatggtggggagtgtgaatcatgcatgtggatagtcggagctctcggagagccggagcgggtcagtggatggcgcgatgtgccgagagcgacgtgcgctagcctgggcgtgcgacgcgcccacgggcaggcgtgcgcgtccggaacacctgcaaggtaacccattgagccatggcagtcgaacaccaaactggggacgacatggacgaagcatctggccaacacacctacatacaaccgacgacatgcaggagatggcacccgagacggaggcaaccacagtgctaggctgacacgagaggagcagaaccagtgaacacaccacaggccacgacagaggaagcaagatggacgtcaagcataaatggtccgagaaactaaaaacaagaccacgagaacaacgtaaccgatggacccactcagaaggacacagagacatgaaccacatcataacaacacaatgactgggaccgcagccaacatgaaccacacggatcacaggcaacatacaggaacaacgagcagcacacacacaaaaagggacagaacaacaacagcgaaacagaaaggggaacataaaccggaccgacagacccccacgacaaaggaccgaatcgcctgaacacataactgagacacacctgggagcaggaggaacggagggaaacacaggaaccggaaacataacacacaccaagggcaagcaaaagactcccacacgacacacgaaaggccgtacaagcaattcaaacccacacaggacgggaactgacgatggagaacataacaatagcaggcagagagaatcataagggaaagacgcaaggtgtcaaaacgatcagaacctatgaaaacttaagaagcacagaaaagaatggcaaacaacgagaggtagtaagtaccaaaataccatgtcgaacaaagaaaagactaaaagtagcacaacatgaacaaggagtcaaaaacaaattgtgcaattggaagagacaaaaccgaggagacgcagcacagccaccgacgcacacctccggggaacagggcgagacgagacgagacaccagagaaagaaccagacaacccacacccagacgaaaagcgcagaatcggaacacgacgcacaccacacagacgcacaaccacagagacaccagaaacaagcagacaccggcaaacaagacgacacgcgcgctcacgaaccacacaaaaatcaaacaacagaaggcatgagcaggagccc

SEQ ID NO: 664876 - DNA, 464 bp, Homo sapiens
  misc_feature (77)..(77): n is a, c, g, or t
  misc_feature (439)..(439): n is a, c, g, or t
  misc_feature (456)..(456): n is a, c, g, or t
ctggctgcgtctttttgtcccgtgcagaggatgttttcgggttggcttttcccatggtgggcttttgcttctttgtngtcgagctcggttcccccttgcgggtctcataatgcatgtggcacttaggtccaaggtctccagagggtgaaagctggagtctgtcaatgtcctactgagacagcacagcccacctagctagccacatttgttttagtctgaaccatatatacttatagaattcagtcaaagatacaccatctgatacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctacaatatgaganacgcaaggggatcctcnaggtccct

SEQ ID NO: 664877 - DNA, 165 bp, Homo sapiens
taattgttcaagtgtaatgagacgaatctgtatacgaatcaggatttctttaaaatctaaataagggggaagaactagatttccatagactgtacagtactggcattgatgattaggatcatggtgactgctgtcatgatcataaactgaggaatcagagagaaa

SEQ ID NO: 664878 - DNA, 342 bp, Homo sapiens
acacaagatgctgtgacaaaatctccaggagcatgcaattagatggctatagcatttttgcaatcggtgtggccgatgcagattactcggagtgggactagcattggcagtcagcccagcgcacgcaatgtcttcttgggggatgactttgacgcctatacgaaaatcgaagatgagttaattacttttgtctgcgcaaacagccatcagcaacctgtccagtggtcacacaaggcatggccattgcatcttgcaggcatttaagatgatggacaatgtttggtttggttgaaaaagatttttcatccgtggacaggggtctctatgcgcagcctggtcacc

SEQ ID NO: 664879 - DNA, 372 bp, Homo sapiens
accattcctctctgccactcgtggttctgttctgtcttcgctgtccgcgtcactcgaattggcgtgggtcttagtcctcacctctctcagcaccttcattcttctctgtttctgtacttgtccctgcctaacaccaccttcttccctgtaggttttttcagtttctctctctgatctttagtttttccctttgtttacggtttctgggacgggctcacactctcccctttcctccctttccccttttcctcatactcctcatttcttctgttttccctctgaggtcctatttgaaatgttttatttttcttctccctaaccttccagacctctcctctctctccccctgtgggcaggacctgaggctctaac

SEQ ID NO: 664880 - DNA, 1570 bp, Homo sapiens
gccggggctgcaccagtgcatattaaaggcttttggcagcaaaaaaaaaaaaaaaataaaaaaaaaaaaaaaaaaaaaaaaaaaaaaaaaaaaaaaaaaaaaaaaaaaaataaaaaaaaaaaatagaaagaagaaaaaaaaaaaaaaatgaaaatgaaaataataaaagaaaaataagtaattaaaaaaaaaaagaaggaaacagaatgatataaaataaacagataagagataatgacatagaaaggaatagaataaaatagaagaagtatgaagtgatagaggatacgagaataaagaaagtatagaaatgagtgtagaattataataaaatgtatatattaatgatagaatgtgatacaatataaagaaaaaatgaaaacaatgatgaaagtactaaataaacatagagaggaaattccaacaacatgcaacaaggtaacatgcaaaaaaatgatccccaaacacatgagtaacattacattggtaccaaagtgacaccaatcaatgaaatccacaactagaacatattgcaatcagcagtagaccatatcaaagacagtagagataacgtcagtctcttactgctacatacgcgaagacgaaacaatagaacgaaaaagaagcagatcaaatcacatatacgtttattatcagataagaaaacaagaacaaaagagagaaaaaaggaagacaaaagaaaacaatataaaggtcaataatgcaacaaagtagacaatagaaatcaaggaacaacatgaagacgacaacagattaagaccaaagaaccagaggaaaacagagcaaacaaatgaagcacaaaaacgatccacacaacatagagaaaaacacacagaagacaacaaaagacaccagcaaaagaaaaaaacgaagcaagagaaaaagactagcaacagaagaacaaaaagacacaaaacaaaacagaacaaaaaacacacacaaagaaaaaaccaagcggaaacaaaacacaaaaacaaaaacaacacacaataacgaacaacacaacaacaaaacaagagaagagaaccaacataaaaccacaaagagaaaaagaacaaagcgaaacaactgagaaaacaaaacaaacaaacaaacaagagaacacaaaaaaaacaaaaacacaaacgaagaaagaaacaaaaaaaaaaaacagcaaagagaaaaaaaaaaaagacaaacaaacaaaaacaaaaaaacaaaaaacgaccaacaacaaaaaaacgaaaaaacacacaacaacaccacggcaaaaaaagacgcagatgaacagacaaaaaggggaaaaagaaaaaaaaaacaaagaaaaaagaacaaaactaaaaagcaacaacaaaaagaaagaacaacacgaacaacaaagcaagaagagaaaagacacaagaacaagacaacaaagaagacagaaaagacaaaagaaaacagcacaaacgaaaacacaaagcacgcaacaacaaaaagacaacagaagagaggagacgaaacaaagaaacagaacacatcaaaaaaaacaacataacatgaccaaagaaaagaagaacacaagaaaaaa

SEQ ID NO: 664881 - DNA, 144 bp, Homo sapiens
ctagaaaatcccctattactggagatgaaagggttaaatattcatattacacagagggagatgatttttagatcatgttttcaagtttcatactgatgtgaatgttaattgagtttaataagctcggggcactttttattagac

SEQ ID NO: 664882 - DNA, 1509 bp, Homo sapiens
tccgcggagcgcgcgcggcacgatgtgacggtcgggtgcaggcatgatgaaggccctccgtggccgggctcccgtccgcgccgcgcgtgctgctgatcgctgagaggaacccagatttccctttccctgagtacgttttagatcgagacggataccgagcgcgacttcctcgtgcagttcgactctggtgcatgacctgctgcatccgtacgatgattccgttggcactgtaggacacacgggtattcgtccgaaccgtacgacccgtgcaacggctgaccgcttctctcatactagccgccgccctgcagcggtgcgccgagcgccctgccatgtggcgatgactcgccacatactatcaacggcaacggacgacggctccccccttgcttctcaactgactctaccagtccggcattctctaggtcgctagaggcactcgaaacgcggagcgctcgtccccgcgacgttcgcgcgaccgtgaccgtgactccacgcgaccctttcgtaagtgcccactgtgggatgcatccctgtatgcggcccccttgtgcgcgtgccgggcgctgccctccgtgcggcgcagccgcagttggccggcctcgctgcccctgagctgaggtcccaagcccgcccctaggcgcggtccgtcccccacacggtgggtcggcccccgttccgctgccccggggcggaccttcgccccatcgccgcgcgcatctggcaggcaccacctctgccgcgacgggttccccgccctgtgcgctggcattacctcttaggcttcccccgccccgtgtcccccgcgacggcgctcacgcgccgcgttcattcgccccgcaacttccggcggtcctcccaccgatgtgtggcttaattcggtctcgcctccctccgcatggcggcctaccccttcagcccttcgcctcagccacctctccgctttctcggcgctccagcgcccaccctccccctcccgcccacgcactcgcccgccgtgtgcccctctcccctgccgcaccagcgatgcggacttgaccccctcagcacctccccaggccagccacccaatcccccgcacatgcgcccccaccatcactctacgttggcatccagccggtgaactagctgctagaccacacatcaacacccaggctcgcgccccaaagccctctgcgagcgccctacacgcagcactaacacaattccaccctatggcacaccactagacgcccaagccaccaccaccaaagccccatcgcttcaggttttcgtgtacccacaccgcaccccacaccctctcaccgaaacctttccccttcaacccaaacagcaatctctcggccgcgaacgacccaataatctacaacacatctactcactatccattagcgcgacgaaactcaccggaaccctctccacccggcttaccctcccatcgtatcgccacaactgtccgaccctcatcacttcttcgcccggcgattccctcacaaccgcgtaacgaag

SEQ ID NO: 664883 - DNA, 131 bp, Homo sapiens
ttatctgtttctagtgtcgtccgagttctctgatgagtgagaataggttgcccactggtgtagaagcttattatggtgttcatcatccagttacggcaagatattagaactatctctctacgacatgttca

SEQ ID NO: 664884 - DNA, 312 bp, Homo sapiens
atcgagctcggactcctcagccttccaaagtgctcagattacatgacagtgatgcatgtgcctagcttagctctttatcattgttccttctattgaagagggagtcttgcagttgtcacccagtgtgtgtgcagtgtcatatcgtcaggtcaggggaacctcgacctccaaggtacaagtgatgctccttgcctcagcttcccaagtaggtgggataacaggggcccgcctcggtgcccgtaataataccgcggtatctacgagaaaagacgggatatcattatgtgggccaggcggaccttgaaatcctga

SEQ ID NO: 664885 - DNA, 283 bp, Homo sapiens
cttagccaataatatgcctatgatgatccctgacagcaaaaagtttgttttctgagactgcaagactgccagtgtccaggtagagactgagcaaaggatgttatgggctgtaccagctcccagagcttcggaagaaagagcagcagctctctcttggggaaccatcagagaatgctgttgatgtgttatgtgtctgtctgtcacctggtcacgaggttttaccacctttgcaattgtcagatatttttcactccctgaataaagtatgtttgcttaaaattga

SEQ ID NO: 664886 - DNA, 939 bp, Homo sapiens
agtgatgatgaaaactaaattgaaatgtgaatacctaactgatacaatgtgggattaagtggaggattatgagaagaggataaccaagatgagatttgagacaacagatttctgggaatgatcacgtaataaatgtctgaatacatatcgtctgtgacatcgttaagacacattctgagggtatatgtctccactaggaatcgaggcatctactgtatgtcgagggaggtgggtccctaatccaccgggataaaaatcccatacagtcctatgcatgtcctcctgtgattggttgaaggtaatggacacctggttccaggagtgtcacaaataactagaactagtatctgtgccgcgccacaagaccccaacgccactaggtcataatgcataattctggtaccaagaatattgaggatcctggtccaggcaccggatatttagctgggcatacaaagttcagtgcataagacagggagcctgttgagaagggctgctccgcgactgtgaccagctcgtgacagcgtgcatatcagaagctgtgcgttgccatatgggtgcacagctcactgaaggtgaagccatggagttggggctccagtccaagctgtctcccccatgcctaatctgttgagctaattactgggtccctaatctaccgtcgtgctggctcagacaaaccaagtccgataaaggcacgtttgtagaactccggttctcggataagaggaacacatccccaggctgtccttgaagctactcgacgttctgtgtcccatctcaacgcatcttcatctgcggtaccgctcgccacccgcggcgcagattcgcacacaccgggcttcttcctggagagggaggggggcaaccctccacacaaacaccggggccccctccaaagggcgaacccaccgcccccggggcgccccacacaattcc

SEQ ID NO: 664887 - DNA, 162 bp, Homo sapiens
tcgaactccagacctataatcccagcactttgggagggtgaagtgagaagatcccttgagcccaagagttcgaaaccagcctgggcaacgtaaggagaccccatgtctattagaaaaacaaaaaaggaagagcctatctgacctgcgctaagtggacgttgg

SEQ ID NO: 664888 - DNA, 230 bp, Homo sapiens
ggccaaccccatcttctgaggatccaggcttttcttctcctctggggaatgccagatcctcatctgtaatcaccagatagggccttcttctcaaacacatgcaggaatgttaagagtcctcctcgggtcacctccctcatggagtttgagggaattatcttggccaccagaagccgtgggaccacaaaggcctacttctgaatagaagtaaccagttcatacatgatctc

SEQ ID NO: 664889 - DNA, 775 bp, Homo sapiens
  misc_feature (775)..(775): n is a, c, g, or t
gtccatcttcctgaggaaggcctgggagataattttgacctggtagatcattctgacttacacatttcggactttaaccctagtctgaagactctgtgcaaactggccgtgattcattataacctaatccagtcctgtttgcctcatgatatcaggtggcgacggctgaagtgccatgtactcaccaacagtcagatagtcacgtcgtcctccagtcgtctcctcccatgggtagtgaggaagtttgctcgtccacctccctctctcctgagcctgcgtgtctatctttcagcatggccctctgcacccatcttgtcatcccggcctgtcttcctttgtacctcctcggatcttcggtaatacctctcgatgatgtgaggtggttgcggcgtacgtaggtgttctctgttgcttgtgcactacatgtggggaagctgatagctgggcgatgcgtagcgctaagagcttctctatccccctccttcttgaggcctgaaggggctcccgttcccctttgggtcgctcatgctcctccatttcccaaccgtcacttatgcagccctgtcgtccctgggtacgcattagttctactggggccccagtgggaccacgtaccaagtgcttatcttgactggtgccaactgggtaacgggcgcactggtgcgtcgtaccgtgggccgacagccctagtcggcctgtttcatgatgacctttcagggagggctttaccccccgttccccgccccttttgccttctgttcccgtttctccgctn

SEQ ID NO: 664890 - DNA, 432 bp, Homo sapiens
  misc_feature (10)..(10): n is a, c, g, or t
  misc_feature (23)..(23): n is a, c, g, or t
  misc_feature (320)..(320): n is a, c, g, or t
  misc_feature (416)..(416): n is a, c, g, or t
cctaatgaanatgggttactatncactgtgcctcccttttaataggtgaatccaaatgaaggtgttacagagagtttcagtaacgagttggtggtaagatctgaagacttggactcaggcttgcaggcacccagcacccccacactttaagtaagaagttagttattgccgggcgcggtggctcaatcctgtaatcccagcactttgggagaccgaggtaggaggatcacgaggtcaggagtatgagaccatccctggccaacatggtgaaaccccatctctactaaaatacaaaaaattagcggggtgtggtggtgcanacctgtagtcccagctactcaggagggtgaggcaggagaatcccttgaacctgggaggcagagattgcgccactgcactccagcctgggcgacagnagacgaatccgtctca

SEQ ID NO: 664891 - DNA, 1466 bp, Homo sapiens
  misc_feature (833)..(833): n is a, c, g, or t
taatacaacgtttaatcatctgggttgatcaaaaaatgcaaggcctcagctcataggaacagcagcagaaattagcgagagacacgggacttttattacaaaaaaatttgtgtgtgctttacaaaacattatgtgcaaaaaaagcttaaaaaaaccagagaccaaaggcagcatcctgctaattttccatctactattaagaaaaaaaaatatctggtacctaaggttttaatttcccttaaaaaaatattattccgcttaggcacaattggctggggggctttagaaagatataagccaggttctccacagaattccccctttggaggtgacttgtgtttcccattttctccggcttttatatagcttaaggcatttttttctcttctcgtgacaagggtgtttgtttgggtggctgtggcttccagggttggggttacacgtggcaaaaaaaacaaaagtgtgtctctccgtgttagaccccgaggccaacggggcccaagaattgcgagtttccgggaactccgaggggaacgggctcacagaaggtgacacacgggggccgtgaacatctcgggacacagcgggggaacgataggccacggtgaagtgtggtatagcgccagggccccccaggggaaaccccgtgggaccccaagtgtgttcaccccttgtggcgggcccccaaatcaactccagaaaactttgttacaacggctatgcgcgatatgcgccacacaaattggtcattcgacacaacacaggggtggcgttgtacacagccgttggtcgagaacatctgctggagtaatagaaaacgccccagagggggngtcacccacaacacaagtgtcgccgcagtatctgggggcggcaccaaaagaagccaaccgggggctgttaaaaacggggtgtgtgggcgctcatccccaccaaggagaagggagatacacgttatacaccacatatgttgcaccaggagagagagattaagtaggacagcactcgcaccaaacaggccagtagcggatgagaggcgagaccacgctaaaaggcagcccacaaccgaagtggagggcgtgcccacacacacagcagccggaagaacccatgtatcaccaaacacagcccggcgaacaacaaaaaacggaggagtatggtgagtacacaggtccgacccactcgccagatggaatgtcaacccccgaagataatgatccatgacagctgagataagaaaggagcaacacaagctgaagtgagccaaccaagaggtaggcatgaatgtaccgacacacacaagcgaggaagaaaaaatcaacacgaccaccgacgatagaatatgaatcaagccgagtgaagtccaaagacaagaagagcaaggcgagaggctcactacgatgactatgagtacgcacatataatgcacatatatatgtgtatagtcgattagttctgcaatcaga

SEQ ID NO: 664892 - DNA, 107 bp, Homo sapiens
tgcacacgccgaacatccatactgtcgacacgctgaggaatcacactgtacacgccagatatccatattcttcttaaaatcacggtcatgagtggactgaatgctct

SEQ ID NO: 664893 - DNA, 124 bp, Homo sapiens
atcttcagcatcatgttatcctgggcctcagctcctggggacccacgtccctgctctaacacctgcctcggtttttcctactgtcctcagctggcgtgctgggtcccctctctcagtcgacatc

SEQ ID NO: 664894 - DNA, 601 bp, Homo sapiens
gctcatacttaattttttgttaattaaacatttattatgatagctttttaaagctgtgttgtctttgattcagggcagaacagcaagaaacatgagacctttatgtcaattagctgatcccctggaaggtggaaacacattgtcggcccgccttcatggggggaaagggatatcaatggtgtgaaaaacacccatgcaaatttttgatatgaagaagaaataggggttctccaacccggaaaagtttgctcctaatgctaccccctaggggacacccccccaaggggctataaaaggggctgggatatacgggggggcccccccccccgaggattttttttagacatataccgaccagggcggctttgcatgagcacaagccatgagctggtgcccagctaaaaggggcgaggaaatttaaaaagagggggtcaacggccatgggcgtcccaaagataaagttttcccttagaataaaatgggggggggcccggggagattttgcctccaaggatgtttataagcggtgtgtggttatcacacaacaaccggggccggagggaataggtgcttgggcaagactatgactcccttatgcggg

SEQ ID NO: 664895 - DNA, 201 bp, Homo sapiens
cacctccacaggaggcagtatggacaacatggtgacaccccgatctctactaaaaatcaaaaattagcaggtgtggcggtacccgcgtgtaatcccagcttctcgggaggctgagcgaggagaatcacttgcaacctgggaggtggagtgttgtggcgtagtcgagtatcgtgccactcaacctcaagcgttcgatcacag

SEQ ID NO: 664896 - DNA, 140 bp, Homo sapiens
ttcccaggacatcaacagctgtgtcaggcacttgctaaggatcctaaactgcagcaaggctacacgctatgggattctcccagcggcaggccaatttctagagggcagtggctcagtacatgcccgttcaccctcccatg

SEQ ID NO: 664897 - DNA, 2163 bp, Homo sapiens
  misc_feature (1948)..(1948): n is a, c, g, or t
  misc_feature (2096)..(2096): n is a, c, g, or t
  misc_feature (2101)..(2101): n is a, c, g, or t
  misc_feature (2104)..(2106): n is a, c, g, or t
attaactgttttgatgagtacctattttgatgcaaaggaacggccctgggacctcatagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaatgggcagtggcatgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccaggaggggtcagacgtccttgtgatctgcccaggtgtcacggaaggagattttctagctccacatctgtctgcacataggaaggaacaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatttggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgnctcactcctaaccctgactttattcccaggccccacaccgaggcaggtgcaggattcgccatggtgcagcctccgggtacaaacatctgaggcactggcgatccagtccttgcagcacctgaacacagctcagacatgaggggataangtggntgnnnagagagggcttgcatctgcctcagattgactcaatgttcggtccccccgggtgtcca

SEQ ID NO: 664898 - DNA, 1138 bp, Homo sapiens
  misc_feature (923)..(923): n is a, c, g, or t
  misc_feature (1071)..(1071): n is a, c, g, or t
  misc_feature (1076)..(1076): n is a, c, g, or t
  misc_feature (1079)..(1081): n is a, c, g, or t
gtttaatggcagagtgcggtccttaaacgagaaccacttagggaatgaaagacacgctcttatgccaaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatttggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgnctcactcctaaccctgactttattcccaggccccacaccgaggcaggtgcaggattcgccatggtgcagcctccgggtacaaacatctgaggcactggcgatccagtccttgcagcacctgaacacagctcagacatgaggggataangtggntgnnnagagagggcttgcatctgcctcagattgactcaatgttcggtccccccgggtgtcca

SEQ ID NO: 664899 - DNA, 107 bp, Homo sapiens
tcatactggcaacacccacacatgcagcccagcacaacaccactagcacacaccaggtcatctatcccatgtatcagcaccacacacacaccacattggcacacaca

SEQ ID NO: 664900 - DNA, 187 bp, Homo sapiens
  misc_feature (13)..(13): n is a, c, g, or t
  misc_feature (99)..(99): n is a, c, g, or t
  misc_feature (121)..(121): n is a, c, g, or t
aacagcgcacgtnaaagaggctcacgcgcgctgtcccattaatggtgatgatgtgaatggccagacaccccttcattcaggtggcagtctggcccatgncaaggttgatattccatctgantggtggcgtgctcaatctgatagtgatccatcaggtagtgttggatctgatccaacaaggcatcgt

SEQ ID NO: 664901 - DNA, 465 bp, Homo sapiens
  misc_feature (180)..(180): n is a, c, g, or t
  misc_feature (215)..(215): n is a, c, g, or t
  misc_feature (227)..(227): n is a, c, g, or t
  misc_feature (237)..(237): n is a, c, g, or t
  misc_feature (240)..(240): n is a, c, g, or t
  misc_feature (246)..(246): n is a, c, g, or t
  misc_feature (271)..(271): n is a, c, g, or t
  misc_feature (275)..(275): n is a, c, g, or t
  misc_feature (282)..(282): n is a, c, g, or t
  misc_feature (303)..(303): n is a, c, g, or t
  misc_feature (346)..(346): n is a, c, g, or t
cccccccccccctttccccaatggggggggggggggggcgggggggggttttttttaccccgcccctttttttttcccccccatttgcctgggggccccccccccccttttttttcccccctttaagaccccggggccggtcccccccccgggttttttctttgggccgggggggggttncctttttcccccggggaccccttttcccctttggncctttttggggncccctttaanccngttttntccaaaaaaccggggggggccgggncggnttttccngggtttttttccccccccggnccccggggatttttggtttttttagggggaaaaaaaacccccntttttttttttttggggccttcccccccatttttaaaaggggggccccccttggggggcttttagggtttttttttttaccccccggaaattaaaccccctttggggtaaaacccccca

SEQ ID NO: 664902 - DNA, 473 bp, Homo sapiens
  misc_feature (9)..(9): n is a, c, g, or t
  misc_feature (167)..(167): n is a, c, g, or t
  misc_feature (172)..(172): n is a, c, g, or t
  misc_feature (200)..(200): n is a, c, g, or t
  misc_feature (279)..(279): n is a, c, g, or t
  misc_feature (436)..(436): n is a, c, g, or t
gggcggcanagggaggcgtttggggccgctccagggtccgctctgccattcctgaactggtccctcgtccccgtgactctggcatcagggaagcgaactgttaggcgagaggaggaggcagcagaaccatatccccttcttcctcggggcgggggcgggccaggcgnttgancggggagggctccgggaggagtgcctgncagccggctgtctgccgcgatggatgacagtaaggtggttggagcaaagtaaagaagcccgttaaacgtggtcggaacnaagccaaaattgacttgaaagcaaaacttgagaggaacccggcagagtgcaagagaatgccgagcccgaaaaaagctgagatatcagtatttggaagagttggtatccagtcgagaaagagctatatgtgccctcagagaggaactggaaatgtacnagcagtggtgcatggcaatggaccaaggaaaaaattt

SEQ ID NO: 664903 - DNA, 757 bp, Homo sapiens
tccgccgtgttggagctttcgctgtctggggccgggtgctccgggcctcccagctgtcgccgctagctgagttagggctcccgtccacgctgccgcacgggcttgctgagggccggctcgtactgggaggcttcgcgttcacctgaacatttccgcctcctctggatgggggatgagaggcggggctgatgcatcgcatcagtcctggaccctgacttcggacttggagaatgaaagcgccgaggatggaacggtgagttagttggggttatgacgcttggcgcgctgggagctggcacccctggtctcctggacttcacttcccaggaggcctcgcgcgcgactggaagtgttggtagcctataagaaggcgaggcggaacccggcgatctgtctctgtgggcgtgataggcgagtcggctgtagtgcactacagggtcatgagttctatctgcattcgtcctatggaacgctcgcggtagacggcaggctccggatgcctgtgtagcgacgagggcgggttccggaagatcccggactcactttcgctcccgacgtgatggttagcgggtgaggtcctgcagagactgttcacgtgatatgctcaaggtgcccatttcgcaggacattggagcccaggccagtgctctgagcctatcatgtagggctaggggagtgcgtgatcagacatggtgtctgggacggttctatctatgtccttgctggtgctggggtcccggggctctatgtgcatcct

SEQ ID NO: 664904 - DNA, 101 bp, Homo sapiens
aagccctgtcactccttggtacctgggatctgagcacgaagctgagtgggaaacagtgggggctccgaagcgcccagcaggccagcgccctcctttctaga

SEQ ID NO: 664905 - DNA, 499 bp, Homo sapiens
aaccaggaagcctggctgtccaatgttccaaatctggatgtgaaatggaccatgcagacaggacccaaggggcatgggggagctggcagaggcacccgggaaaagtggggaagcacctgtcggccaggaaggtagagaggcacctaccccagaacacggtgccagcgtcacactcttattaacagatgcaataaccaccttcggagaccagacccctcaaagagcactcagcccacaatgtgacgcagagaaaccagagacccaggcagggagtgcacccacggggacactccgagggtggcctcctgcctgccctgattacttaaaaaggagattcttggaaacctttgcgggcccacaggtgcaccctgactcccagggatgggggctgagccacccaggaaacaaatatgaaatcaaagatccagacagccctgaccctcctgattccagggtccataaataagtcattcttaaaatagtggttgttttctctcta

SEQ ID NO: 664906 - DNA, 139 bp, Homo sapiens
ctcattgaaattaagagagacatagagagagactcaccaaaatgcccaacggtgacaaagtgtgcagaaccgagaatcattcttcaaaaactcaccttgatcttgaagacccgctcgtgataccaatggagtgtggctg

SEQ ID NO: 664907 - DNA, 178 bp, Homo sapiens
cttgagacataaagagcctccagatctctggcatgctgtttacagatcaacagacgtcgatggcaagggaataattgaggaaaacttccctggccttgctagagatctatgacatccaaatacaaaaagctcaatagatacacccggaaaactcattgcatacaagattataacctag

SEQ ID NO: 664908 - DNA, 144 bp, Homo sapiens
cagcccattagggcctcgctataggtttgaacaaagtgctgcaaaaatccagagaatggcatgaacctgggagacagagcttgcagtgagccgagattgcgccactgcactccagcctgggcgacagagcaagactccgtctca

SEQ ID NO: 664909 - DNA, 244 bp, Homo sapiens
gataagacctgacatatagtagaaactcaattaatacagatgagtgaactgaatgtaggtccctgcccttgaggaagatcacaatttagtgtagtcatatgtacacttaacatacggcaacatgtcctacagacatgacgtcatatgggcgactgtatttttactgaagcactcgtcaacgggtacttactgtaaaccctacgatggtcatagcctactacatcacctggagctgtaccatact

SEQ ID NO: 664910 - DNA, 495 bp, Homo sapiens
  misc_feature (7)..(7): n is a, c, g, or t
  misc_feature (44)..(44): n is a, c, g, or t
  misc_feature (52)..(52): n is a, c, g, or t
  misc_feature (73)..(73): n is a, c, g, or t
  misc_feature (87)..(87): n is a, c, g, or t
cccaaangggccttcctgaaaccccaaaagccccccggggaaangggaaacngagtaaagccaggcccttgtncctcactgcccccnctaagggaacttggtcacctcggcacttttaagccctcagtttctcccagttcaataataaggacaagagccttttccccatgcattcctctttccccgggaaagttgactgaggtgacccagtaatagaattgaaaagggagagtgtcttcagtgcaatgtggcatccctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaattta

SEQ ID NO: 664911 - DNA, 169 bp, Homo sapiens
  misc_feature (20)..(21): n is a, c, g, or t
  misc_feature (23)..(23): n is a, c, g, or t
  misc_feature (57)..(57): n is a, c, g, or t
  misc_feature (74)..(74): n is a, c, g, or t
  misc_feature (96)..(96): n is a, c, g, or t
  misc_feature (108)..(108): n is a, c, g, or t
  misc_feature (127)..(127): n is a, c, g, or t
  misc_feature (136)..(136): n is a, c, g, or t
  misc_feature (144)..(144): n is a, c, g, or t
  misc_feature (150)..(150): n is a, c, g, or t
ccattatgaaatcagaattnntnttgattctgtgcaatcaaaacaaaaggcagaatngaatgctgagattggtnaaaattgcaatgaccatcttgnaccacagatttntgctatgtgtcatcaaaanatctagttntgagtaanattttnacgattgttataaaattat

SEQ ID NO: 664912 - DNA, 408 bp, Homo sapiens
  misc_feature (53)..(53): n is a, c, g, or t
  misc_feature (92)..(92): n is a, c, g, or t
  misc_feature (135)..(136): n is a, c, g, or t
  misc_feature (159)..(159): n is a, c, g, or t
  misc_feature (176)..(176): n is a, c, g, or t
  misc_feature (194)..(194): n is a, c, g, or t
  misc_feature (407)..(407): n is a, c, g, or t
ccgtttttggagccccccaaggaaggccctcatcccctgccgctacttttttngggaatgtgggttccatccaggattgggggcctttttgntcaccccctttgcacccaggatcctagtcccctgccctttggnncagctgcttcctgcaaaaaaacnagtttttggtctccctnaaaaaccatgtccctcgngctgttttttgcctgtcccccctgtgccctgccctccagcttgtatttaagtccctgggctgcccccttggggggccccccgctcccaggttcccctttggtgtcatgtcaggccttttgcaaggaaaaaccccttggggaaaaatggaaaagggcaaaaaaaattaataaatttcccttggcccccgggtgagctgagggtttttgcaaggna

SEQ ID NO: 664913 - DNA, 340 bp, Homo sapiens
cgctattacaaactatctatctgcggggaggaatggggtgcgtttgtactgttcaaactgtcatcctattgttacgttgttagatatcgggagtagtgtgcattaggtgcagtagataaggcgtcagtagaactagaggttaagtgagggtgatggtcgctatcatcgtcgggctcattaggctcttgttcttcgtgaactcttcgatcatggcccctttgggctaaatacgccggttagcgggggcatggcctcctagggagaggagggtggttggaatcccgggtgtttgtcctgttcgcttgtttcaggtgcgatatagttgtatactcgcggagtc

SEQ ID NO: 664914 - DNA, 620 bp, Homo sapiens
ggactctgagaggaccccccttgcgggtacatactcttatatacgccaacggttaagaaagggtcaacataaaaaaaaagacattgtgataataaatactgctcttggggctgtaataaataaaaagtttatataccaagggaatgcactttaccagccacaagtatcttcaaaaattaatgaaacaaaattatatatggccatagttcacagttacgcagccaaaagctgctccaataacagcctttaaacaacatgggagcttcctcccttctccctccccttcaggaagtatatgcacagttccaaagtcctctggctgaaatgctctcaacagagagaatttaagaatcaatgcaccttactgcaaaatggtctgaaaaaccttttaaaacaggtatctcaaggaaaactgcatgctggttcactcttggatagtccaaagtcaagaactgtatgccttagcctgttctggtaccacccagtccagcaggccacaggggaatagtatacgaaccaccacatgtccatctactacaacatactctagatcattcttttggcttccctgtagatctcacagtggaaaagaggagcccataggtccatacgaaaagtca

SEQ ID NO: 664915 - DNA, 923 bp, Homo sapiens
tgggaaagggggagcaggggggggggtggggaaagacgcagggggggttttccgggtttcggaccccaggggccggagggtgaaatcctcccgtgcaggggactcctcaatagccacgtgtttcgccagaagagaaggagaggggataaacccgagcgccaccatccacgcaagccgcaccagtgccgctcctaagcctgcacagccgcggcggcagaagcagttgagagttccagggtctccctccactggctgtagtaacccgggctccggggccatcggggggtgcctccgtgagtgccccttcacccagcccctgtgaagactcccaggggggcgagggaaatagtcagagggattcacaatctttcagctaacttattctactccgagtgaatcggctgatgtgttaacagaggaactaaggtccaacgacaagacgaggattctcaaggttccagtccaggctcacagagcgccaaagcgctttaacgggcgaacagtgctgagttggcggaagcctctacatcgagaatcccgggggggagcgttgcccgaggggtagcagggacagcttggcagttctcctggagttcgctgaggagcagttgcaagccgaccatgtttttcattgggttccacaagaaccgggaggacagagccgccttgctccgaaaccttcagctttgggggcttggagatgtgggagaacgggggatcccttgtccccaagagacccgagcttgcttctgggctacacgttcgagaagagagtcttcgggagaagacggcaggaatatggccgagctaggagactgggaaatcggccctggggcccacgcgtgtacccgggtgggttagaaccgtaaagtcgtcatccggcgggattggccgcatgtgtaccggggcaattacgtcaccga

SEQ ID NO: 664916 - DNA, 241 bp, Homo sapiens
gtttcaaaaaaaaaaaaaaattgtttccttgtcaaattgaactaggtccatttgaatatgtgtattgctttaatgtatggaagtttttagtataaaagctgaaggttcatgcctttcggttaataaatgtttgaaataaatgtttaggggtttttgatccccatgtcaagttgttctttcccctcttttaaaatatccccttttatttccccagaaaagtaaatggtttgtgggcgtctta

SEQ ID NO: 664917 - DNA, 588 bp, Homo sapiens
  misc_feature (28)..(28): n is a, c, g, or t
  misc_feature (74)..(75): n is a, c, g, or t
  misc_feature (79)..(79): n is a, c, g, or t
  misc_feature (94)..(96): n is a, c, g, or t
  misc_feature (99)..(99): n is a, c, g, or t
  misc_feature (129)..(129): n is a, c, g, or t
  misc_feature (356)..(356): n is a, c, g, or t
  misc_feature (587)..(587): n is a, c, g, or t
acttcccaaattacagtcatttccccantccccagggggtaaagcaatgaggtgtgaagtctgccagcggtctnnccgnggccgctgagcgctnnnaangaatggcagcggccgcatgcagcccatctnccaagctgggggaacgacagggctgcgcccacttcccagggccgggagggagaggctccaggagaaaaaggccaggtgtctctcccaaagctgctcacccctgccgtcctgcctggaggcagaaatgctaggaacatctgaaaacaggccctgcgggacgcgaacaatgggcatagaaaaacgccatcacccaaaggctgcctccagggttagcgctgctcgcccangccgcctgcgcgtccacaagtgtccgatagagaagcaatgcagtctccatcgatggaggagcaagagagccggcgcctctaaggcttccaaggtaaagcctagggcagcggcgggaccgccagggaggcccaagcggccactgcagggcagttcgagttctggtctggaggcgcgctgtgtcgcgccgtcagatgggtcaaaggctgcgcatggcgacctctgtcctctana

SEQ ID NO: 664918 - DNA, 677 bp, Homo sapiens
  misc_feature (21)..(21): n is a, c, g, or t
  misc_feature (69)..(69): n is a, c, g, or t
  misc_feature (84)..(84): n is a, c, g, or t
  misc_feature (105)..(105): n is a, c, g, or t
  misc_feature (115)..(115): n is a, c, g, or t
  misc_feature (117)..(117): n is a, c, g, or t
  misc_feature (128)..(128): n is a, c, g, or t
  misc_feature (130)..(130): n is a, c, g, or t
  misc_feature (133)..(133): n is a, c, g, or t
  misc_feature (136)..(136): n is a, c, g, or t
  misc_feature (140)..(140): n is a, c, g, or t
  misc_feature (167)..(167): n is a, c, g, or t
  misc_feature (170)..(170): n is a, c, g, or t
  misc_feature (186)..(186): n is a, c, g, or t
  misc_feature (199)..(199): n is a, c, g, or t
  misc_feature (210)..(210): n is a, c, g, or t
  misc_feature (212)..(212): n is a, c, g, or t
  misc_feature (230)..(230): n is a, c, g, or t
  misc_feature (242)..(242): n is a, c, g, or t
  misc_feature (244)..(244): n is a, c, g, or t
  misc_feature (255)..(255): n is a, c, g, or t
  misc_feature (269)..(269): n is a, c, g, or t
  misc_feature (279)..(279): n is a, c, g, or t
  misc_feature (323)..(323): n is a, c, g, or t
  misc_feature (349)..(349): n is a, c, g, or t
  misc_feature (388)..(388): n is a, c, g, or t
  misc_feature (390)..(390): n is a, c, g, or t
  misc_feature (417)..(417): n is a, c, g, or t
  misc_feature (460)..(460): n is a, c, g, or t
  misc_feature (466)..(466): n is a, c, g, or t
  misc_feature (469)..(469): n is a, c, g, or t
  misc_feature (492)..(492): n is a, c, g, or t
  misc_feature (585)..(585): n is a, c, g, or t
  misc_feature (660)..(660): n is a, c, g, or t
tttactttagttagatgagtnctacaaatttaaagctttgaaaagctactacttttacttctaatacanccagatgaacacgangtagcaatatcagcttgtatnccagagaaancncattagttttncnggngangganccacttatccacgtctgtgggtactgngcnggcagattcacagggngggggtaaagcanccacaatggcncnggcagcatcaggatcacncttgaaggggcncncagacaaagtngtattcatgcaacnaattcctttnccattcgttttcttagtcactaatgctttccaatggtcatgagnccttttaataatatcaatggcaaagnccttatctttaaattctgcattaaacgcaaacccatttncnggtttcccatcaggaaccttatacctnctaaaccagtccacagtagcttctaggtagccaggtttcagcngtttgncancattgatatcattataattggcngcatcaggatcatccacattaatggcaatgactttccagtgggtttccccttcgtcaatcatagccaatatgcctagccctttcacgccaatnatttcacctcttgcacataccttgcttccaatttcacacacatcaattgggtcattgtcaccacaacagccagtntgtttatcattgtcccc

SEQ ID NO: 664919 - DNA, 187 bp, Homo sapiens
aagtatggctgtgtgcgcttgtgtaagagtgtccaggttcacgcccggtgcctctcatgagtctcagaagcgcatcagagccaaccttgcgagcaggattcctgcagcctctcggcgcatagagacctaggcagccgcaggacacctggcatttcaacaggagtgaacctggctgactctcggacgc

SEQ ID NO: 664920 - DNA, 305 bp, Homo sapiens
tttattctactttgaccgtccgaaggttatgcagagaacgtatctagtggctcttgtgcaatagaacattaatggatgccatactcttgcttgcacccggtaggattgacaccaacctctaataaggtctcaaaagtctaccctcttccacacatgtttttgattccggatctgtttcccgatttgagcaccttctatgcactgtagcattcccttgagccttatttgatgaagaaggattaatctcaggacggcaagcagcagtatctgcagttcttagaacagcgttagagactggacgggct

SEQ ID NO: 664921 - DNA, 310 bp, Homo sapiens
cccgacgactgacatacacgcacgccagcgcttgcaccatctccctggtcacttgagagaacattcccaagatatagtgagaggccacacgggcttatttgtgagttatcgaggttgtaggactcaattccggtttaagaaggttctttttgtgggggatagaaacagaggtctggctatgttgcccaggcttgtcttgaactcctggcctcaagtgatccacccacctcggtctcccaaagttctgggattacagacatgagccaccgcgcctggccgtgtctggccttttttagttatttcttttttt

SEQ ID NO: 664922 - DNA, 335 bp, Homo sapiens
tttttttggtgggggaggtgaataaaattgggcagctaaatttttcagttccatgtgcctcccaaattaaaaacaaaaaataagtagtttttttgaatttacttgcagacaaagtaaaaactgtgctgcattatgtttttttgtaaacaaatgacattttttggccagggacattccatccaattttttgtcaatccccctgttgtattaaacaacaaaacttaaagggaaaaatgatttttgtatacccttaatttctttgcatggttttattttaaataatttatgtaaaaatcctgacttttttttttttggaaacatcaaattaaaattga

SEQ ID NO: 664923 - DNA, 332 bp, Homo sapiens
gcgccctatggttatgcgcttgtaggttgtgaggcgctgattcgtgacttcaaacatcaggacaacggcctgttgggcatacgcgtcgaaggtggccgtcgttaccgcgtgcgtagtccggcgtgcagaaagaccagttgctggtggccgatgtgcaatggctgcaagaattgccggaccagccgctgggcgaagaggacgccgacttgctggcgttgcttgaggccttggccaaacacccgatggcggcctcgctgaacatgggcggccaggccgaaggccatcaagccctgagcaaatacagtggccatatctgctcacattaaacgagg

SEQ ID NO: 664924 - DNA, 292 bp, Homo sapiens
aaaggttatctttgaagaacatgggcaccttgtaatatgttacaggctgagacactaggatgaaagaaggcacatctctcccctcaagtttagtcttgcggtagaactttaaaaaaaagccaccaatggggataattgagttttaaacttgatggcaatgatttaagtgaagagaacacctgggtttattttctggtgttggagaggtgaataaacatcaacagttgaacctttgatttcagtggatttcaacatgagggggcagggactgcttcagcgtcgacgcggccgc

SEQ ID NO: 664925 - DNA, 124 bp, Homo sapiens
atcagggcggaacctgttctcttgggcctagatcttaccccgcgcggagctggcttgcggatgtactcttttgagaaactatcatcattatcatgatagccctcacttcctccctggttattca

SEQ ID NO: 664926 - DNA, 182 bp, Homo sapiens
cttaagtctggaaatgtgtttgtttcttgagattgtgtcttgtcaattgcctggtctggtcacgaactcctgagcatcagtgatcctcccacctcagcctcctaagtagctgggactacaggtacgcgtcacagcccccagctagttgcatacttttttttttttttctgaaacaagatttt

SEQ ID NO: 664927 - DNA, 578 bp, Homo sapiens
gcaagggaagctgggaaattgtagtctacctggtttccctggaagaaaggaaggtggttttagtgaacacacagcagtgtctgccacatgaccatgctgcattggttattacatatttgaatatcacccctaggtaaagtcacaaaggtagcaagtggcagagccaggagtaggacctaggtctgtgtaacctcagatctggattctttgcagggcctctcatactcctttaatggctggctcaggttctgcacctctggatgcagtgggtgttgtgattgcctatgtggactctctttccaggcaccaacaattctataaaacatgtgactgctctccctttcccttccatggactatctgggctacaaatttgagagtaggttgttgggaatttttgtgagcagccaactcaggatcaggtctgtgaagctcctggcttatgtggtgctcagtggctctcttgggagtgaggggcgatagacaaactgtgtcactctccccaggagggctgggctgtcattagcattcagcaaggctgtgagtcttgttgtacaaatcagctgtttaaaggcctta

SEQ ID NO: 664928 - DNA, 104 bp, Homo sapiens
gagagtcgagatcacactattgcacttcagcccggcgtgagagacgcaagaccctctgtcaaaaacagacgcaggaacgcaagcttttccactttcctttctct

SEQ ID NO: 664929 - DNA, 272 bp, Homo sapiens
accccaattaatgcttaaagagtgaatctacattttgtatgaaatctgttgctactatgttattctcagttcttcaaataagaaaccaacaccaagaaaatatttgttttgttttttttaagaatcattacacttctttcttaaaaataaagagaagtgtccacattatgtatttttagacttggctgacagggtatagctaaattttttttttttttttttagaaggaatctcacttcttctcccaggctggagtgcagtggcatgatctt

SEQ ID NO: 664930 - DNA, 418 bp, Homo sapiens
  misc_feature (48)..(48): n is a, c, g, or t
  misc_feature (354)..(354): n is a, c, g, or t
cacgaggtgccaccgaagttgccgaccgcctggccgtggatgccgtanatgaagcggccggtgtcgccaccaatagccggctggaagttatccagccgaaggatgccggacgacagcagcgaaatcgtgtccggaatcagcgatccctcacccgccgggatcaacgaggtgaacttgccgcagcgaatggtggtctcgggcaacgacgtcggaacctctagattgtcgtagaagaccagatcagcgcgaattccactaggtgcactatagggtccaacctctttgtcgcgagtccgtccgctaccattcttctcctggagagcaagcaacactacagcagagtcgtccagatcntcagggttgaacgtctggatgctgaagtcgttgtagtcaatgaagtcatcgccggggagctcgg

SEQ ID NO: 664931 - DNA, 233 bp, Homo sapiens
taaaaggggggccccaggcccccccccaaacccgttggcccccaagggccagggaggatttttggccctggggggtgacttggcctaccaacccctcccgttcagggccctggatgtggaaaacagcccgtgaggtccgtgaggttttggccgtttttacacccggggcctccccgggttccaaaaaaggcccggttttaaataaagggccggggcaggatgaaagggaaata

SEQ ID NO: 664932 - DNA, 298 bp, Homo sapiens
  misc_feature (12)..(12): n is a, c, g, or t
ggatccttacgnagtgcaatggctcatgcttataatcttaatactttgggagactgaggcaggcggatcacgaggtcaggagatcgagaccatcctggctaacatggtgaaaccccgtccctactaaaaataccaaaaaaaaaattagctgggcgtggtggtacatgcctgtagtcccagctacttgggaggctgaggcaggggaatcacttgaacccgggaggcggaggttgcagtgagtgaagatcatgtcactgcactccagcctaggtgacagagcaagactctcaaaaaaaaa

SEQ ID NO: 664933 - DNA, 174 bp, Homo sapiens
aaatggtataatatatctgtcatttggcaggtctacatatctttttcctgtatcgaaaatctactgtctcaaagagtctaggctacatattcttaaattgcttcagattactggttctatctatttattaatacatctttcgatccattcatccactcttcgataagctgggct

SEQ ID NO: 664934 - DNA, 656 bp, Homo sapiens
  misc_feature (12)..(12): n is a, c, g, or t
  misc_feature (25)..(25): n is a, c, g, or t
  misc_feature (30)..(31): n is a, c, g, or t
  misc_feature (48)..(48): n is a, c, g, or t
  misc_feature (83)..(83): n is a, c, g, or t
  misc_feature (95)..(95): n is a, c, g, or t
  misc_feature (109)..(109): n is a, c, g, or t
  misc_feature (112)..(114): n is a, c, g, or t
  misc_feature (117)..(119): n is a, c, g, or t
  misc_feature (121)..(122): n is a, c, g, or t
  misc_feature (124)..(125): n is a, c, g, or t
  misc_feature (127)..(127): n is a, c, g, or t
  misc_feature (129)..(129): n is a, c, g, or t
  misc_feature (134)..(134): n is a, c, g, or t
  misc_feature (147)..(147): n is a, c, g, or t
  misc_feature (177)..(177): n is a, c, g, or t
  misc_feature (186)..(186): n is a, c, g, or t
  misc_feature (215)..(215): n is a, c, g, or t
  misc_feature (277)..(277): n is a, c, g, or t
  misc_feature (352)..(352): n is a, c, g, or t
  misc_feature (355)..(355): n is a, c, g, or t
  misc_feature (366)..(366): n is a, c, g, or t
  misc_feature (434)..(434): n is a, c, g, or t
gatacgccagcnacagacgccggcngccannatctgcatccctatgcnacgctaggaccctggggaagagcgcaggagcccgngtgaagggctgnaatgaggggactgnggnnntgnnnannanncncncctanaaggcagaagccntcgccccaccctcgagctccgctcgggcanagtgcctgnctgcctagccgctgctgcgggcgcccacntcgcccagccatgccaggcccggcaccgacgcggggaagatccctttctgcgacgccaaggnagaaatccgtgccgggctcgaaagctctgagggcggcggcggcccggagaggccaggcgcgcgcgggcagcggcngancatcgtctggnggaatgtcgtcctgatgagcttgctccacttgggggccgtgtactccctggtgctcatccccaaagcnaagccactcactctgctctgggcctacttctgcttcctcctggccgctctgggtgtgacagctggtgcccatcgccttgatggcagccacaggtcctaccgggccaagctgactctgaggatatttctggctgtcgccactccatggctcccagaatgacatcttcgaaatggtccaggaccaccgagccacaaaaagtactcagagacggatgctgaaccc

SEQ ID NO: 664935 - DNA, 1037 bp, Homo sapiens
tgactagcagaccacttagcgaaaccttttacccaaataatgtataggcgatgagaaattgaaagctggcgcaatatatatagtacctgtaagggaaagatgaattgattatacaccccagcataatatagcaaggactactccctatacctgctgcataatgaatgaactagaaataactttgcaaggagagccaatgctaagaatccccgaaaccagactgagctacctaaagaacaggctacataggatgcacacccgtctatgtagcacaatagtgggaagatctataggtagaggcgataaagctaccgagcctggagatagctgggtagtccaagatagaatcttgatgttcaacatttaaaatgtatgtccaacgagtaaccctcataaatccgccttgtaaattaaatctgttagtcgcaaagaggaacagctcttaaggacatgtaaggaaaaaagcttgtaacagagagtaagaagatctaagcacccatagctaggcctagaaagtcagccatccaatatcaagaatcgcgtagcaagcgcaaacaatccatctaactaaaaggaaccccatacatggtacactgagactcactcacatccaatgtggaagccaatatatcaccctatagagggagctactgttagtatacagttgacatgaaagcattcttctttcgcataggcctgtgtcgattaataacacgtgactctgacacatgtagagctcaattatctacgatcaccgaaaagtcagtattgaccctcactgtgaaccaagaaagggatgcatagggaagggtacaaaagtacggattgggccactaccccggctgtttgcaaatatacctcgtgtacaagttgaaggcgctgctggagattttaagcccgaccaccgaaaggggacactggccaaaggccgtgagggcccaccgacgcgtgtaacaaaaaacgccgaaagcgtgtccagacactaggtttgagacacaaacatcaatatggggccacgtccacatggagaatacgag

SEQ ID NO: 664936 - DNA, 189 bp, Homo sapiens
ttcagtgctgtgtgtggtggatcacacctataatcccagcactttgtgaggctgaggcaggcatgatcacctgaggtcagttcaatgccatcctggacaacatgctgaaacccatctctacaaaaatacaaaaattagctaggcttgatggcagtcaagttactagttactgatgggacgcaaactggt

SEQ ID NO: 664937 - DNA, 432 bp, Homo sapiens
ctagaggatcccccgcagcacactgcaacaccaagagtcaggcagtgaagtactcttcaggcagcattgccttgaagctgctcatctgtttcaaagctaatgatatagaaaaggcggttcaatggctggacacgaatgttgtggatctcctaatgaagcatatttataaaggatttgagagcccgtctgacaatagcagtgctatgttactgcaatggcatgaaaagccacttgctgcttgaggagtagaatccattgttcgtatcttgactgcaacaaaaacatttttgtctgacaggaagtgcattatctgcctcggcagtgggaattgctggtacaaagaccaaaacaaccaaatgccaccgctgccctgtgggtagcatctgatactctcagctttgccttattgctttttcatatctgtaaagaaaa

SEQ ID NO: 664938 - DNA, 423 bp, Homo sapiens
cggaaattcggccattatggccggaaggatggcttaatttttaaattaatggcctaaccaattttaccatccgatttagggttccctttttaacaaaattttggccaacattggtaatctttggcctggctgataatacccattttaaggggggtaaggggaaatctaatggggcttttaattggaattcccctgataattaggaaggttgagtccctttttaggaccggtttttaatctgggggtcttttgaaaaaaaatttaaccaggttttggccctcggaattaggccagtggatattggctgttaagtggaatggttaattaatatattgggggggaacttctggttagatatataatggcccatagtttttttaactgggctggctttggggattaaattcaaataattcttgaatc

SEQ ID NO: 664939 - DNA, 272 bp, Homo sapiens
tatcgatgccactagccatgttcaggaaaacaccctcttgcccctgtttctgtccagtgaggatgatcagaatgtgtccctggggtgtatggctggctcgcagttttctcacgtgctgactgaagggttcattgccgtgtctcaacagctttcgatggacatcttcaataggataatatctaggcattaggcgaagttgaagcacccgggtaccgccgttcttgtcagcagcaacgggttctgtaacagttggtgggatcgataaacactgt

SEQ ID NO: 664940 - DNA, 484 bp, Homo sapiens
  misc_feature (22)..(22): n is a, c, g, or t
  misc_feature (25)..(25): n is a, c, g, or t
  misc_feature (33)..(33): n is a, c, g, or t
ccccttgacacataggacgccnggncgatggcnggcacccgcaggcgggccacatggacgccgtgcacctccccgtctggcggtagccatcagggaagccaagatgggtgcatcgggtacatccaggatctatggagaaagaagcagcctgacgccaggggctctccagggagggtccgctgccggcagcaccggcagctctctgctctccacagggctccccgccccacccggactgacaaagcgcgccgaccgggctacaaggccaagcaaggtaacgatatatataggaaccgcgttcgccgaggcggccgaaaacgcccagatcctaagggcgcacctcacgccaagccctgccatcatggggctaaccagctaaagttcgctcgaagccttcagtccgccgcacaggaacgagctggacgccactgaggcgctccgagaagcccgcaccactgggccggcgaagcccacatctcctccg

SEQ ID NO: 664941 - DNA, 609 bp, Homo sapiens
tgccatagagtgaactagtgctatagaacagaaattcatttaatttagtatatcaacagcctatgttgttaatctgggctctggtatgacataaaaattgagaaatgatatactcggtgtatcgcatcaacgtgtgaccttctattgtaggtctatcattaggcaagtgtacgcttacgtgatctagtgtctaaaagtggatgtttcaaatgagttacgaaggaagatatggacgtgttgttgaattcgactttagttcactgtcctgatctaatgaaagacaggcatttggatcagctcctcctttgtgccttttatatcatggcaaaggtaatgtatacacttgggagaagaggctgggcatggtggctcacacgtataatcctagcactttcggaggtcaaggtgagcagatagcttgagcccaggatttcgagaccagcttgggcaacatggtgaaacctcatctctataaaaagtataaaaatcagctgggcattgtggcttgcacctataggcccagctacttgggagactgaggtgggaggatctcttgagcccaggaggccaggctgcagtgagccgagatcagaactgtactcagctggc

SEQ ID NO: 664942 - DNA, 292 bp, Homo sapiens
cgggtagcagtcagacaacaaatggcaggcggttattagatgtagctccaggaggttgagttcagcccaatggggactccgtccaagatgtggcagttggaaggcccagtttccaagggaattcttttatcttttattaaattgaggcaaagtctcgctctgtcatccaggctgaagtgcaatgatgtgatctcagctcactacaacctctgcctcccaggttcaagcaattttcctgcctcctcttccctagtagctggaattacaggcacgcgccacacgcccggctaat

SEQ ID NO: 664943 - DNA, 106 bp, Homo sapiens
  misc_feature (105)..(106): n is a, c, g, or t
gctcaaaagcaagggaaactatatactgacttcatagaaaaggagctccaaaagagataaacataagattttcaaagccaaaacctcttaattgcccaaagaatnn

SEQ ID NO: 664944 - DNA, 155 bp, Homo sapiens
atgtgctggcagaagcaggaagcgcttcctgcttctgcctcccgagtaggatgcgcaccactgtgcccagctaatatttgtgtttttagtagagatgggctttcaccatgttggccaagctggtcttgaactgctgacctcagatcatccacctg

SEQ ID NO: 664945 - DNA, 433 bp, Homo sapiens
gtctaaaataagacgcagagaaatacagtcagaaaatttacctagataacaagaggctctcaggctaggggaccatccctttcatcttctcttaagggactataagaaaaactaccacttgtatatttctcctgtgcactggccgtccagtgacaatgagcaacaccctatgaatagagtctcgagacatactgaccttgctcctcatacgagcatctctggtgcccaaggaacactgcattacccgtctctttgaggagatgtgaccccaacaaggataagcacatcaccctgaaggagtggggccactgctttggaattcaagaacaggacatagataaaaatctcttgttttgaccgaacattttaaagaactcaactttccagcatcctcctctgttctaaccacttcagaaatatatgcagcgttcca

SEQ ID NO: 664946 - DNA, 552 bp, Homo sapiens
gatagagttaataccctggcgagagggataaaagaggaatgacagcgctattcccatgaaccatgatatataccccgatcatcagcagcgccagcgcgcgaggacacggcgcggatcggtggcgcgatcctggccacactgtccacctaccagcagatgtggattagcaagcaggagtacgacgagtcgggcccctccatcgaccaccgaaaatgctactaaacggactcagcagctgcatagcatcagctgcatgggttcatcgagaatagcaaatttgcccctggccaactgcacacacctcatgctagcctcacaaaactggaataagccttcgacccgcacttgtccttgaaagcttgtatctgatatcagcactggattgtagaacttgttgctgattttgaccttgtaattgacgttaactgttccccttggtacttgtttaataccctgtacatatctttgagttcaacctttagtacgtgtggcttggtcacttcgttggctaaggtaagcaactgtgcttgtggaagaccaggtagagccgag

SEQ ID NO: 664947 - DNA, 366 bp, Homo sapiens
tggcctcccccccccaacacaacccagactgtgaactgcatccttaggactcagagttcttccaaagtgggaccccctcaagagttggagagagaacttgcgtgctagcggcccagcctgggggcaagggtttgatggcagccttccccctctagccctgagctgggtgaagatgatgctgtcccggagagctgcttccaactgtcattgagctcccgggagccctatgggaggaggggctcagggtcactcttttcaggaagcgccagccctaggaaccccagaaaagagtggtacctaaggctgaaattgtttttgctgttgccaggggtgggtatttgagagtaaaacattttatttcttttt

SEQ ID NO: 664948 - DNA, 238 bp, Homo sapiens
tcgatctagaggatccctggtgaagaggaagcatggcgctccgaagtaccaggaactcgaaaattaatgctgaaaataaggcgaaaataaacatggcaggcgcaaagcgcgtacctacggcccctgcttgcaacctccaagcccggactgaggccaagaacagctctaggggacattggtaacaaaagtcagtgaacaacttgcaggccaaaaatgcctatgaagaagcgaagcaaaa

SEQ ID NO: 664949 - DNA, 692 bp, Homo sapiens
gcattgccgctctgtggcctctctgggttgcttctcccggccctctgtggatgggtcttttcctggaggcgccccctcttgaaaaggtggtgcctccccgggggttgcacgccccgcccaccggttgtgttgcgtgagtcattgtcgggggactctcgcgtgcatttgcctagaggatgttagattcgcgcttctgtgactaaaacttttcccccctctcgatggtgggcccacaaggtgctttccccagcgcgctgtttccgcctacgcccgcgcgtgtagttgaggaggtgtggggggtgaaatactttgagaatgagatgggttaaaagcgctttgaccaaggttgtttcctgagcagtgggggcccactatatcgtcttcacagtggtgtgcgtccaccctggtctgttcactcctccctcgatagttcgctggtgagtgattacagcaagtcacgcctctcctgcctctgtgagcgtctgtcggtcatggagcgcacctgctcccacctatgatacgtgtaaataacggactcacgacccagccagcgcctaagatcagccgcccgcgctgtaccgagcacgcgccccaacccgtaggtgccacgagggccgccagaataatcggggcggctatcataccgtgcgtgaccccgaggacgcgccacgaagaaagatcaatacaagata

SEQ ID NO: 664950 - DNA, 105 bp, Homo sapiens
ttaggatcccctcatcaaacccttcatcaaaccctgtcatcaaccccctgaccttttgggttttaagcaggaggtgtcagaaaagttaccgcagggtttcgatga

SEQ ID NO: 664951 - DNA, 136 bp, Homo sapiens
gaaaaaaaaaaaaaaagatggcctggggctgcattttttgggtccttaaagtgggctggaaaaacctaaagggcccagcatgtggctgggaaactgttggtggccagtgggtaaaaaaaccctttcagtttcccta

SEQ ID NO: 664952 - DNA, 113 bp, Homo sapiens
ctggctgccaggtcggctcgaataaggaggcttagagctgtgcctagtgactccagactcatgcgccgaataatagtgtatagtgttccaatgtctttgtggtttgtagagaa

SEQ ID NO: 664953 - DNA, 459 bp, Homo sapiens
actctacaggatcttcatcaaccctaaatttattatgcacaaatttccctgtagattttattaagaacttaactgctcaggcacagtggctcatgcctgcaatcccagcactttgggaggccaaggcaggcagatcacctgaggtcaggagttcgagaccagcctggccaacatggcgaaacctcgtctctatcaaaaaaaaatacaaaaattagccaggcgtggtggcgagcacccgcaatctcagctactcaggaagcagaggctgcagtgagccaagattgcaccactgcactccagcctccctgggcaacagagcaagattctgctgcaaaaaaaaattagaaaaaaaaaccaaaacttaattatttggaaaattatcttcatctattagttgatttgaaaacacacattacttttcaatccataataaattcagggtggatggggtaccgagct

SEQ ID NO: 664954 - DNA, 300 bp, Homo sapiens
accagcaagagacgtccactggtggaaatagtgtcgaatctccaggtcactgaggatgtactggcaccttttaagccagcacgtgattcatcatgtcattggggatatgaacatttcgctttggtatcctcataatgttttctgtagttcaacgcactcctcatcttttggaaatccatactgtgaaccacaccagggaattcaccgatcacttttccatcctggtagtgacctttctgcttctcatatgtctctttgtatttgagctcactgttcaccatatcaacatactttccgaat

SEQ ID NO: 664955 - DNA, 147 bp, Homo sapiens
ttgcatagagacctctcaacattttacccatcagtctaaaaactatatactatcaccaaatatcccattaaaaaaataaaacctacattactagccaggtgcggtggctcatgcttgtaatcccagcactttgggaggccaaggtgg

SEQ ID NO: 664956 - DNA, 327 bp, Homo sapiens
gagtaatttttctttgggcctcgttaagaagcaaataatagggcaccggggtacagtggctcctgcctgtaatccccagcactttgcgaggccaaggtagcggatcatttgaggtcagaagttcgagactagcctggccaacatggtgaaatcccgtctatactaaaaatacaaaaattagccaggcgtggtggcaggcacctgtaatcccaggtacttaggaggctgaggcaggagaatcacttgatcctgggaggtggaggttgcagtgagctgagatcatgccactgcactccagtccggggtgacagagcaagactctatcta

SEQ ID NO: 664957 - DNA, 715 bp, Homo sapiens
atgggacatgcagcgcaagtaggtctacacagaagcgacttcccctatcatagaagagcttatcaccttgcatgatcacgccctcataatcattctccttatgtgctgcctagtcctgttatggcccgttttcctaacggctcacaaacgaaagctaactaatactaaacatcgtcagaccgctcaggaagaatagtaaaaccggagctgaactaatcgcagcccgtccaatcagtcgcatagccgctcatcgcgcctcaccagtgcgcctacgcaaattcctgtttggcataatcaagacgagggctcaaatgaatcctcctcgcacttaccattcgagaatcgaatgtgggcatcacaagtggtacgtgaagcctacggagtgacaccgtagcataagaggtggactaacatctatcacactgcgctgatcatggagcttcaccacgcagtattcgcatagaagcgcaggcgacctgtcgagctgcttggacgttgacaaacgagtagtactcgccgatggatgcccccatgcgtatgtaataacatcgcaagacgtctgctctcatgagctgtcccaattaggcgtaaatccagatgcatcccgacgttaaacaaacatttcacgtaccgacggggtatactacggcaagctcgaatctgggggcaaacaagttatgccatgtccagaattatccctaaaatcttgaatagg

SEQ ID NO: 664958 - DNA, 775 bp, Homo sapiens
agcggagaagtgacggcgaaggcggtgcgacagacagctggagggcagaggaggcggctgcggggtgtcctgtcctcgaccatgagtgccgcagcaggactgccggtgatccggaaaggtgttcattcaggcgagcactacacgctagtggtcattcacagctgccagattccagaccagagttccctgcggtagtctggagacaccggattgatacgtgctacgcgagtgttgaaagaacacagttcgaactctcaaataacctttatgcagaagcaagagaagctcggggccagtcatatctcgaaggttgtccggcttgtttaacagcatataccatcggttcctatgcatggaagctcattcatgagaaggttctgaagaaagtctccacaagtacattcaagtagcagaatcgagaagatctatcgctccacgaaggagctcctccgtgacagatcgctattgagcgaggactgcgagtcattgatattaccatttatgtagagaccgaggtatgagcagtggaagataaatccgaagaatttaatgatcccacattcgcagctcgtggtccgccttcactgtatccaactggaccgagtcgagatgctgtcccttacgtgctcctcgagagcatcattccttgctatcgtgctgccagagactcacggtgcacatttacgtcccaaggaactcactttctataattccatcacctggagtgacctctagtcgctcagcatccactttgtgtctccaaattgtgtaagac

SEQ ID NO: 664959 - DNA, 443 bp, Homo sapiens
ggatctcatgataatagctacgaaaaagagaaaagacaagagaggagggaagaaaaaaaaaccgaacagcctgaggaataagtttagccaaggaagatgagagatctactagaaggaaaactacaaagcacggatgaaacaaatcgaagaggacacaaacaaagggaaagacatcccatgctcatggatgggaagaattaatatggttaaaatgactcttctatccaaggcaatgggtagattcaatgcaaccgctatcaaaacaccaacatcagtttttcaaagttagaaaaaacaatcctaaaattcatatggaaccaaaaaagagcccaaatagctgaagcaatcctgagcaaaagggacaaagctggaggcatcacactaccggacttcaaaatatactacaaggctctagtaaccaaaacagcatggtattgacctaa

SEQ ID NO: 664960 - DNA, 851 bp, Homo sapiens
gcgtgtaaatggtgcttcctagaaggtccgtgtccacgtgaacctcttaatctcagcatccggagctccaggaagggaaaatccagtcagatagaatctatatataccatttcttgggaaccttcagccctcaagattccaaatcatgacctcagtttcaatcagttgtccttagtcctcatgtcactgcttgggcgctgcctgtggtgaagcagtagaagccggtgatgcaatcgcccttgggtaggtgtggtcctcagcattacaggcatttgtgcctgctgggggggtatatgcagaaaaagaatgcccagatgtgacttggaaaggctactgagtcaaacctcacccgtgaaaaaccttgtgcgcttaagaggctaaacctgagctgtggtgtgtgaaagggtccaaggaatcagtaaatacagggagttcacatttttccatgtgttccatgaagtggaaaaaaaacatacctttataatggacacacaaaagttgttttctttacaacatatagtgcaagaaaatgaggctataattgtgtaggtaggtagtcacagaagtcagaggggtgacattttaccttacgtaatatccataatcttaggaattctcttcaaaagctgtgaacataggagaagggaggtctggccagaattttaggaattcaccatgtcgggtataatcaggccctgaacgtaggggcttaaataaaattggttgggccccacgtaaatttttgaatacgagccgggaaagaactttccctgggaccttcacatgtcggttccatcgcgggacacactgtaacacaccgtgggagcacggtgggacaaattgacccgaga

SEQ ID NO: 664961 - DNA, 354 bp, Homo sapiens
tggttggatggccaccatttggtttttggccaaataaaaaaaggccttatttttttgggggccctggggccttttgggtcccggaatggcaaccccccccaaaagttccccctttctggttgggggccacctcaaaaagttttgcttgtgttttttttttcccccccgatttttccttttgtgggtggggggggccccccccccccccctttggtccggggttccaaaaaatttttgtggtttcccccgcggtcccctttggggtcccttttttcctttttccccccccccccccggggggtttcagggtttttttttttttttttaaattaaaatttaataccctttttccca

SEQ ID NO: 664962 - DNA, 348 bp, Homo sapiens
  misc_feature (24)..(24): n is a, c, g, or t
tgggggccctttgggggggggggncccccccttccctttttttggggggccggggcccccggggggccaggttacccccccccgggttttttgggggccccccccccctttccccggggggggcccgccctttgggggttgggggggggcccttccccccgggggtataggatattttttaaaacccgttttggggggggggccccccccaccccccctgggggggggttttttacccccggggccccccgggtttttttttgggggaaacccggcccggggggaaaaaaaggtttttttttttttttttttcctgggggttttttttttaaacccctttttttttta

SEQ ID NO: 664963 - DNA, 187 bp, Homo sapiens
ggtcgtctggattgggtggagaggagccaggttgggagtggagggatgtttacaggaatgcagagtaggaccattgtcgcagccggattcctggtctggggcaccaacgtccaagggggccacatcgatgatgggcaggcgggaggtcttggtggttttgtattcaatcactgtcttgccccaggct

SEQ ID NO: 664964 - DNA, 248 bp, Homo sapiens
gtatacataaaatagagttgtgaacttaaactagagaaagctgcaaaaagtggtttggagagcatggcagggcagtgaagaagggctaatagaagcaggtcccttgcccagaaccctcaggtaggcctattggttggatagcggacacctgaggcaggaggtggcagggcccaagtccaggcaggcagcagcggggctctacttgagagctgagcgtggagaggtagcgctcgcctataacttgatcc

SEQ ID NO: 664965 - DNA, 288 bp, Homo sapiens
cctaacgtatttagaagtagcttaagattcaagagacaatatgacagacttcgaagagtagcatgaggaaggaaaagatacaaggttactaaaacatgacggaggttgagatgaagcttcttcatgaagtaaaaaatgtatttacaagaaaattgagagaaaggactacagagccccgaattaataccaatagaagggcaatgcttatagattaaaatgaaggtgacttaaacagcttaaagtttagtttaaaagttgtaggtaattaccctcatttgaaggcaatcg

SEQ ID NO: 664966 - DNA, 272 bp, Homo sapiens
gtcagtgtaaattctgcttcccaggttcaagtgattctccgtgcctgagctccgagtagctgggattacaggcatgcaccaccacgcctggtaattttgtatttttagtagagatgaggtttctccatgttggtcaggctggtctcgaactcccaacctaaggtgatctgcctgcctcaggctcccaaaatgctgggattacaggcattagcccactgtgcccggctgctggtgattcattattgattgattcattgccacacggtctctca

SEQ ID NO: 664967 - DNA, 806 bp, Homo sapiens
agcggctgttgctgtcgcgccgctgcgtggttgctgtcccgtggacccctaccatggaggagaccatctaaagatccccccacatcagtctgtcttgtctggtgtcagcgtgtacaatgttgctctcaggtcagtctttaagcagtgtggagaagttctacagtccctggaggggacgtcagatgtcattataccttcacccagcatttcatccctcgtcgaacggattggattggcatctgtagagtggggtggaagacgaaccagtgagtattacaccttcatgtgggttactttgcccagtgacctaaacaagaaatcagctaaacagcaggaagtccaagtcaaacgctgactacctgcccaaggatgatgagtattagcagttctgctatgtggatgaggatggtgtggtccggggagcaagtattgctttgcaattccggccagaaaatgaggaagacatcctggtggttaccgactcagggagaggtggccgagattgagcagcacaacaaggagctctgccacgaaaaccaggagctgaaggacgggtgtatcagcctccagaagcagaactcagacatgctggctgagctccaaaagaagcaggaggagctagaaaccctacagagcatcaataagaagttggaactgagagtgaaagaacagaaggactattgggagaccagagctgcttcaactgaaaagaacaaaaccagaagatgtcctcagacaagtgagaagacggggactccgacgtggatcaggttcaggccccagttgtcactccagagacagaatgg

SEQ ID NO: 664968 - DNA, 378 bp, Homo sapiens
ctcacgcgggtcgggtgatgagtaaggagacgatctgtgagcacataccgaaatcgtaattccctcgtgggttgcctctttgccgctgtcctgctgggtggactctcgtccacggtgctggcagaggaaaatggcagcgaccattcaaccactgttcctgttacagcaacggacaagccagcaacggcaaacgattcgaagctagatcacggggcgatggaccatagccagatgagccatgagtcgatggatcatgaccaaaaaaccaaaaaggcagattgagatcatgaccagtaagtttttacgcccaacgctgatggcacttgcagtctctaccggtccagcattctttttcatggctcaagccgctgaagagat

SEQ ID NO: 664969 - DNA, 158 bp, Homo sapiens
tatctaaggatgtactcccactggttgcagcgacagggtaggtgcgagcacccaggctgacagcgtgaacatcaccagcttccagtgccatcacgagaaccgtgtcctccacacttgacgcgggctgtgaccacctgtgactgcagtccacaccgggt

SEQ ID NO: 664970 - DNA, 388 bp, Homo sapiens
  misc_feature (250)..(250): n is a, c, g, or t
ctggccgcatcagattttattttattttatttatttattttgagacacagtcttgctttgtcacccaggctggagtgcaggggggtggggtgatctcggctcactgcaacctccacctccagggttcaagtgattctcctgcctcagtctcctgagtagctgggactacagatgcccgccactaagcctggctaatttttgtatttttagtagaggcggggtttcaccatgttgaccagggtgtgggtanatcttctgacctcatgatccgctcgccttggcctcccaaagtgctgggattacaggtgtgagccactgcacccagcctaaaagtcattttaatttgtaagatatgtttactggtttagagagacagaggctaactttt

SEQ ID NO: 664971 - DNA, 536 bp, Homo sapiens
  misc_feature (21)..(21): n is a, c, g, or t
  misc_feature (65)..(65): n is a, c, g, or t
  misc_feature (73)..(73): n is a, c, g, or t
  misc_feature (226)..(226): n is a, c, g, or t
  misc_feature (229)..(229): n is a, c, g, or t
  misc_feature (271)..(271): n is a, c, g, or t
  misc_feature (287)..(287): n is a, c, g, or t
  misc_feature (295)..(295): n is a, c, g, or t
  misc_feature (316)..(316): n is a, c, g, or t
  misc_feature (319)..(319): n is a, c, g, or t
  misc_feature (321)..(321): n is a, c, g, or t
  misc_feature (352)..(352): n is a, c, g, or t
  misc_feature (355)..(355): n is a, c, g, or t
  misc_feature (370)..(370): n is a, c, g, or t
  misc_feature (384)..(384): n is a, c, g, or t
  misc_feature (394)..(394): n is a, c, g, or t
  misc_feature (401)..(401): n is a, c, g, or t
  misc_feature (407)..(407): n is a, c, g, or t
  misc_feature (436)..(436): n is a, c, g, or t
  misc_feature (444)..(444): n is a, c, g, or t
  misc_feature (496)..(496): n is a, c, g, or t
gtacaggatggatgtggaganggaaaacagcaagtacacacagtgggacaggccacaggacaggntgggagtnaataaagagtgcacactgcttccctgctttccccagtaactgaaggatctaagccacctcctcctcaacatcctcctcgaactcgccctcctcctcggctgtagcatcctggtactgctggtactcggacaccagggcattcatgtggctctnggnctcggtgaactccatctcgtccatgccctcgcccgtctcccngtcccggccggccttncgccgggncatggccgtggactgctcggnggngngcttgaacagctcctggatggccgggctgtngcnaaaaaaggggggggngatttttagacccngaggagggangtaaaanaaagcngtgttaaaattgtaggggatccactgaanaaaatagntggtgtttttgttttggtctttagcttttctcatccactccttcatggacangcggccctgaccacggcggcaaccgtcagcagcggccatg

SEQ ID NO: 664972 - DNA, 173 bp, Homo sapiens
ggagcacatttaacctgagcacgcttcatggggagctgccagcctgccatcgctgcgcgctatcgtggcccgagccaacagtctgaagaattccgggagtccccgactgacatcttcaagctcagatgatctctcagatcctggaacttgacgccacaatccagcttgactag

SEQ ID NO: 664973 - DNA, 328 bp, Homo sapiens
gccgaattattaggtactacccaaggtaatcagctgctggggatcaagcctgccatcgttatctgttgacataatcattcagcgaatctgtctttctcaacaagtatccagtatctggatcttcattagcagttggatcccatctgtaatcaccaagaaattctgtccaaactaacaaatccatcaccattctagtcatgttcttctaaacttcttgaatgaaaattccgtcatataatcaacttcttcaggatgctcaaacagccataaattcttcaaagcatcacaccgggacctgaatcctggttagctttttcaaatcgcttct

SEQ ID NO: 664974 - DNA, 618 bp, Homo sapiens
  misc_feature (521)..(521): n is a, c, g, or t
ggtgaatgcccactgcctattcattcccattaatatgacgtaaatactataaattcttttagtggcttcttctggtaattatctgatgtttctggcaatacacttatactgcttttagaaaaccagttttagggttgggcatggtggctcattgcctataatcccagcactctaggaggctgaagtgggtggattgcttgagcccagaagtttgagaccatcttgggcaacatggcaaaaccctgtctctactaaaaatataaaaattagccaggcatggtggcgtgtacctgtagttccaaacacttgggagactgaggcaggaggatcacctgagcctgggaggcagaggttgcagtgagccaagatggagccactgcactccagcctaggcaacagagcgagaacctgtctcaaaaaaaaaaaaaagtcaattttagatattatctcttgagttccaattatggaaaataagcatttagttttcttatgtccccccatgtgcaaatgcacactcactntatcctcccatcttcacaatattattctaatctccatttctggttaaatctagaattagcatttacattgttatgactatgcatttatagcatttat

SEQ ID NO: 664975 - DNA, 131 bp, Homo sapiens
cccagtttttaatggagtggatgacatggctcttgcaaactcctcctcctgggttcaggcgattcatctgcctcagcctcccgagatagttctgcctggcattaaaggagctgttcatgccactgccatta

SEQ ID NO: 664976 - DNA, 928 bp, Homo sapiens
  misc_feature (7)..(7): n is a, c, g, or t
tgcttanacaagacacagaaacagaagggagaagaagagacgagagacggaagcaaagtgagagggtagcaaatactgcccccccttttggatccctcccggggacacggctagtcaccacagcgcctgccttctttgtgggtccccaattcagggccccggccccctgggttcaacgccgggaaagtggaaaccccgccggtacaccccgctctgtataaggagtctgatcttgacgaatcctcgcaagggttcgtccacttcccggctaagggtaccccggctcccccccaaaggagctgtcaagccttcatcactccccccttaaattgcaacagtcggcaaattacgggccattataatagtcctattgagtggggggctaaattcctcaagagcaattaagaggtaagaagaccgttagcaggtctttctaaaaatgcgggtgcgaacgcccggaactttctttctttcttcgttcctcataaacacgcccgttacacccccctgttccacaccacaacctcctccccctccgtgtaaaaaaacacagcctttaaacctatagcctgcgttaaaatctttgttttataacacgcacaccacggctctttctcgtaataatgtgcaccccctctcggcgaagtgtgttgttagattaacccccttccctctgggtgatttctttcactaacccctcctcccctgtcccgggcaccaccaattggagggcattataattgagcgctggagaaccttctcaaaccacgcgtttgtatctgtggggcaccacgcaccccaagatgattataaataattgggacgaggaatcagttttcacaacagcaacccgttttggcatagatccccttaaacggaaaaatttttttttccctcaagaaaaccccccctttcggcccacaaaaca

SEQ ID NO: 664977 - DNA, 285 bp, Homo sapiens
ctgaggatcccgacactgatcgagcaggcctgtgagaatcaattcaggacagtattttttctgtggtcctttctccatcctggatcagagataaactattaagacgtaaaaaaatactcaaaaatatgtaagtgtttgggttgaacctttagattggctcatgatgtttaacataacaacatttatttcaaatcactgaattcatggagatgtggacacgctgggttggctctattttggtttatgtgtgatagtggttctgtcatcatcattcatgtttttaag

SEQ ID NO: 664978 - DNA, 124 bp, Homo sapiens
tgctccggctgatctagaggatcccgtgtctttctgccaggcatatcctgggtcttctagcaggactaagccagtctgtggacgctgatatagaggatgagctgggggactctgctctgtcctc

SEQ ID NO: 664979 - DNA, 261 bp, Homo sapiens
tgactctagacgatcgcttatgtggttgtgggtagaggagcggagttgttgcagaacgcaggatgtggtgcttcgctgaagcttcaggacctcatcgaagagattcgcggggcaagactcaggcccaggagcgggaggtgatccaaaaaggagtgtgccacattccggtgctccttccgcgacgggaaccaagtgcacaggcaccggcagcttggcccaaactgctctacgtccacatgttgggctacccacacccacctg

SEQ ID NO: 664980 - DNA, 133 bp, Homo sapiens
cggcacggggtgttcccattttgatgttggggccgaaaatcgttgtgaaagtgttgaaggcacaagcacggggtcagaaagctaaataaaaaaatgaaacttttttgggtaataaaaatgaaaaggcgctgta

SEQ ID NO: 664981 - DNA, 186 bp, Homo sapiens
tttatccataatatggaaaggaggaaatttctaccctgatgcaggagggaatggctgatattattcattaccacaggcctagcatcacatgtggaacaactcctctcttctatcgatggactgcttaagcggggtgttacccggcatggcttgtgttattattgacttcagccctctaggctacag

SEQ ID NO: 664982 - DNA, 129 bp, Homo sapiens
  misc_feature (72)..(72): n is a, c, g, or t
gcggtgacggtgctgcgcaagaaggggccctacggccgcccaggcaaatccaggcaaggctaatctaagccncacaagagccgaaggagaggttgtggaacctcccaagaatatggcgctgctggccaa

SEQ ID NO: 664983 - DNA, 226 bp, Homo sapiens
gaattccccccccccccccccccccccttattcagttggtgggggccataaggtggaaagaagttttccacgggagagaggggaaacggaggaaccgtccacggccaccgtgtgacctgtggaatgtgtgaatcccctgaaattgttccctgctgcggtttaaacccggggggatgggaagggagaacctttccccgggttggaagagaaggatgattcttaatcc

SEQ ID NO: 664984 - DNA, 433 bp, Homo sapiens
gacatgagcagctgagcctgagtgcgaagacggagagaaggccgaccacagtcatgacatcaacccccataacctggggacaactcaagaaaaccacacaggaggctgagaaactactggagcaccagggacagtctgtaaagttggatggaccatcaatgggaaaatgagagctgcccacccatggccttacactccttcaattaatacataaacagaaaggaggatatacagagagccaaaggcccatgggacgtgaccaacattcctctgagtctatacgatcaaacagcacactgtttatcatgaatacagaatgtgggcaaactcatgactgtgcctgccccagaaggtttgctgagggcaattgcttcctgacgcctagctccttgaggttatctattgggacatccagagaatgcagtcttgctag

SEQ ID NO: 664985 - DNA, 157 bp, Homo sapiens
cgcgtagagcggtctgatagactgcatacacaggtcagcagatttcttaagtggaaatatagacagacctgggaggctttggtatataaagagttgagaaagtcatggcatttgggtcaggtcaacgaccctcttaccgagaacccgctcttacgcg

SEQ ID NO: 664986 - DNA, 419 bp, Homo sapiens
tggagaaagagcgtgggggacagaaacagggcaggcaggtgagtggcggaagatgagccggatggacatgtccctgacagtgcatgcagcaagctcaggcaatctagggaggcaggtcgatctgcaaatgagccatgcaaagacagcacagacaaaaggaatccactcttgaggagtatcacaaatctccaatgggagcagagttcagtggccgttctctggtcggtgggcaggaaatcagggaaggcttcatggatgaggaagccttattctccatagacagagtgcgagaataagtggcaatgtgtgagaagatgcttgcccaggaagtacctgtgtggttttctcagcgacttaacttttcactccagtgaatactcctaataagagctggcatggatgactcagtgctcatacca

SEQ ID NO: 664987 - DNA, 131 bp, Homo sapiens
gactttagaggatccctcgtccatcccccttcgtgtgtccatccgccttcgtgtgtccttccctcttcgagtgctcatagctcttcgtgtgggcatcacgctgccggcgggcaccacccttcagtggatga

SEQ ID NO: 664988 - DNA, 147 bp, Homo sapiens
tcagctcggtacccggcacgacaccttcacggtgctgaccgccgaccaggcgccaggcgtgttcgccagcaccgtcctgccgcagctggccttcgtcgacgcggcggtcggctacgatccgaacaacgtcacggtgtccttcacccg

SEQ ID NO: 664989 - DNA, 1436 bp, Homo sapiens
  misc_feature (737)..(737): n is a, c, g, or t
cggacgacactattgtgtgtggggccccgtggtgcccggtggtgggtacctgtgggagttctgcggcccccttctgccccgccggggtgttgttgccgccgggatgctatctcggcgccacgtgccctctggctccatatttaggcgcgccgcattaccaccgcgggtgtgccggcgcccgcccccggtggattgccgtgtgcccgccgcggcgggtcttgtgtgagcgccccccgctgtgtttgtgcgccccgggggaacccgaagagttgggggggaaagatattttttcccactgtgggcgccacacagggaggacgggtgggccttcctccggggaggttttctcccttggggggaagcacaccaaggtgttgttgtcccccccccccctttttcgggggacacgccgggttttgccccccgggatgtccccccgtatgtgggcccgacacactggtgtctttgagccgcggagagacccatctatgggtacaccccctcgcgggagaggtggacacccccccggcgagccccccgggaaaccttcgtgcgttggtgcccacgcggcggatctttctctggtgagccccacaagggcacccctccacgcccgggggatagcccccccacgcccttgtgggcgcccgcgagacggcgatcatgtatttgtttcccggcgcgcccccaatagtgggtgggctgccgaccccttcgcgctgttgttaccgctctcnctcgcggagagaccatctctctatttgtgtggacacacccccacagagatattctcgcgcacccccagtgacgtcaccttgtgccaccgctgggacacacatctcacacccacagcgcctcgcggcggtgagtggtgtggtgtgtggagaggacacgcaagtgtgtgggttttcacgctgtgtgtgtggaacttctgcgacccaccagatgggctcgggacttggaaataccgcccgccggaaccactctcgggtgtctccctctcttagactttatattgggttgttctccccagagagactgtcccccagcggaatttgtgttcttgcccggttccaaaagcccaacgtggacccaggacttatggaagaggttttggaataataatacttggcttaagactgcccagggcggagagccccttccccaacaccacattgttggagacaccagcccaggaagacccagggagaagcgccaagagagaccggccactggccagctcaccagagaaggcccaaggagcctctcgcccacgccaggccggcccacccagaacgccacgccacgccacgccacgcccacccgatttgtgtagcccaagtcttacccaccccccccagcacccccgacagactaggcttaggcccctctgccctcccttccttgtacctttatccattataaaatccacttcc

SEQ ID NO: 664990 - DNA, 922 bp, Homo sapiens
  misc_feature (283)..(283): n is a, c, g, or t
  misc_feature (326)..(326): n is a, c, g, or t
  misc_feature (349)..(349): n is a, c, g, or t
  misc_feature (452)..(452): n is a, c, g, or t
  misc_feature (560)..(560): n is a, c, g, or t
  misc_feature (575)..(575): n is a, c, g, or t
  misc_feature (676)..(676): n is a, c, g, or t
  misc_feature (714)..(716): n is a, c, g, or t
  misc_feature (720)..(720): n is a, c, g, or t
  misc_feature (728)..(728): n is a, c, g, or t
  misc_feature (737)..(738): n is a, c, g, or t
  misc_feature (750)..(751): n is a, c, g, or t
aacgaggcttccggtggcgcaaagggtgtcgggagcggcttcctgcaaaccttccctggcatctggagggaccaccgttgccgcgtcttcggcttccacgatctgcgttcgggctacgcggccacggcggcagccactgcgactcccactgtgcctggctctgtccatattagttcccaggcggccgtcgcctgttccagcagcggcagcggcagcggcagcggcggacatgttgtgaggcggctggcgctgggtgtctgaaggatggtttggccgaggcggngtgcaacggctgctggctgtgcggcgtgcagctggcagcttgnggcctctgggctctatagagccngagccctgctgggtaccctgccctggtacctgctggcgagtgccagtgcccctggatcttgccctctgctccgacgccgttgggggaccagttaggcgacagngcccgccctctgaggagaccacgaaggtggttcccccagaccgctcaaattttccggaaccaccgcgctttccccctcctcaggcctgggctgtgctctctctagaantcctcgggaccccanttttcttcccaaaactcatcctaaagtctctcacacacgcgagtgttcccagccctcaagccaggtgctcctccgttacatttttcatgcaccctcttcgnaaaagcaccccccgggatcactctccgagaggcgactnnngganaaaatctncggtggagnnaggggaccagannctggggacgtccaacaaaagccgggacagccgagaaaaaccaggaagggaactaaaggacatacatacatcatgggaaccgaatgaagatctccactatccgcaagagacggatatcaataacaagatcaaacgagagtcaccctaatggccgggcggccaaccaacgccg

SEQ ID NO: 664991 - DNA, 439 bp, Homo sapiens
aacggatctatgtcagtgatctcatgaagtagagtaagtagtttgcacatacatgtgcacgcaactagactttaaagatttttcatagaaattctcaaagtgcgtatcacctgttcagttagttaattcagattatactggggtaggttatttttttttttaaaagacgggggtttccatcatatggcccaggctcatctcaaactctttcctataaacatgaggcacgcgtgaatgcaggcgcacacacactcacacacctctcacatcagtaatcctcttataaatcccagtccaattctggaaacagtccccttgataacactgtagcctttttcctccaccatataatgagccatcacctctgaaaatttccagtgtatgagccacttctattgcgggaaaacacctatctccggttcagagtatccaggcgagc

SEQ ID NO: 664992 - DNA, 700 bp, Homo sapiens
cgcggtggctcacgtctgtaatcccagcactttgggaggccgaggcaggtggatcacgaggtcaggagattgagaccatctggctaacatggtgaaaccccgtctctactaaaaaatacgaaaaaaaattatccgggcgtggtggcgggcgcctgtagtcccagctactcgggaggctgaggcagaagaatggcgtgaacccaggaggcagagcttgcagtgagccgagatcgcgccactgcactccagcctgggtgacagagtgagactccgtctcaaaaaaaaaaaaaaaaatttagccaagagggggggtttgtacctgtagtcccagctactcagggaggctggggctggaggcttggggaaattcacttaagcccagggagtcccggggctgcaagagagtcatcattggccccatggccctctatccgggggtaacgcgtgtgatgtgagacctggtctcttaaaattagaacttcggggccaagcacgggggctttacgccgtgtaatcccagcacttagggaggccaggggggcccttcacgagggtcgggaaatcgagaccatccggggccaacttggtaaaacccgtctcttacttaaaatttttcaacaacaattttaccgtgggggttaggggccttgcctggaatccccagtactcgagaggtgaggcaggagaatccctgaacccg

SEQ ID NO: 664993 - DNA, 227 bp, Homo sapiens
  misc_feature (101)..(102): n is a, c, g, or t
gtcttgcagagaggagcgcctctctcgccagtgctcagcctcatgccaggcgtgatgcagttagggcgcagtgggcgcgatcggttcttgtctcctcaganntcgcgagcgcgttgggggagaccacagagcacgtattcctcttgcccctggattgcttgggtccgccggtccctgggggaggcgcttcagcgacacaagatgcgatcgtctgcaaggaacccacg

SEQ ID NO: 664994 - DNA, 738 bp, Homo sapiens
ggaatctctgaggcacgccgtgatgcccaggaagagaggacgaactggaggtccaactacttccttaagatcatccaactattggatgattatccgaataggttacatggtgggagcagtacgaggtgggctccaaggtgatgccgcagatccggatgtcccttcgcgtgaaggtctgtgggtgctgatggggcgaagatagcatcatgatgcgcaacgtcatccgaggggcacctgggaaagagcaacccgagctctggaagaaagctgctggcctcatatgcgggggaatgtggggcttggtgttcaccaaggaggacctcacgtgaggatcagggacgtgttgctggccatgttaggtgccagctgctggtgcgatgctggtgccagttgccgcagtgctgaaggtcactggtggccagtccaggaagcactggtctcgggacccgaggaagagctccgtattaaccaggctttaggataattcaccaatagaattcatccagggggcactcatttgaggagtcctgagtgatgtgctgcgtggtcgtgacgtgtgagacaaagttgggagccagcgaggccacgctgctgaacatgctgcaagatcttgcccttcttcttgggtctggtcatcgagcaggtgttcgaaatgggtgcatctacgggccctgaaggtgttgctatcacggaggaaattcctggatgcatcgtcttgctggagggtgtccgaagttg

SEQ ID NO: 664995 - DNA, 250 bp, Homo sapiens
tagtcatgtccgtcccaactgcttgctgtcgactgcaaataccttagggggggggggtgttgctttgagggaagttacgcttatttttatttttttattgtcttatggttttttttccctttgtcctggaaaaacggggttctcgttatattgcccaggcggttctcaaacccctgggctcaagctatcctcccgcctcttagcctccctgaaacctggaattacaggcgtgacccaccgcccccggcct

SEQ ID NO: 664996 - DNA, 180 bp, Homo sapiens
cgatcgagctcggtcctccattcatattatcttgcatgatgtcatttctcatcagaaattactacctttaaagcggtaggtttaattgataacttcttttcaatgtggatgtcagcttggattgtggcgtggatgtttgcatttccaagtgtattagtctgtgcaccgattgctcaaaag

SEQ ID NO: 664997 - DNA, 151 bp, Homo sapiens
aacattaggcttaatctaatattatctatatacagtaaaatttaccctttttagagtgtagttcagtgaatttgacaaacgcatcatgtttctaccaccacaattaagatgtaacacatttccattacctcccaaaactccctcgtcgacg

SEQ ID NO: 664998 - DNA, 877 bp, Homo sapiens
ggctatctgcaggctggccagcttcctctgcgctccggaaagtctgcggcccagcgcggactagtgatggacctccacagctcctggacattgcccaggagtccttgtcggcgttcttctcccagcctccgccgatgccggcggtgctgtggttttgaagggcgagcgccaatagagattggctgtgggctgtgtgtgctgggatggctcagggtgtctggcgcaacccgacgggcggaccttaccgtcaccgcctcctggcacatggattccttccaggtagatagcagacacggcagtcacccgaggctgttatcctaggaaccgtgctgcaggatggtatctaacaggagtctggattaacctcccatggatatcgactgcatttgcagtacaccagagggccctggtcatgggtgccccactggtttctgtggctgattgtggcccgtactgtggcccaagcatgtggaataagccattggctagggtgtgaaccactgtgataggccgacattgagatggggcagccatcagtcactggtagccaacagaccagaccgtgtagtcatgtgacttggaggaaatacgcaggtgattagcgtacccggaccatcgttaccttcactcttcgaggagaataccatctgatttagcagacggtgcagttggctggatccagggctcgattgtgaatattctagagagcctagtacaggattctaaatagtagcggactcgcgaacgcatgtcagaaactggatcgcagtggcatgacgaggtaaaggcggatggccagtgtcagtcccgggacccggcactccttcgagttgtcccccatggatgttggcaaagagcaagatcctaagaaatggcc

SEQ ID NO: 664999 - DNA, 325 bp, Homo sapiens
tcagagtcaatttgggaaaggccttcaaacatcactatggggggatgtgaactgttatatcctggttcaatacgtgcatcttttcaaatgttttcaatcataatcggatttccacaattacatccttcagtctttgggggggaaaatttataatggcttcccgcaattttataaatccttccgaaatcttcctaaccgctctaaagaggcgtgaaaaggaattgtatattaaaactagtctttttgtaagtcgggggacaggtagctatttccatggaataaagtggggcggttttggccaggccaataaatggagggaaaactc

SEQ ID NO: 665000 - DNA, 320 bp, Homo sapiens
ggatcacaggagggtagggaagaaacgtggatgccgtattgattgatttatttaattcattgatgaagacaaagtcatcgcgtcgtgtgcccaggcaggacgtactcagctcactgcaacctccgcctcccaggttcaagcgattctcgtgcctcaccctcccgatagctgggattacaggcgcacaccaccatgcctggctaatttttgtatttttagtagagacggggtttcaccatgttggccaggatggtctcgatctcctgacctcatgatccgcccacctcagcctcccgaagtgctgggattacaggcgtgag

SEQ ID NO: 665001 - DNA, 101 bp, Homo sapiens
gagaagacgacagaagggaggaggtgaactgtttccacattcaagattaaactgagtgaatcatcaaatatcaaaaaaaaaatatataaaagtcgtatcga

SEQ ID NO: 665002 - DNA, 415 bp, Homo sapiens
  misc_feature (38)..(38): n is a, c, g, or t
  misc_feature (49)..(49): n is a, c, g, or t
  misc_feature (138)..(138): n is a, c, g, or t
  misc_feature (179)..(179): n is a, c, g, or t
  misc_feature (224)..(224): n is a, c, g, or t
  misc_feature (288)..(288): n is a, c, g, or t
gagacaaattacgaccactggaaaccagccacccaagnaagatgaccgnagaacatctgcccatcaaggcccttaatgctacaggacaagcaaacctcaagctggaggcacttttccagtgaaagcaggccaggtgcnggttgtcacgcctgtaatcccaagccctttgggaggccaangcgggtggatcacttgaggtcaggagttcaagaccagcctggccnacatggtgaaacctcgtctctactaaaaatacaaaaatcaaccaggcatgacggtgcacgcctnttatcacagctacttgggaagcagcggctggagaattgcttgaacctgggaagtcgaggctgcaagtgagctgagatcaatccatggcagtctagcctgggcaacagagcgagactctgtttcaaaa

SEQ ID NO: 665003 - DNA, 686 bp, Homo sapiens
cagaggttatttgagagggatatgacctccaaagtttccacctgtccaactgagaagagtaagccatccgagtgctggctctctttgatggaatcgctacagggctcctggagctgaaggacttgggatacaggtggaccggtacattgcctcgaaggtgtgtgatgactccatcacggtgggcatggtgcggcaccaggggaaaatcatgtacctcgagcacttccgcagcgcacaaagaagcatatcctgaaatggggcccattcgatctggtgattgaggggcagtccctgaaatgacctctccatcgtcaaacctactcgcaaggctctctacaaaggcccttgccggctcttccaagagttctaccgcctcctgcatgatgcgcgtcccaaggagggagatgatcgccccttattctgactcattgaaaatgtggtgaccatgggcttaagtgaccatgaggtacatcttcgcgattctcgagtccaaacctgtaatgattgatgccaaagaagtatcaagcttcaacagggcccgctacttatggggaaacttaccgtatgaaaaggcgttgattccactgtaatttacgtgaagctcaaatgctaaggctgaaggatacaattcccaaagtagacattctacaggtaattcacgaaggtacggtcattgatctgacgga

SEQ ID NO: 665004 - DNA, 230 bp, Homo sapiens
tgcagaggcgttagtttgtttttgatctcagataggtaatacagaattcactaggcaggctatgcttgtattgctttgaatggggacctttgttaacgcaggcccatgaagaactcaaagattataatctctgtatctaatccattggagtaattattccaattccaaccagccgtattgtttggcccgggtaacaataccttaaaatattgaaaaattcttgaattcct

SEQ ID NO: 665005 - DNA, 172 bp, Homo sapiens
aggacacctgccttggtcctcgggatgatatatagcaagacataagcgtacaggtgtgaccagtcttcatcctgatgcccaagcgcggaagaatgcacaagaagaaagtatcaaagaaatacttgcaaaaagtaaaatagttgaagaaatgctgaaaatgaaagcagaccta

SEQ ID NO: 665006 - DNA, 703 bp, Homo sapiens
  misc_feature (352)..(352): n is a, c, g, or t
ccggatgcttgaggataaccgtgcgctggcacacgcatgattcatgccgcattctggttttcaacaaccagtgggatcgccacggctacctccgcgtatcctacccagacgttttcccataataatacttcaacatgctagcattggttcgaaacactttcctatctagctcctcaagcggtgatgacaactatctgtaatctctcttggagggtggaagtttgattggtggctctgactaccaatcatgactcttaccggcacctagtgcgtacccctcgtactattgatacttctatgctgctggaattcctctaggatgacgctgaatcttgcgaagtcttgtgatccntcattccaggttcatctcgatggaaaactctggattaagatgcttgtgcgacaaatagtgtgctggtgacactttggaagtgttggactcgtatcgcatgactcggattcaatgggtgccccattacgactccctctcgatggcaagggcagcgtggatggcagtgccgataagctagcttgggtactaccagagcccccggaagctagaaaccttcgctgttttcacaatgtcgtagggctgttatacaacacagtttggaatcatcccagggggggcatccgatttgatacatccttgcactcgtagtgtcgcagcttgaatcccagcactgtggaacacacaatttgg

SEQ ID NO: 665007 - DNA, 1470 bp, Homo sapiens
  misc_feature (7)..(7): n is a, c, g, or t
  misc_feature (145)..(145): n is a, c, g, or t
  misc_feature (1034)..(1034): n is a, c, g, or t
  misc_feature (1167)..(1167): n is a, c, g, or t
  misc_feature (1199)..(1199): n is a, c, g, or t
ccacccncccttctgcgtcgctctctttttcttgcttatgtttctgttttttggttcgtgtgttctcgattgtttcgtcgccacccacgcctaccgcgtgcagctcgcagcgtcggctggagtaggacgggaccaggagagaganttggtgagggtagagggcgctgtcgctgtgacctggttgtgcgtatctgtttcttctctattcggagggtcgatcgccttagttgtttcttacgcagatcgagtgagttgtttgcgtgtctgagggtgtctcttgtgtgtgctctgcagtgccgttgttcctctctggttgtgcgtaacgattgtatttctgcgccgcgctggggtaactacctatctttttttggcggggtcgcgtctcctccatcctcgtatttcgctacgggacaattcgttgtttgaccacgtgggttctgcccctgctctctcctcgtgggagtatagagttttctctgtctgggttgataaagtgcgccggagaatccccgcacctgtgtgggctgcctcccccacgaatgtgggtgggcgcctccccccactgtggtctgtgttgtgccgcagtccttttggcgtgccgccaatatgttatctgcacggtgtgttttccccccccgcgggggatatttgtggccgtcgtgagtgcgtggcctctcaccggcgcctcgttttggtgtaagatcatcaagtaattgtggtgtgttggcccccgcggtctggctatgtggcgagcttttttgccttctctactgcgtagagacaaacgaatgtgtatgggaagtgggccccacatgctcctcgcttggactcctgatggccaggatatatattagcgtcttggtatattgtgtgcgcccgccccaaaatgctgtgtctggtctggagagacaactcaagcggtagcaatggtggtcgcacacacaagctccggctccctctctgtagcgcgtcgcgcttcgtttgttcatggtggtcgtgtgaaagacaccatgtcgcgcgctgagttgaagganatttcacatgtatagcagacgaagcaaaaaggatttgatagagatctgggcgtagtctccctcccacgggcagtagttcgtaagcgtattttgtctaaaagagggtccctacgtatagatgagcgcacagagnaatcactcggtctgtaactaacgctcacctcntagttgcctcgcgcacgcgtacgaaagtgaccactagtgtgcgcgccgcccccgccttgtgcgttttcatagagaatgttatatccctccggtgcaatacacattgcgagcctcaatcgccttattgttcctccgcggcgagtccctcttcatggtgtgatcttcgacccggggatgtctctccaccacgagccacacattgtctacttgcagctacacgattttcacccaataatcaattgtgtgcgacacacaaacaatggacagaaca

SEQ ID NO: 665008 - DNA, 329 bp, Homo sapiens
ccgcagctcggtctttatttttttggcagaacttgatgagctcattttaaaattcatacagaaatgccagggactacgaaacaacctatagaatcttagaaaaataataaacaaaattggagaactcacatttctcattttcaaaagcgtactgtgaagctcctgttatcaagactgtgttgtaccactcacaagacggacatattgatcaatgaactagaattgacaatacagaacttaattcatacgtctgtggccactgattttccacaggattgccaggccccagtctgcgggggtcccgatgctcggaaattcgtaatcatagt

SEQ ID NO: 665009 - DNA, 313 bp, Homo sapiens
gggcattttctttttagtttttcattaaaaaaaattccatatctccccctataaaatcaaataaagggattattttttccacccctcttaaccttttttggggaggacaatttttgtttttccggaaattcccataaaatccagaagcaagattccgtaagttgagaactttggccagttgatcagctttccctagggggctttgcctttaactaaagggggggagggtagattatttcaaaaatgtatgtaaaactgtttcctgaccaataaaaggtatgaacggggcagaaataaaaactttttttaatta

SEQ ID NO: 665010 - DNA, 172 bp, Homo sapiens
atatcacagcaccaaatttccatctccatcattaccttcatcccatataggcataattagaacattgacttcctctctttcttcttcccactcatcctatccctactcctaatcacattacctattcccccggaacatctcagtacacagattaaggtctacctggcgggat

SEQ ID NO: 665011 - DNA, 514 bp, Homo sapiens
cagggcacaagcactgagtcagcctgggttcaatgcccgttccataactcacggctgtgtgaccttggcgctctgactcagaatgtccaagctttgatttttttaattgaaaactgatggaaaatccacataaaaggtttagcacatggtaaacaatgcacaaaaattattcatgagattgctcaaatgttacaacactgagttcctgaaaacagcagtttgtatcagaaaacataccaaatagtatttttaaaggtttgtattatctctacttgtaaagaaagacactgatttcatttttccttagtactttattttatgtaaaagaattctagcattgtacaggcatgtagattaatgagccaattgtgtatacttttgtgaattgaatagttagtataaaaaaaatttatgttactctttgaatagtgaaatttcacttcactattaaatccaagaaacatttttaaaaaacgtttgtcaataataaaatatttatggtcaaaaaaaaaaa

SEQ ID NO: 665012 - DNA, 119 bp, Homo sapiens
tgcagacagctgatctctgggtcccagtcagttacatggaaggctgatctattttggagctgttgggggagggctcagcaagacaggagctgaggcagaatcacagagagatggccctt

SEQ ID NO: 665013 - DNA, 452 bp, Homo sapiens
tcatcaccatgagaatgaactgtcctggcaaccacgtcccagacaaataacaacatgccctaaaaaccccaaacacagtgtgcagcttaatcagctcacccgctcacagggtatctggtaccttaactcctgccgggtctgagtattgtaaatactcaaagtaattgttgaatcagttcggttgacctgggagtatattctgggggaagcgcttaaagatgccaggtggctacctgaatttctgagtactgtaatgatcccagcatttctcaattgtgtgaaacaacattcatgagtttgaaaccaatgagtcaggtacttactgtagcaggagtggcagactggccaagcaggacccctaccctgttctcttttccagtgcaaaagggccattctcttctgtttgccctagttgttctctaaaatgttataaatgtggacacttctatttt

SEQ ID NO: 665014 - DNA, 124 bp, Homo sapiens
tcggtaccatctcctttcttcatcaccaaagtagctttgccacaggtactacttctggaatacttcactgaagttcttagatacctgtttgaaagttaactgaatagcttcatatttcctgaag

SEQ ID NO: 665015 - DNA, 290 bp, Homo sapiens
tttttttttggggtagaaaggattatgaggtacaaattttttattgggatcatacttaaaaagacagagcagaatcacattcattttcttaatagtatcacggtaaacatagcgaattggggcgctttaagatggctcggaaaatttctgaagagtggaccatagcagccgggtaagccttttcctttcccccaaagctctccggcccttggcagaaagacggtgggtgacaacggatgctaactaaatagcatggggtggagctggccaaatccttccacctcctccca

SEQ ID NO: 665016 - DNA, 875 bp, Homo sapiens
gggcaggaaatgcatgttcatctggaataaactggattttcaatgtcctggtttcactaacatttttacacacagcagagtatcttacatactatggagctttcttcctctatgctggatttgctgctgtgggactccttttcatctatggctgtcttcctgagaccaaaggcaaaaaattagaggaattgaatcactctttgacaacaggctatgtacatgtggcacttcagattctgatgaagggagatatattgaatatattcgggtaaagggaagtaactatcatctttctgacaatgatgcttctgatgtggaataattttcagctgctcatatatttagttatttaaacaaactggggggagaagaacagcaattggtgacttcactgccctgcttctaatctggttctttccacagcctagttttgattgacttcatattctagaatacttgattaggaggaagatacaaccatgatgactttttttttccacaaggaacaatattttaaaaaatatttacagagattttaatctaataattcttaagcaaatgtgtgtaatgccttcctgaaatagtctaaaatgaatattgtacccagtggcttcagtggtatccttttttcctaagaccatttataattattagtggcaacagagtcagtgctaatctagccaaattacatatgtataatatatttataaaggattctgggagatggtccaagggtgttctgtgtcaaaagaaggcctattggccctcagtttttctacagagtagtggcttatctctgatcagctggtacaaactaaattccatgtaagctttcatcaacaaattccaaagtgcctcctacaagggcacagctg

SEQ ID NO: 665017 - DNA, 349 bp, Homo sapiens
cgcagaagtccaatgccgggcgtggtggtacgcgcctgtaatccaagctattggagaggctgagccaagagcatcccttgaccccaggaagcgaaggtgccagtaacccaattttgcaccagtgcactccagcctggtaacaagagcaatattccttctcaaaaaaaaaaaaaaaaaaagtccacttgaagaagataatcaaagaattacgcagaagaccactgctcaatagaaatcacataaggtaagtcaggctctgtggctcacgcctgtaatcacaactctttgggagaccgagacaggcggcttgcttgagctcaggagtacagccgtggcaacatggcaaacc

SEQ ID NO: 665018 - DNA, 1311 bp, Homo sapiens
ttcttctttgttcttccttgtctgttcttttcttcttttcttgttcttctactttcgtttcggtcttgtcctcttcaccttgtctccttgcccccttttctttttttctgtttcttttctttcttttgcttgcttttttctttcacgcctgtttgttcttcttcctcgcccttacgataaactactctcctcctgtcctcccgtctccgttctggtcctgtgtgttcttttcctcttttttcttgttgctattgtctcttggtgtttttggtgtttatcgcttatgtgttcatttgtttgttgcatgtctgttttggttcttgtctcttgccgggttgctgctttagttctttgtctgtgtattgttgtttggcactatattgtctctttgtaggtggcctttatatggtgtccttcttccgtttttctatggcttgactttgttttattgcttgttctgttttttgccttgattatgggtatgtttgttgcagattctcgttgttctgttattgtttgtttggtgtgttttgctctactatgttcgtctttctatgagtgttttccggtcctcttgtttctacctttccagttgtcgttgtatttgttgttccgcctgtttctcttcgatcttatgcgtcttgacagcgtactttcctaatgcggtaactagttggtcttgggtacgcttgtcttgaatgtatatgttttcatgtgcttgctggtttatatctattctctagtgccgttgttactgtgctttccggattaggtctgagtccatgtcacatctcttgttcatgtgcattgaattgcgcagcatgatttttatggataactgtatgtgtcgtcgtttttctttctcagtactagactatcactgtattgtgtcttttgcactgatgatccggatttaatgtgatatcacagtctaatttttattcataagccgagatgttttgctggcactgagcagagtcttgctacctcagtcagtattgttttggtcttgcctaccttcccgtcgaccgactttggcctactcgtgtcagccgccaccccagccccacctcgtccccacgcttacccgccgccccgacttggcttgcttcgttgtaggagttgtgagtggttcggttctgtttacatcagttttaagcgagaggtatgcctgtactcgcttgtgcagaaaacacttgttccagacttcaatcgactgggtttatgtcccttcacatagttattaaggttagtttactttaaatgtcataatgtattttattgtaacagacattgtattgccacattgcc

SEQ ID NO: 665019 - DNA, 401 bp, Homo sapiens
cagcttccgagcaacgccttcgtgagcacggctaagtggcagctcctctttggcctcaagtgctcaacatgatggccgaggagaagctggttgatgcctggattgcagcaccgagaaagcagaagaaggcctggagaagttgctcccgtgctcctcttgagggctgcctgagctggtgtgcaccctcccctgtgtgccggaagactgggaattcctgctaagtgtggcttctagagtgtttgtgttgtacccggttctgacttgctatggcgagtgcgcatcctgtcatcatctccactgtcccaagcagtcactatgtggcggccgggccagctggaacccagaccatcctctcaggcagagcagggtggtccgggcacactgggcctgcctctccagcc

SEQ ID NO: 665020 - DNA, 194 bp, Homo sapiens
ttagcaggcataggtcggtctagtcttctattagctcttagtagattacacatgcaagcatccccgttccagttgagttcaccctcttaaatcaccacgaatcaaaagggacaagcttcaggcacggcagcattgcagctcataaaggcttagccttagccacaacccccaaggggagaccagcagttgattag

SEQ ID NO: 665021 - DNA, 523 bp, Homo sapiens
ccatgttgggcatcactgtaacttctgcctctcagcctcaagcaatcctcccatctcagcttcccgagtagctgggactacaggcatgagccaccacacctggtcccctttttttttgagatggggtctcactgtcgcccaggctgagtgtagtggtatgatatcttaatccaccttcttaatccgactcacggcaacctccgcctccggggttcaagcaatcctcctgcctcagccttccaagtacctgagattacaagtgcacaccaccatgcccagctaatttttgtatttttagtagagataggctttcatcttgttggccaggctggtcttgaactcccggcctcaagtgatcctccctcttcagcctcctaaagtgctgggattacagtcatgagccaccgcactcagcaaaagctccttccttttatggctaagtagtatttccctgtaggtctagatctcaatttgatggacatatgggttgtttccagtttttggcaattatgaatcaagctac

SEQ ID NO: 665022 - DNA, 113 bp, Homo sapiens
tctctccacactggcatgacctatctaggttctctccacactggcattcccagtgccttctaagccaggcttagagaatgggcaaggctgctgcagagcaaaagtgttagata

SEQ ID NO: 665023 - DNA, 114 bp, Homo sapiens
ataatatcctgcagagtgttttccaacttggttccattctccctgtcactatcaggcattccgtgccttctttccactccgactctgtttggctttactgactggttcttcatc

SEQ ID NO: 665024 - DNA, 258 bp, Homo sapiens
atcccccgggtaccagcagctggtgagctgtcccatccttccccagagcctttcttaatcgtgcaactatctcagtattctttctaaggcttcgtagaatctttcgtcatcttttacttcgctgttataatgaacatcattttacatgcagcaaactgttaccacatcatcaggtgttttccagtacactaaataccctctcattcactcattcttacagtctactagatatttcctactagattgcttgttccgctg

SEQ ID NO: 665025 - DNA, 1000 bp, Homo sapiens
  misc_feature (312)..(312): n is a, c, g, or t
gggcccggcgtcaggtcccagaccggggctagagacctgagggccggggtccgggcccggcggcgggactccaggcggttgatgcgctgctcaggagtcagccatgacctgaaacgagcagggactggatccttgatgatggttagacagtagttctgtagattgcagcgcgtgcacagcgtgtgccattcccaatgtcctggcgatttgatgcggttcgatattccttcgttgtgtgcccttcagtcacttgagtaacgagatctacttagttggtaactgcgcgcgagagacactttgcggcagtgcaanggtccagtctactgctgcagctcatgataggacgtatcgacgttcctgttgagttccctttccgaggtgcgaggtccttcgggcatcaaaagccttcccatcactcagtgctctcagctggagttcctcttgaccatcacaggactattgttggactcaggatgtcggtcagaagttcgcattaccaaactgagaccttgcaacgtatggtccttgcagttggacacttgcccatggatcatggaggagcaacgcacccggcatcctgtcccttgcgattgaccctggtccgatagccattggtgccaagttaacgacggaatacagccaggttttgtacgacatgccgtgacaggctgaagcaaaaaagaccgtttcccaccatgagtaaggcaccctccattggcgtgtcccaaggtaggcttggaggtggtattgcttgcttaactagcccatcgagatgtcgtccaggccatgttgtactcgataggtgtacttagctgggccatgccacgtacttcagacttgagcaagtacaacttctgctacaaacggggtcaacaagacacgtgtcagggcgctacttgcgcgcctgtcggacgacaggatttcccttgaattccccgttgtaccccgagaaaggagattgagtgaacattgcgttcaggctcatgagtactaatgttcc

SEQ ID NO: 665026 - DNA, 134 bp, Homo sapiens
ggggccccgacaaccacccattttttttaaaagtggggtgggggggggaccggggcagccgcacgcgggagggaggggggggcccccggggggggcggagggggggcgcccaaagcgggggggggggggggggc

SEQ ID NO: 665027 - DNA, 93 bp, Homo sapiens
gatgctgcggtcgttctagaggatcccggcaccacttgtgctgtgctcaggagactctgattttactattgagaaaaataaaggcgtcaatct

SEQ ID NO: 665028 - DNA, 181 bp, Homo sapiens
actttccctctgtctctgtatgggggagcttcttccttctttcttgcctattaaactttctgctcctgtaatcacagcactttgggaggcccaggagggaggatggcttgatgccaggagtttgagaccagcctggccatcataagaagacttcatttcatataaaataaagtgaatgagt

SEQ ID NO: 665029 - DNA, 386 bp, Homo sapiens
gctgaccctactctcagtgcctggggctctatggagcttccctcttgtgctggaaacctctttgccatctgggaaatgcctctgccacatctggtaagtgccatagccttgagtgaagtgattggtttatgtatatttctttttcttctctcaggatacatcattcactcttgggggacgtgaagaagctcatcactgatgagtttgtgaagcagaagtacctggactatgccagagtccccaatagcaatccccctggaatatgagttcttctggggcctgcgctcttactatgagaccagcaagatgaaagtcctcaagttggcctgcagggtaccacagaaggatcccaaggaatgggcagctcagtacagagagggtccagg

SEQ ID NO: 665030 - DNA, 175 bp, Homo sapiens
  misc_feature (7)..(7): n is a, c, g, or t
tatcgantgccacccagccatcaaaggatgtaaaaggagtaggagagtagttaataactctattctgttacatgccttgattggctggtgggcaatggggaggaagggattggaagaactaacgcaagagctaaattactccaaactacaacagggaaagtggcatcgactaaac

SEQ ID NO: 665031 - DNA, 199 bp, Homo sapiens
agtattaggcgatgagtagggagggctactaggtgtaatagagtattgctgcgtcagcgtctgctgttgctcatcggtgatgatagcagtgggatagtgtgttcgaagagatataaaatatgatagttctgtgctgtgactgtataattaaggagatctgaggggagatagtatagagaggtagagttttttcgtgata

SEQ ID NO: 665032 - DNA, 150 bp, Homo sapiens
tggtggtgtgcgtctgtagtccctgctattcaggaggccagggtaggaaaatcacttgagcccaggaattcaagcctgcagtgagccatgatcacatcaccacacttcagcctcgtgaacagagttgcgacttggcagcaaaaaaaaaaa

SEQ ID NO: 665033 - DNA, 881 bp, Homo sapiens
  misc_feature (224)..(224): n is a, c, g, or t
  misc_feature (293)..(293): n is a, c, g, or t
  misc_feature (305)..(305): n is a, c, g, or t
  misc_feature (325)..(325): n is a, c, g, or t
  misc_feature (580)..(580): n is a, c, g, or t
  misc_feature (586)..(586): n is a, c, g, or t
gagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaanaaaagtcatccatccatatagtagaaaagcagctcaaattacgagagaggcccacaaacaagaaaaaanggaccacatcgncagaatgaaaaggccttgcngtctcaaccttgttggtgaaaaactgcaatggtttcaaaatcatcttgatccccaaaaaaagagatattcaaagaaagatgctttgtgaactaattgaaagagattccagacattctaaatgcagtaatctgaaaacatttagggaatgggactttgatctgaagaaattaccaaacattaatatgacgaaaaatttgcgctaatgatgcaattcccaagacgtgcaagaggaaaactattatactgtagaccanagattntgggggcaatgtggacctaaacggatgatcagtgatcagatgaggaaatgaatgcagggctaatagtcttcacttggattggaaataataattgggagtcaatatttttcttgattatggtcctaattgtctgcacacaaattgggacggattctttattgagagagtcttgggttaaaatgggtttgtacttttaaagggaaggtcattcctcatgtgaagtaattgtgggagtggtgtcatgaaagggggggacaagaaaaagggtgtgttgaccacatggtggacacacagg

SEQ ID NO: 665034 - DNA, 1451 bp, Homo sapiens
ggtgtgctttatcgggcgtgacattacatttcaccgcgcgggccttcgcagcgtgcgctttctggtgccccctttctgcttccagcctcatagaccaggtgcatggaccccttagctctatcgtactcatgactctgtgacccttccgcgcgaagagaggaagccaagtaaggagcgacctattcagaccttggaaattctaaaagaatcatgtacctagagtgtcagtaattgattcagggactgtggcgcatagcgtcgttctccctagcagataagtggccgtcggctgcgcagcctgtgacggagggcactcttgtacccgatacgatgacttgtctgtacgagacctacatagtaaacctgcgtctccacgtaggagtactacgctcgctggcctataaagccctgcagtcgtacgaattctgtaccctatccgtaacagacacgcgggcagaccgactggcccctgcgactgggcttggcccacgacagttgggcacacactacaaaaccccttctctgtccctatccataataccaagtaactacaactactctaatcaccccacagcacaactacaataaaaccaccgaccaccatattactgcaatccatacatccaatatcaaccacctacatcctcaaacatccttgtcaaacgctcccattcaacaaccaatcatctcacctcacactctggcaaccaacatgcatcccctcaaactcaccccctctgcagccgacaccctccaaacatatcaccaactcattccccgctacgacactattgcccttgccatcccaatcgaaccgccgcccctttctccccgctcactgtagtccgcactccactcccacaacaccttcataattccaaaacacccccccacaccttcacatccgccactcccacccacatgacccctacacactctcacccatttctaatcacaaccactcccattcccattccaccacaccaacctccaaacacaccccttcctactgcacagcctcatcacactcccacctggtccaccacacacaacccacaattcgtactcccatcacccaacccaccctcaccacacacacccacacgaccacacgcacactggccaaccaatcccataggcatcgaaccaagcagccatcccacaaccacggccacccaacacgagtcatcacacacaccaccagacccagcaaaccagttctccaccagtcacgaccagacctgccaccacactgcaaccgccagcacacgcatggtcaatccaatccacacagacagcctccgagctccaaccctcagtccggccgtgacatctcccttctaacgatgtgacgtccaccactacatatatcacagtcacaccaccaacgacacaaacaaaccagagcagcacgaccaagccaggtcgcaacatctacgcagtcgatcaca

SEQ ID NO: 665035 - DNA, 207 bp, Homo sapiens
gtcctgttggtttttttgggttttttgtaactggggggcaaaagcaatttccctacccggggcattccttttttcatgttgggaaaagtttttcccttttttttttaaggggtgggggttgggggggtcagcatgattattttttaatgtaaaaaatgtgacttttggatataaaatgaaaataaatgtttaattaaagggccctta

SEQ ID NO: 665036 - DNA, 1044 bp, Homo sapiens
  misc_feature (224)..(224): n is a, c, g, or t
  misc_feature (293)..(293): n is a, c, g, or t
  misc_feature (305)..(305): n is a, c, g, or t
  misc_feature (325)..(325): n is a, c, g, or t
  misc_feature (743)..(743): n is a, c, g, or t
  misc_feature (749)..(749): n is a, c, g, or t
gagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaanaaaagtcatccatccatatagtagaaaagcagctcaaattacgagagaggcccacaaacaagaaaaaanggaccacatcgncagaatgaaaaggccttgcngtctcaaccttgttggtgaaaaactgcaatggtttcaaaatcatcttgatccccaaaaaaagagatattcaaagaaagatgctttgtgaactaattgaaaggtacttaaactcgattcatgcagtgatgctggatgcaggattgagttacttaagcagtatcagggacatggcagtgggagtgcgggcactgttcccgggagaccgtcatcaagcagacgatgtgagcgggagcggacagcatgtttgacgggatatggccttgagattccagacattctaaatgcagtaatctgaaaacatttagggaatgggactttgatctgaagaaattaccaaacattaatatgacgaaaaatttgcgctaatgatgcaattcccaagacgtgcaagaggaaaactattatactgtagaccanagattntgggggcaatgtggacctaaacggatgatcagtgatcagatgaggaaatgaatgcagggctaatagtcttcacttggattggaaataataattgggagtcaatatttttcttgattatggtcctaattgtctgcacacaaattgggacggattctttattgagagagtcttgggttaaaatgggtttgtacttttaaagggaaggtcattcctcatgtgaagtaattgtgggagtggtgtcatgaaagggggggacaagaaaaagggtgtgttgaccacatggtggacacacagg

SEQ ID NO: 665037 - DNA, 845 bp, Homo sapiens
  misc_feature (200)..(200): n is a, c, g, or t
  misc_feature (215)..(215): n is a, c, g, or t
  misc_feature (403)..(403): n is a, c, g, or t
tggttccggaaagcgctgacaaattagaatgtggatcggttggaagaactgaagaatgcaaaacatgaagagagtgattgaggcaaatcggagtggagctggtacagtactgtgaccagtgcttctatagccagggagcagaaacgatctttgggcccttgtctgtgctgaggactatgcagtaaagatctgcctctaangcagtccgactgtantgcgtgcagattgtgcggttaataaaatacttacttatgaaatgttcactagaggaggaagctcgttgtgaagagtgtccaggaaggttggtgagaggataatccgtgagagcgtcttgatcgtatcaggaaggtgtgtcgtaagagtaacaatgcattcatgaggcgcgaatgtccgcatgttacgnatcaccacgagcggagagaacactcctgttcttaacatagcataagcagattagacaaaccgtaggctcgataagcggtcccaggatagatatggcttgcgcccaaagcgttggtagacgtagaggacgattcgcacaggggcgacagaaatttgtagactttgggtcgcgggaaaacaagcgcaacaattgcgataaaagggctattgttactgtgtgaaatgggcatgaaatttcactagggatgtagtggttggcaggaaacaactagggaagagtagcatcgagttgcgagaaagagagtagtccaaagcaggaaagacgagtgaacgaacaacagaatggactgacgacagagatgctgtatggcatcgctccgtcgaacatcgtaacaagcgggtgagactggtgtcccattacaccgggcaaagctcgtatgctg

SEQ ID NO: 665038 - DNA, 234 bp, Homo sapiens
attcatcggggacctcgctattcatcggctacctcgctattcatcggcacctcgcctattcatcggcacctcgctatgcatcggcgcctcgctattcacccgtgtctgttcactgaccaagagtccacaatttgtcaaggattgaaaagtggggcagaagctctggcttcctctttaagtggtaatgcttcataccaacttatcccaaagtaacctgggtagtatttgtcgaag

SEQ ID NO: 665039 - DNA, 334 bp, Homo sapiens
  misc_feature (18)..(18): n is a, c, g, or t
  misc_feature (25)..(25): n is a, c, g, or t
  misc_feature (54)..(54): n is a, c, g, or t
  misc_feature (75)..(75): n is a, c, g, or t
aatcaacaacagaaattnatttctnacaattctggaggctgggaagtccaagancaaggtgcttacagatttgtnttctggtgaggacccacttcctggttcgtggatgtttgtcttctccctttcacatggcagaaggggtgatggagctctctgggtctctttatataagggcactaatcccattcatgagcgctgttactctcctgacctatcacttaccaaaagccccacctccaaataccatcacattggaaatgaggatttcaacattaggaattctgggggcacacaaaccattcagtctactgcagacattaaatagggatctagg

SEQ ID NO: 665040 - DNA, 777 bp, Homo sapiens
  misc_feature (130)..(130): n is a, c, g, or t
tggaacacaataccatttatttttgatacacaagacaaacatatttgaaaggtacatccagaagtgttcaacatggaaatttccttacccttctgtggtgtcatggcttaatgtgtgtcttcccagaacntttgaaatgttggcatacctgggtggatgtaccttctcaacatatggttgggtctgggtgtactcactatattaaatggtcattggtgcttcaaaaaacacaacaaacaaacacagagcaaaccaagccagcagcaccacaacaaacaaagaggcgggcgcgcccgaagacaatatccccccaggaggaagccccacacaacacgcacccccaccccccgagacgttgctaggcaaacaacagaggaccaccccatcagatgtggcaccctcctaacaacgacaacaccagacacaggagccactgcactaaaacaagcccctcgacagcgcgcaaaacagcgaaacgaggcagacacaaatcggagaagaacaacccaaaaaagggcggaggcaaacaccacagggcaaccaaaacaccgatgcgaagatatacacaacgctcaaaacgcgacaactaatacacgatatacaaggccataaaaccacgcgtcgtacacaacagcgcgagtatgactgcacccaggcgcaacgaagaagtagatgcagcgagagaaaatagactcacccaagaacagcagcaccctcccaccgccgccgctccctagaaaacacacgccgtcccccctcccaccccccactaccccg

SEQ ID NO: 665041 - DNA, 162 bp, Homo sapiens
gagtgtcccccaaaattcagaataataacacacccgagcgccatgagtgtcgcccggccatgatactggggtactgggacatccgcgggctggcccacgccatccgcctgctcctggaatacacagactcaagctatgaggaaaagaagtacacgatgggag

SEQ ID NO: 665042 - DNA, 897 bp, Homo sapiens
  misc_feature (190)..(190): n is a, c, g, or t
  misc_feature (715)..(715): n is a, c, g, or t
ggcagatcgggagtcccgagggtctgtctcttgacttcaatcagtgtttggacggaacagatcgtggggactctcttccgatgccttccgagcgcaccctcacgaatttctctcatcaggcattgtcgagatgcgtccggagacctagtccttactcgagcacaatcttttcatgcttctggtgatctgnactagcaccgtcttggtgtggctattagctccattactgtgctagaagcgagacacatgaggctccgctagaattcagtcgagatattatgtccaccggaacgtggaggtgaggcgtcgttacagaccttggtcgaattagtactctcgcaaggtctccgtacacctaccgtactctcgtggtggtttctattctcagaggcagcagatggattgttggctcatagggagaggcagtggagccgacctgtctgtgcacgggaattgtggtcctgacgtgaggaaagcgcgaagggtctacgatgccgtcatcctgattaagattgcaaaataccaagctgtgggggagccagcgacctcatccatttcactagtgtaccaattctagacgaaaagacgccaagcctggaaagacttgtagatggggagttaacaaacccgctcgaggaactggccatttgaaaacggtctggggctattggtccattgggatgaatagaattgctgaaaccgagggcgcctttanggagtcttgaatcgtccccctgggtgattctttgccactgggaatgggatcctcaccaattgctttgctgtggaactttaccctagtgaaggacgttccacagtttcctgaaggaattaaatggataagttgaaaaagcttttatccagacgaaagcattggggtggggaccaacccattga

SEQ ID NO: 665043 - DNA, 1064 bp, Homo sapiens
  misc_feature (329)..(329): n is a, c, g, or t
  misc_feature (441)..(441): n is a, c, g, or t
gggagcgacggagatctcgccgggttcacgttcacgctcgtgtggtgtgcgagcacgccttccggttcctcatccgtaggcgaggagacctcgagttggctagaaagttcagcgatgatcatatgtctcaacggatccatgcgctaagggaaggatcgttgtgacctcatcgtcggggaatcccgacgtgtatgaggtttgatctgcttcaccatcaaaaggtctcgtatcactagtctgcctggtgccccagttcgggtgacttcatacctggtgtatgctactgagcgaccgctagaagtctgccgggtagcaactggagtaagaanctcgcctagtactggggcaagggctgtactcaacagggcgtgtagtagcaacattcactgtatacaactattcgcagcctagcaccatcggggtggagctacacgcacacanctgaaacagtctacggagatacccaatgacgaaagcattggtacgaaaactggatatggatcgagcataaggcatcgtggacaggacacacattagaatctaaaacgtttgggggttgcgggaagcgtcgccactttgctagggggcgttgtccactttgacgcgtcatggacaataggcatggtggcccgtttgacgaacggcgggtcgcccctgttaccggacagcattcgcgtgacttgtggggtggggacaaactacttgaagtccatcctggccagtcccgggcggtccaagtggtccatcaataggcggtgctcaatgctgggcgaacaagctggccatggcaggagttccatgatcctgccagtcgggtgcaggccaacttcagggaagccatgcgcttgggagcagaggtttaccagaagcctgaagaaatgtccttccacgaggacactatggcgaaagatggcagccaaatgggggggcatgaagcgggttttgggtacacaaattccggagacttaagaaggccgggagtgctgagctgctagggaaagcccggccaccggataggggcacggctggactaggccccaactacagtgggacttacggctagg

SEQ ID NO: 665044 - DNA, 270 bp, Homo sapiens
gagatccgaagccacgatggtatccaggtaaggtacagtgaggcatctcccaggcggtcagtgtgcacgtagtgtcgcttctgaacataagagcaggtcctcgagtgcggtcgtgcagtgacagtcgggggtgcagcatgagggagatggggtaggtcgagttgcgggagatggggtaggtggagttgacgggaactgagcagggcacagtcacatcctgtctgggattcgtgtagtgcttcacgtggcatgtcacggacttgcggtcta

SEQ ID NO: 665045 - DNA, 302 bp, Homo sapiens
gactatcggagctgacgttgccagatattatccgttcaccgcgattcaggcgcctgaccgacatagtgccaccgatggacggggatattgtgctggtatcgcctgctccatcgcatttgcacctagatgatcgcagcaatgggcgactttgtgcatgcccatacagggttacgccgcgtagtgcatggccctgcatttcccgactggcaaattctcgatcgctaggcgtagtagtgagaggttggagtggcgacactggttttgaccgcgtagggcaccggcgaattggcgagcccgtcggc

SEQ ID NO: 665046 - DNA, 1609 bp, Homo sapiens
  misc_feature (423)..(423): n is a, c, g, or t
  misc_feature (810)..(810): n is a, c, g, or t
  misc_feature (814)..(814): n is a, c, g, or t
  misc_feature (821)..(821): n is a, c, g, or t
  misc_feature (872)..(872): n is a, c, g, or t
ctccagctaaagccgagagaagccaagtgcaggatgagcaagttccaggcagtgggaacagcctgtgcaagctctgaggtggccacgggctggcacatggaacggagggcagagggactggtgcagcaggaggggggacggcgggaaaacaggagcctggagggagagggaggagacggtccgcagtgcctgctggctgggagggatgcagattctgcccaagggagcaaagtaccccacgcaatacacaggctcttcatgctggtgctggtttttcattttttctgacacagagtctcactctgttgcccaggctggagtgcaatggccagatcttggctcactgcagcctccgcctcctgggttcaagcgattctcctgcctcagcctcctgagtagctgggactataggcgtgcaccgcnatgcccagctaatttttttatttttagtagagatgggttttgccatgttggctaggctggtcttgaactcctgaccttaggtgatccgtccacctcagcctcccaaagacctgggattacaggtgtgagccagtgcacccagccttgtgctgggttttaaagcagctctccctatatctcatgcttcaccacctaccagagtgaggctcagggtgaaactcagagcaaggtgcaagacaacttcaggtatctccatgctcgaagccctgacctactgtattgccccgaaagtcttccctgctgtggctgcatcttttccacgtggataatcttggttcacctctagcacaggaattcttttccggggctcctaggatgggctgggtnggtnggagtgnaggatgtctgcctcccctgagtttgtatggaaaaggtattcttttggtgcncttctttctgggagggagtctattgctttgtcttttcagaagggctcatggcccttcgaaggtgaagacccaggatgcagggtgatctgcacttggccctcaaggccaaggtcaggctgtggctgggccgggtggtgatcctggctctcacctgcatgcagatgcacttgagtccaaaccccaccctgggcaaagcaagggcccatttaggtctagaagagacaggagtgggcaggacaggcctcatgaatgcaaaaaagaaagtctctgagcatctaccaaatgctagaagctgtcttgcacctgtcatctctgtttttgctgtggatggtttaaaaaactttccctagattcccccctctcatgcagatttttgtatattctgatgtctttgtctaagtcttagaaaatgaaagagctggagccgtcggaggtgcccacacccacctgcagtgctgactcaatggttttgttctttgaacaggggtgtttttaaagggtacaagcacacctgcggttcttctctcaggtcttccggagagattcaggaggcagagtcatgagtcccagggactctgggattcttaccttctgcaaaatatcccgccgcagctcagaatctgatgagtctcttaactttgcttctaagctctgtgtggaggggagagagagaaatctcaagggtgcattcacaagaacattaaacacgcaatagaatgtgttggcaaaaaaaaaaa

SEQ ID NO: 665047 - DNA, 328 bp, Homo sapiens
  misc_feature (181)..(181): n is a, c, g, or t
agtcagaggaagaacatccaagtgagagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttanggacttggttgccacagtccaggagcatttgaaggcacagtgcaggggctcagattggcacagaattctttgtgaaatatgagtgccacagactgtaacagatagcttcatgcacactatgcattttattggtttgtttggaaaatg

SEQ ID NO: 665048 - DNA, 505 bp, Homo sapiens
ttgctcacaaacccattgacattatcaatatgatcagcaacggcgactcaatcgtcagagcgatcaaccccattgcataatgtgttcagaatgtcctatctagctatccatgtgaagatattggcttcgccaccataggcatcaaagtgctccaaatgtccacttgcaacttctactaaaggaaggttcaaaaatactcaatcaaaagaatgtttaactctgtgagatgaatgccacatcataaagaagtatctcagatgttgcttatctagatttttatgtgaaaatatttcctttgtctaacttaggctgcaaagtcctccaaatgtccacttgcagattctacaaaaagagtgtttccaacactgctcaatcaaagaaacattcacctctgtgagatgaacgcacacatcacaaagatgtttctcagaggttctactatctaattatatgtgaagatattcctttatccaccattgttcctcaaagcactccaaactgtcca

SEQ ID NO: 665049 - DNA, 301 bp, Homo sapiens
ttcctcctgctgaggacccagcagaatgatgcagcgtgcccaggactttcagcagagtcagtcagagatgcagccaccgatgatgcctgggctgcctcaatgtgcaggtcttcctcccatgaaacctgtggaccagtgactgcgttcccctcagcaccaggtaccaggtgagccagagcgctgagggggcagcacactgcagtgcaggcccacttgtgcgctcattcttgcccctggaggtgcatctagcctgaggaatgccagctgggtctgggaagggggcacagtggatttgcgggga

SEQ ID NO: 665050 - DNA, 144 bp, Homo sapiens
agctgttctagaggatacccacgaaggaccacaaaactaatctagtcaggttctcaggcaggcagttctgcttcagattagagcagaacccataaaatactcaagtcctgggatatgggctatcagtggtacctgagctcgaat

SEQ ID NO: 665051 - DNA, 291 bp, Homo sapiens
ataaagagagtaatactagtaagtagagtcagaaggaagtacaaagtaacagcaatatcagagaacagcccacatagagaaaacgatgcaaagaaaatgaggtacaggatcacaaaaagtggtataagaacacctgatactagcagtaatacccaactgattctacacagtactataagagcacatatggtatacacatctcaattaaattcacacagcaattctatgtgagatagaaagttaacatccttatctaaataacgagccagaggctcataaatgtaaaatgtg

SEQ ID NO: 665052 - DNA, 421 bp, Homo sapiens
cagactacctgataaaggacatggtcgagcccttaccagtcccaaatgtataagaggtgacacttgcgaatattgtcaacacaaagaaacactcatagtcggccccagtcaaaggcggcaccatgaccgacctggatgaacaggaagatgaaagcctggttacgacggtcaaggatgaggatgagaacagtacggggaacaagggagagctgaccagaaatccagacctgcatgaggacaatgtgactgaacagacccaccacatgatcattcccagctacgctgcctgtttggactacaataatgttcatgcaattgatcggagggttttaccatattttttgaacggcaagaacaagtccaagattccagagaactacctggcctatcgaaactatatgattgacacttaccgactgaa

SEQ ID NO: 665053 - DNA, 251 bp, Homo sapiens
gaatcagctcggtaccctctataggcgaaagtgctaggatttcgcattagccagtgtgccaggtctccatatttgtgctctttatgacatcttcccaggagataatggtgtggtccctacagagggaatgtgttggggacagctccttaaaagatctcttacgtggttttcactgctaatatttatgactaaatataaaatctctaagctttatcatgggaatttgtagatgtatcttcggccttatcgag

SEQ ID NO: 665054 - DNA, 307 bp, Homo sapiens
tttgagcttgcagtgcagcgaagatcgctccactgcgctccagcctgagcgacaaagcgataccttgtctgaaagcgataagaaaaaaagatagagctaagctggacgagcgaggaaaatgggtagggatagaatataggcggactataatttgcccacggaaggtgcccttatttcctcacctttcactgctctggcggcgctcctgacgctagaccttccggcgcccctctttcttacaggtcctttaaggcaagtcaggttttccacctctctaaaaagctcttattgcccaggctgtatgtgt

SEQ ID NO: 665055 - DNA, 618 bp, Homo sapiens
  misc_feature (561)..(561): n is a, c, g, or t
ggttattgcattgttttctgtatcggtactcaagttggcttctgtgtccttttgagaaatccctagcagttttttttttcttttgagacggagtctcactccgttgcccaggctggagtgcagtggtgcaatctcagctcactgcaagctctgcctcccgggttcacgcgattctcctgcctcagcctcccgagtagctgggactacaggcgcccgccaccatgctcggctaatttttgtatttttttggtagtagagacggggtttcaccgtgttagccaggatggtctcaatctcctgacctcgtgatctgtccgccttggcctcccaaaggttggggattacagacgtgagccaccgacccagccgatattgttttattttaatcaaggcaaaactgtattgtaaatactgcttgaatttatactttattttttttttttttggagaaggggggctctacactcttttcgaccccagttggaagttgcccgggggggtataatcatagctcactacagcctacaaacttccggggcccaagtgatcttcccacttaanccccaagtagctgggaccaccggtcctgtgcaacaatccggcctattaaaccaaatt

SEQ ID NO: 665056 - DNA, 121 bp, Homo sapiens
taaatcagctcggtacccggtgcgttggcccaacacggtgcgttggcccaacacgtgtcgttggcccaacacggtgcgttggcccaacacggtgcgttggcccaaccggtgcgttggccca

SEQ ID NO: 665057 - DNA, 115 bp, Homo sapiens
cccccccccccccccccggggggggggggttccccccccggggggggcccttcccccggtttttcccgtttgggtttttttttttggggttttttttaaatttttcccggtttta

SEQ ID NO: 665058 - DNA, 158 bp, Homo sapiens
agaatttggatgatgctgaattattatgcagactaattccacccagttgagacacaccaagcttgttcacttgtatttattgaaactggggattcttggccggtgctgtcccctgtatttactttaaggcactggatcacttatcattctatgggtgt

SEQ ID NO: 665059 - DNA, 203 bp, Homo sapiens
accggatacactgctatgacagaatgtgcagtctgtcattcccgcctaccggttctccgtgagcaacgatcatgccattggaatagtagacagcgggataattaagaggacacacgggatcttcacacactgggcagcactcatcgttcgggccacgtagtacctctcgccagtagatctacaccacactgggcgagtgaagc

SEQ ID NO: 665060 - DNA, 358 bp, Homo sapiens
  misc_feature (302)..(302): n is a, c, g, or t
  misc_feature (322)..(322): n is a, c, g, or t
  misc_feature (332)..(332): n is a, c, g, or t
tcttagaaggaagaccagttaaagttgttcaaaagggtccatagagaagccttaaaagtatgaatttagggccgggtgtgaatgctcacgcctttgatcccagcactttgggaagtcaaggcgggcagatcacctgaggtcaggagttcgagaccagcctgaccaacatggtgaaatctcacactactgaaaatacaaaaattagttgggcacagtggcgcatgtctgtagtcccagctgctcgggaggctgaggcgggagaatcacttgaacctggaaggcgggggttgcagtgggctganattgtgccattgcactccancctgggcaanaagtgcaaaactccatctcaaaaaac

SEQ ID NO: 665061 - DNA, 416 bp, Homo sapiens
cagaacagctaagaagctaatttaagaatggccagcccctgaaagatgtaggcaaccttttgcagaatgataaatgggatccaggactggactgtgtttgaaaggcatcaactgaatgtggatgttaatgacctggactgtcagggtccccctttacctcccagagcctcagagcccccaagacaaaataattttgaatactgttccatggggggaatttactaattcaaaaagcccgcctgggccaattttcaggtttttatgtaaataagtattagttaacctggtgcaaaatgatttggcaaacaaaagcatttgggacgtttttgaacaaagaaccctttggaaaaattttttgggggacatgattgatagaaacatgctatctttagtaaatttaaaattttgaaacccca

SEQ ID NO: 665062 - DNA, 123 bp, Homo sapiens
gatcttctacttatccttttttcctccctcttaaactttaattttgatacatttgggagtgaaatgatgacaataaatgcaaagtaattattgaagaaacagtaattttgtattagcttactg

SEQ ID NO: 665063 - DNA, 135 bp, Homo sapiens
ggctgaaacgatgcacgtgactggcacaatttccagaaaacagatactggcggcaacccccaatcccactgtgggtcacgatgactttgaggaggtggtatgcattgggtcagtggccgaacttgaagcacctgt

SEQ ID NO: 665064 - DNA, 131 bp, Homo sapiens
tgttgagccatatgacgtaagtcgtggaagcctgtgctactaaaaatgttgagctgtagatccgtcgacaatggtgaagggatgactcgcaagtaaccctgaggcttgtaggggggtaaaatagagcccca

SEQ ID NO: 665065 - DNA, 128 bp, Homo sapiens
  misc_feature (77)..(77): n is a, c, g, or t
gcccagaccgagagacacagtgatgacctcagcctagggtggggccatctaccctccctgcaactgggagtgtcgantggccccacccagaccgagagacacagtgatgacctcagcctagggacacc

SEQ ID NO: 665066 - DNA, 285 bp, Homo sapiens
aaataaacataatggtttcggtatagtaatgcaaattacgtgtatcaacgaaggatacggcacataaaaatgacacctcatattggattcccggattttgtaaggtacaatagagcatataaaaaatcgctaattactctcaatacttaccgattaaaataagaggttatgtattaatgacctaactgggttatttcgaaaagtttttctttgcaagtggatgtggcagcgaaaactttttttctttatttaaccaaattatggtttttttttttttttttgtgt

SEQ ID NO: 665067 - DNA, 897 bp, Homo sapiens
gagagaagaccctagatgaagttggaaaagagctctggctgactccacccactgtccccaagcattaaaggttgtggccatgagtttacagaattacccacattccagttgccagctgggatgaaaagcttgtgctcagagctctgggaatcatgggatcacatggttactgtttagcccaacagcatgctctgtctagactggacctcccagccccttgtgttgagaaggctaagtttttgtggagtcgaggtgggagactgagaaatgatgaattaaccctgtgttgtcatcctcatgacattcctgaggtaattcagcaggttagaagtgaggacgtctagtctttgtgatgcataatttcctcatcttgtgacatgggccatccagatccaactccccttgaaatacaggggcaggaaaggaggctgaggtgcttggtggtgtctcccattcccctggtctaatttcagaccgggctgtggatcaaggtggattttacttgggatcaacttgtccttttatgccttgaaattaattgtagagaagtcatcaaagtcctgtgatttggctagcgcataggtgtcttatggagatctcttctagggcggtatattactagattagcctgctgagggatgtcacaggtttctattcgggattacagcctcggtagagtagaccacgcgggacgccccttgtcgtgtcttgacccagtctgcgggaaggcggggggggcgcaacagtggcgggattgcggcaaggggggcccgtgaggggaggccccgcgtcgtagaaaaagggtgtggggaaaaccccatgttttcttgtcgggagaattgacaaaatcgggaaaaaaaaaagatggccaacaacaatgttgtccaacaaacgtgt

SEQ ID NO: 665068 - DNA, 343 bp, Homo sapiens
  misc_feature (5)..(5): n is a, c, g, or t
agctngaggagatgatgaggaggacataaagaggtgaggaggaagtaggataataggacaggtcacggagctcctggaggctgaacagggcggtagtgcgtgatactctggtaggcactgtcccggccgtacattgggcgttccctacccttgcactcctcttcagaagaagacaaaagatcgtcatcatgcacctggtgatggaaagcgtcagcatctgggaatgaagtcactgactggcggacagccctggacgggccggcagactcgggctccccataagtcctggtggtgaagtagctctcttcatagtagtcgtcattgtagccattgcactccggcc

SEQ ID NO: 665069 - DNA, 1011 bp, Homo sapiens
gcgcttccgccggtggccttcctgtgggcgggagagggcggcgggagcccaatgagggagcaataacgtggcaaccacccacgagcccgcgtcggtgcccgccccgcagggggacctactatccggcgccgagccggaggggggaaacggcgcccgctgccgccggagctcgagcaacagtccatcccgcgcgtggcgtgcgccggctcgctatggcagcgcggcccaccctctttcggcctcagctgtccggggtgctttcagcctccgctgtggatgctgcggccgtctatcgaacgccacatgaaggtgctccgttgctcgcgcgctcatcgcggggtccggcgttcttcctgtgcttggcgggccccttctgcggccgatgaggaagaaggaaggggccctaagtcaccgttgcaaggtgtattttgagataggaatgggcagatgaagaatgtaggcagggtgatatttggtctcttcggaaagatgttcgagaaacagggataattatgtgggacttagtacgggagagaaggagttggtaaaagagggagaaaatcatggggtaaatggaggagtacatgatcacaggcggagattcacaggggacgatggacaggcggaaagcagcatctacggtgagtgggtacccggatggagaacttgcacccggaagcaatagggggccctggctgggttggagcagggcgccggcggggacacgagagaccgagcgggcgaccgagatgttatggcaggggcggacgcacagccggggcggcacgtgcacgacatggagtgtgggccagggccaaaaggccggaagggagcgcgcgcggtggacagcagaggagacagagggaacaccggggggggacactaaccgcgactcggagggcgacaccagcagagagggaggaagcaaaaaacgacgaggggaaggcagcaacacagcgcgagaggcgcgaggcgagcagcgacggacgagggaggaagacggcaaagagg

SEQ ID NO: 665070 - DNA, 339 bp, Homo sapiens
agcccagaatatcctgtggtacagaaagaaagagaagagaagagaaagagacagagaataatgaggacatatcagaaggacacagacagtaatcccagcactttgggaggccaaggcgggtggatcacctgaggtcaggagttcaagaccggccaacatggtgaaaccttctctctactaaaaataaaaaaattagccgggcgtggtggcacacatctgcagtcccagctaccggggaggctgaggcgggagaatcacttgaacccaggaggcagaggttgcagtgagccgagagctcgctactgcactccaggcctggacagagtgagaccctgtctc

SEQ ID NO: 665071 - DNA, 538 bp, Homo sapiens
aagttgaatctgcaaatacggggagtcctgttgatgttgccagtaaaattagcaggtgttctggtcctgtggccatctgcctagtaaagctttttgcatgaaccttctatgaatgttactgttttatttttagaaatgtcagttgctgcgtccccagacttttgatttgcactatgagcctataggccagcctaccctgtggtagattgtcgcttatcttgtaagaaaaacaaatctcttaaattaccacttttaaataataatactgagattgtatctgtaagaaggatttaaagagaagctatattagttttttaattggtattttaatttttatatattcaggagagaaagatgtgattgatattgttaatttagacgagtctgaagctctcgatttcctatcagtaacagcatctaagaggttttgctcagtggaataaacatgtttcagcagtgttggctgtattttcccactttcagtaaatcgttgtcaacagttccttttaaatgcaaataaataaattctaaaaattca

SEQ ID NO: 665072 - DNA, 453 bp, Homo sapiens
gtgtctccgctgtgtgtctagtgtcctacatctcctcttcttcttaagtgtcttattctcatctcagtgctgctgtcacagtaataccagaggctgtgcgcggttataaacaaaacacattgattctcccacagtcctggaggctggaggtctgagatccaggtgtgggcaaggctggttcctcctgaggcccctctcctgggcttggagacgccgtcttctccctgtgtcctcacagggtcgtccctctgtgtgtgtctgtgtcctcatgtcctcttcttatgagatgtcttagtccatatcaggctgttgtcacagaataccagaggctgggcggctaagaaacaaaacactttgattctcccacagcccatggaggctggaggtctgagatccaggtgtgggcagggctggttcctcctgaggcccttctcctgggctagaagaccccgt

SEQ ID NO: 665073 - DNA, 117 bp, Homo sapiens
accacccatcaacactattatgtccctcatcctcaccaccactaccaacaagcacatctatcacagcatgacctctaccaccattgtccctgtcaccctctccgttgcccttacctc

SEQ ID NO: 665074 - DNA, 613 bp, Homo sapiens
tggccggtccgtactgcgcgggatatgtaccgtaagcgaaatgataaattatacctaagcataattatatccatggactaacccctataccttctgcatatgaattaactagaaataactttgcaaggagagctacagctaggtacccccgtataaccagacgagctacttatgaacagctatgatagcacacccgtctatgtagcataatagtgcgaagatttataggctagaggcgacaaccctaccgagcctgcttattcctggctgcttgtctatataatcttagttcaactttaaatttgcccacagaaccctctaaacccccttgtaaatttaactgttagtccaaggaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagatttaaacactgaac

SEQ ID NO: 665075 - DNA, 122 bp, Homo sapiens
gaccggcttgatatgggccgtttgacatcgccgtatcgcttgatcagctgaaacgtctttcgcgtccgtcgcccgcgcccaacgcctgatccgtcggcgccgccacgccgcccggcctgcag

SEQ ID NO: 665076 - DNA, 919 bp, Homo sapiens
agcggaatggcttgaaccaggaggtggaggttgcagtgagccaagattgtgccactgtacaccagcctgggtgacagagcaagactcttatctcaaaaaaaaaaaaaaaaatgctccagggcttaaatgaaaagtaaaatttctaagttaataaagatgaaaaaggggtgactatttagtgattgaacaataacttaaaggtgtcttattaaagcaacgtgagtgtctagccctaaatttaaccagggtaaaaacgggttaacactaaccgtgaagtttgggtgaaataacgtgtctctttaacttatggagatgttgcaagaaagtgcacattccagggggacggggagctatgaaatgtgactaaatttcctccttgcaggtgtttaccttcaagatggtataggtattctctcctcttcttcccccagtccccattacttattggcacactgtgttttaactggactcccggtttggatatttatcaccaagaccataaactcatcaatatgaatttctggatgtatactcacgacggtcttggatttatgtccctaaaattttttagatagggtatgtgttgctttggccagaattctttggggctaaatttttacttcctttccccaagcttgcttgagtcttccttaaccgtggttttctcttaacaccaatgatgaaccctgagaaaaatgcctgcattgtggagcttggcctagaacaggagctgagtatttaagatgtttttactcctcggggtcacccttgaaaattatgtgttcccctaaaattcttctggtattccacaaggcctttttaattggtcaagcaattttcttttcactgttaccctttagatatttctatggattaccctgggtccacaccgtggagagacacttcggagcaacaccgg

SEQ ID NO: 665077 - DNA, 286 bp, Homo sapiens
ctttagagatccccgctcacaattgcggcctgttgcaacctcacttcttgctccctcagaatgcagaattccacttaggggtcataacgcagattagatacctggtccgtttcatatcaggagtgatactctattaatccgttttaagtatcttgctgaggcttgacaatggcgtgacaccttggatgtggtgcttgcgtttgccgagtattgcgccactgcattctggcctgtgcgaaatagcgagactccttctcgcacaaagacaaaaaagagccccgaaaaa

SEQ ID NO: 665078 - DNA, 167 bp, Homo sapiens
taggcaaaggagtgtcagccacataaggccgaagcagaaaaggatggagtgaaggtccccacaaccctggcaggaatactgccatcaaaactcaaagtgccttccaaatgcacaacagctcagcatttgctattacgcacgacttgtatgcatgcacgcacattgca

SEQ ID NO: 665079 - DNA, 168 bp, Homo sapiens
ggtgatctagaggatccgtggggctccatcaggcacgcaactcctcagctcatggaggtctccttccatcttcttcttcacccgtcagggcctcgctggcagacctcccgggacgcagagacacgcagccgcaacgaggcctgtgaagggagcccaaagggtaccgag

SEQ ID NO: 665080 - DNA, 577 bp, Homo sapiens
gctccagaatatcctggtcacctctacttccaaaaacagttaaaatctggtttactcggtctccactcttcctcacggtcatggccatgggactactctgataacctccttatggatctttctgtttctactactaccccaattttgggccttttccccatttctaactgcatcattaatatcctctttctggcttactaaatgtgctgatccagcacatttagtcagtacgccacagggcatttattgcccacagtaacagggctgttggacagtggcagaagaggccgggactaaggtaatttggtgctgagagggggaaagaagcacaaggttgggtcggtggcgtaatggaattttaaacactcttatccacaacaaacactttttggtgtccggtggtgtaaaagacatcagatatatcacggatttccaaacaggtgagcatccttttaacgagcggggcaggtggggagtgtcgtgctatggatggagtgaggagatttggttgaacgaacgctaagatggccagacgcacctcttcgatctcaattctgcagcctgggatccaaagctg

SEQ ID NO: 665081 - DNA, 200 bp, Homo sapiens
ggtagatttgttactgcaggtagcacacaccttcaatatgactctgtctcaaaaaattatataaataaataataaaaatgtgttttacacaaaagatgaaagaatatgcctactggtagagctaggcgctaaggtgctggcagttttacccaccatgccaaagtgtccttctgaactgctccccaaggtaatgctcagat

SEQ ID NO: 665082 - DNA, 245 bp, Homo sapiens
gtatataacttaacctgacgtaacgcattcacagctgcatcataatcctctctcaaggatgacataccctactcccactattagtggatcctgtatctccaccctgccatcatgcagctttggacctgatcgcggaagtacaaccatgttctcatctctccaataacataggcttttaaaccatatcccaatttgacttaagatatgagtttatcaataatatctacatcaatagtttatgctgt

SEQ ID NO: 665083 - DNA, 1092 bp, Homo sapiens
  misc_feature (398)..(398): n is a, c, g, or t
  misc_feature (435)..(436): n is a, c, g, or t
  misc_feature (523)..(523): n is a, c, g, or t
  misc_feature (558)..(558): n is a, c, g, or t
  misc_feature (576)..(576): n is a, c, g, or t
  misc_feature (620)..(620): n is a, c, g, or t
  misc_feature (667)..(667): n is a, c, g, or t
  misc_feature (671)..(671): n is a, c, g, or t
cggacgcgtgggtttgccgccagaacacaggtgtcgtgaacactacccctaaaagccaagaatgggaaacggagaaagactcatatcaaccattgtacgtcattggaccacgtagattcgcggacatagtccaccacctagctgtgccattctgtatctatacacatgccggctggccactcgagcaaatgagaagccacattgataacacattgtgttgacgacagtgatggcctgcctgagaactgtgtgaatatgcggcatcctatcaagatagtgcccgtgagagctccttgggcatacaatcctgataaccgactgtaggcgtagagactgttgcggtatcacgcagtgtgactagttctcacttgctcagagacattattgatcgaccgcangctagaaagtagcttgacgtgctgatcttagtacacnnttgatctgtccctcgagggacctaccaatgaacgatctccttattgcagagaaagaccactgtacttagcaagggtggtacgagtcntcaagggcagtgagcataggtgcttgtgtccttcnatgttgctccgcatcgcntcggatgctgtggctcgggaatgtctgagagcgtgcgtagtcantcacatagcaagtaggcgctgagacactccgaagagctgaatgcccnttcntagggcgttaagcagcagctgtggtagtagagaagcgaagccttaatatgtacgggtagttctcaactacataacatgggatctaccgactggagtcacacgcctaacagtcgcagaaagcaggattatcgacggaacattccttgaagggaaggtcatgcactgtacattcaaggaacaattgggcgtacaaatccccgacacagatacgcactttggtgtccaagttgcctggttcggaatcggtgacgaacatgcatggagcccaagtgctaacatgcctgtggtgtcaagggcatggaagagtcacccgtaaggattggccaatgccagtggaaccacgctgcgttgagggctctgggactggattcctacaccaactccgtccaagatgaacaaggccttggcgccttgcctctac

SEQ ID NO: 665084 - DNA, 315 bp, Homo sapiens
gcagggtacaaggacctctatggacggattaagaggcaactgcccctcaggaatgtgatgtgctctgtgtgatcagtatatccatgaatctaaatggggagggggtgagagcacagaggagctttacagaaggaagcacacttcatccagcacaaagctgtcccctgtatcactcaaccactgtcatcctctaaagttctacgttcactgacataactcaactatccactcctctggcttttagcaaatcacatatcatgagtagccttgtgcgttgtggacaataactgcgttgtatgaacgatacgcgactta

SEQ ID NO: 665085 - DNA, 320 bp, Homo sapiens
tggatatttatcccttatcccttggcagatatatgatttgcaaatatttcctccaattccacaggttgccttttcattttgttgcttgttcctttgctgtatagaagctttttagtttgatgcagtcttatttgttcatttttgctttagttgcttgtgcttttggtgttatagcaaaaaaaaaaaaaatcattgccaagaccattgtcggggaactttctctcaacattttcttctaggaggtttatagtttcagttcctacagttaagtctttaatccattttgaggtaattgttttgggggatcatatgtcagtttt

SEQ ID NO: 665086 - DNA, 887 bp, Homo sapiens
cctccgggtttgaccaccgtttttgtcggggtttcgaccccgcatttatggcgttttgaggtgcgccctctagtgggtgtgccccgcgcctgttgcgtcagccctcctttgggggtcgcttcctcctcccccccgcatgttgggacactctttgcgcgccacgtagtctggtccccgcccctgtggtctcagcccctctgggccccccctcgcggctgttctcctcccccggagctccccgtgtccctcgccttttgcctcccgcaaatcgtgcttgtcgtcaggttgcataccagggttgcctcctgttcaggcgccgcactactcccccccaatgccttgcgtcgagtgtagctgcggagaagtcctgtcccccccgtgtgccattgggggggcgcgcctcggcccctgactcctgtcttcaccccgtgactgcaagacgtgttgcggtgcccttgctcggtcctcgccgcggcgggctggcccccccgtcggcgtgactctgcacgtctgttggagtcagtggtcctggcccggtgtccccaggcccctcttcgagggcgtcacaggtggtacccgttctcgccctttgctcacacccgtggtgccatctgacccctcttctcggacgggcgagaggtcgatctccctgctctcacggggggcccccccctccttcgtcggtgtgcggtctgcggcaccccctctctcgcggggagttacccggtcgacgctgtgtttcttggtgcttgcttccccctctcgtctcccggtgggtcccccctacaattcttccgctctgtttgtggggcgccgagtagtcagacatggctacctttgtgccccaggcaaaaaagtcaccatcccccggcggtccccacatgacg

SEQ ID NO: 665087 - DNA, 140 bp, Homo sapiens
  misc_feature (52)..(52): n is a, c, g, or t
gcatcctcgagcatgaccgaagcatgcatgcatgcgctgcaggacgacgtgnaacaacgactgcgctgcaggcctacctgtggggctccgtcgacacgtgagcaccgtgctgccctccaaatatcgttaagctggagcct

SEQ ID NO: 665088 - DNA, 788 bp, Homo sapiens
  misc_feature (92)..(92): n is a, c, g, or t
  misc_feature (199)..(199): n is a, c, g, or t
  misc_feature (320)..(320): n is a, c, g, or t
  misc_feature (560)..(560): n is a, c, g, or t
  misc_feature (581)..(581): n is a, c, g, or t
cattggtccgagagattagagcaataaatacattcagtcatttatttataaatgaatgacagaatattcaatccaaatagaaacaacctttngtcagtgatgcaacataacatggagtcttatattgagaaagtgaatatgaatattttaaatagatgcctaggaaatctgtgtttgctgtttacatttaatgtacttngccacattagcagtaccacacttcttttactttcatccttctaagaactaatgaaagatagcttgctattagctttgacatgttgcacatgccattatgttgttctctaagaacaactaanttctctccagtgttcatgtgtgattcctttttcatcattattactttaatgtggatgaatactatttctaggaacttgattatcactgaacagattgcatatgtaaatgcagataattcttgagcaatatagtgaaaatgatttcacacacagtttgaaatctcatattacacaggggtaaatttttaacattaggacattagctggctggttctataaatgtcctgtattgtctgctgnttcctttgtggagatgtgtcnccgttcggcatgttgggccaaggggaggctccaactacacatattatcccacttaactatctttacctatgacaaacccagacagctccactatgtatagaactggccgtcgccgtcattgcaccggttcaggtggcatcttgggccttacaattcgttcccgtcacacaacccaggggccgacaaccaatgagacacagacgctcc

SEQ ID NO: 665089 - DNA, 185 bp, Homo sapiens
cactacccgcacacatacgtacatcagtgattctaatgatcagctttgactggacctcagctacacacgaatctccgatgaacaactctacagagcatcttttagagcaagagattcatacaggccaagtgatgagcgggggagtcaccacagtgcttcagcgcccaggtgcattctccggcctc

SEQ ID NO: 665090 - DNA, 616 bp, Homo sapiens
  misc_feature (4)..(4): n is a, c, g, or t
  misc_feature (74)..(74): n is a, c, g, or t
  misc_feature (85)..(86): n is a, c, g, or t
  misc_feature (94)..(94): n is a, c, g, or t
  misc_feature (97)..(98): n is a, c, g, or t
  misc_feature (107)..(107): n is a, c, g, or t
  misc_feature (109)..(110): n is a, c, g, or t
  misc_feature (118)..(118): n is a, c, g, or t
  misc_feature (120)..(120): n is a, c, g, or t
  misc_feature (122)..(123): n is a, c, g, or t
  misc_feature (132)..(132): n is a, c, g, or t
  misc_feature (139)..(139): n is a, c, g, or t
  misc_feature (148)..(150): n is a, c, g, or t
  misc_feature (167)..(167): n is a, c, g, or t
  misc_feature (192)..(192): n is a, c, g, or t
  misc_feature (213)..(214): n is a, c, g, or t
  misc_feature (226)..(226): n is a, c, g, or t
  misc_feature (230)..(230): n is a, c, g, or t
  misc_feature (241)..(241): n is a, c, g, or t
  misc_feature (257)..(257): n is a, c, g, or t
  misc_feature (268)..(268): n is a, c, g, or t
  misc_feature (317)..(317): n is a, c, g, or t
  misc_feature (324)..(324): n is a, c, g, or t
  misc_feature (336)..(336): n is a, c, g, or t
agcnacagctcaagagttctggggcttgggaacagaaaagggctccttcctgctccaccccaatctgggttgcntgggcgtgggnnggggcgancgnnccctgcgangnntactgggnangnntcttctttnccttctnggggcagannnccctcctctccacaaangtgtgcgcacttgcgcgctcattangcatgtgcacacatcatattnncacactcaagcnatgntcttgatttcngggctctattgcgggntcaggtatcanccccagagccgaggtgtgtgagagctaccttagcagactcacaaaaggntactgcngaggcaggggtnaaccatcccaagggcctggcaagggagagactgaattctgtatcccactgatgtgagagggaattctaatgagcaaatgggaccagcggggcccagttagggaggtccagatgccagttctgagatgccacccagctctgccttgctcttcagtagccagtcagtgaaaaagcagagtgccaggaggccagtaccgagcaggtcccccagccctgtaagtagggggatgcagtggttgtcaggatccagggcctggtgccaagtcagccgaaccatcact

SEQ ID NO: 665091 - DNA, 281 bp, Homo sapiens
  misc_feature (269)..(269): n is a, c, g, or t
  misc_feature (276)..(276): n is a, c, g, or t
tgagattttggccgggcttggtggctatgcctgaaatcccagcactttgggagtacaaggtgggcggatcacttgaggtcaggagttcgagaccagcctggccaaaatggtgaaacctcattctctactaaaaatataattagccaggtgtggtagcacacacctgtagcccagctacttgagagactgaggcaggagacttacttgaacctgggaggcagaggtccagtgagctgagaacatccattgcacttcagcttggaccagcnggagctntgctt

SEQ ID NO: 665092 - DNA, 957 bp, Homo sapiens
cttccttttcttggctcttccgtgtatcctattgtcttctgtttttagtttgtgtggtgtccttctgggggtacctaccctcctgtgtgccccctggaccccttggtgccggtgtccacatttccctggtgttgctcatacccccgcgaattctggttatgctcccacccccgtgtggggtttttgttccccctggtctttacctttccgttctttcagggtgttacacgggagatttggaactgtcagatttgccaatgtcttctctgacctgaggaggaggatggcaacctcagcctggatggtgcagacagcacttggcttggtggcccagctttcacccaccctaccacactggaaatgtgagcgtgtactcctggcccttttctgtcacggaccctgccgcgcccctgctatcagctggcttccgactcccccttttccctggacccgcccggtggcacaccctggatttgaccctgatccgtgcccgccttcccggagaatttgttcccctccctacacgcttccccaccacggagtttgtcccacggatttgggccccatgttccaagccaattccaccaagttaactgaggcccaggccagacgtgccagtccatctatctggcctgcagcgctttttctgagacgcgccatgaacgaggccttctggtgacccccagttttctgctgtgctggtggagcccccgcccgatgagcctgccctggtgctggcctgagttccccggagctgtttggtggccctggtgatggcccctgaggctggagcccccctggccacgcccacgcctggctctgttctctgtcctgtcaccccactccccacactcccctggtggcctgaactcccacctccctggtggccccactccccccgttcctcaccgatatggtttttacttctgtggatttaataaaaacttcacccagtta

SEQ ID NO: 665093 - DNA, 283 bp, Homo sapiens
ttgtcccctatatttaagatgtccccggatacctcaacaaccccttgttctccctctctgggggttttgtttttctcagaaccctttataaaaaagttatcacctttttcggagcttgatggtaaaagtttttcccggtatacccaaaacccggataaaaaggcccttggacccccctttttatgtgtagtgtactaaaaaaggtttaataactgagggggctcttggggaaatggcggcgcccctattcttattctaaaatcaaaaaattgatccctcgaaa

SEQ ID NO: 665094 - DNA, 432 bp, Homo sapiens
  misc_feature (308)..(308): n is a, c, g, or t
  misc_feature (347)..(347): n is a, c, g, or t
cccggaaagtgttgcttcaccagcaggggcttcccttgccctgtttccaagtagtaagtcgggactgggtgtctacctgtctgctttgctgaggacttgagcggagttccaagcttgcagactcaccattatggatggttctgacgtacccagtggacgatgcctttttctctttatgacgggtacacagaactgagccatcctcttaagggcacatgcacctgggtggtcctgccagagggaatcctggttcctgggagtcagggtcctccctgccacactccctatagtcatgattggtccggatncgggtaccgtgcttcacgggactgcagagcagcacttgnccccagtgggcagatctgaggagcagatgatggccacacacaggacaggctcacctaataaactgttcagtgtggtggcacatga

SEQ ID NO: 665095 - DNA, 729 bp, Homo sapiens
cgggagaaaggtggtattgcattgtgattttgattttcgtttccctgatcattagtgaggttgtgcattttttcatatgtttgctggccatttatatcttcttttgagaattgtctattcgtatccttagcccactttttggtgagattgtttttttcttgctaatttgtttgagtttcttgtagattctggatattagtcctttgttggatgtatagattgtgaagattttctcccattctgtgggttgtctgtttactctgctgactgttccgtttgccatgccaaaactctttaatttaattaagtcccatctatttatctttgtttttgttgcatttgcttttgggttcttggtcatgaagtctttgcctaagccagtgtctagaagggtttttccaatttttcttttggtagcattttcatagtttcaggtcttagatttaagtccttaatccatctgtgagtggattttggtataaggtgagaggtgaggatccagttattctcctgcatgtggctggcactcgcatgttggtaccagcagagttcacaatggcaaaaatatggaaccagcccaaatgcccatcagtcaatgagtggatcaggaaatggtggtatatatccatgatggaatattactcagccatagaaaggactgaattatgggctttgcagcaacctggatgcaactgggagattgtcgtcctaagtgaagtaactgaggaa

SEQ ID NO: 665096 - DNA, 136 bp, Homo sapiens
gcgtatgcctcatcgacggtgatgaggaagttgctcaacgcatcgctgccagactatgactgccacacgtccaggcccagcacgccaaagcttatcataggcatagatactgcgatcgagacaactactcgacact

SEQ ID NO: 665097 - DNA, 242 bp, Homo sapiens
  misc_feature (33)..(33): n is a, c, g, or t
cccccccaagggggcccgggccccggttaccanccccctttgggggggttaaaaacccccttttttaaaaaaaaaaggtcccctttccaaggtttttaattttttttttggtttaaaggttaaaaaaaaaaaggcccccgggtttttttaaaccgtttttttaaaaaaaaacccccccaaaagccccttttcccctttgatgggaaaagggaggaaggtttattaaaacctttgctggttta

SEQ ID NO: 665098 - DNA, 128 bp, Homo sapiens
ggcaggttcagaaaggcgagatgtggccgacaggagcatgtgggaatgtgtgagtatccacagccagctcacagtgcagttgcactcagaacaggagactcagtggacacacaggtctcacggatgca

SEQ ID NO: 665099 - DNA, 115 bp, Homo sapiens
cgagtgaggagacaggccatgctatcaagtgcatgcagctcactgattgcatcctctaagttgccgcacagtgcccaccagaaagtatgtccgacaagcctggcagaaggcagac

SEQ ID NO: 665100 - DNA, 336 bp, Homo sapiens
ttgtgctgggtgacctcttgtatggaagagaaacaggaaacttaatctacaggtggaaagggtacaacatgacagtagatttctcattggaaaccacggaggacagaaggaagtggcacaatatttttcaagtgctggggggaaaataaaaagaactgtcaactcataatcctatacccagtaaaaatattcttcaggaataaaggggaaatcgagaacattctcagatgaagagaaactaagagacttggttgccagtataggactactctaaaagaatagctaaaggaagttctccaaacagaaaggaacagaatagagaatccagcacaagaa

SEQ ID NO: 665101 - DNA, 173 bp, Homo sapiens
gaaagttagtcgtttttggtcttgttttcatttttgattagaggaacttctgaacttggaaggggaagttggcagcaactctcctgggccatgtatcaacaatcttctgacagcaggagcagtgatagttggggattgtgagatgaatgagaggcccatcgtgaattcaagat

SEQ ID NO: 665102 - DNA, 332 bp, Homo sapiens
aaaccaaacaccacatgttctcacttataagtgggagctgaacaatgagaacacatggacacatggggggatcaacacacattggggcctgtaggcagaaggcggtgggaggagagagagcttcaggaagaatagctaatagatgctgggcttaatacgtgggtgattggttgatctgtgcagcaaaccaccatggcatatgttcacctgtgtaacaaacctgcacatcctgcacatgtaccccagaacttaaaaactgaaaaaaaaaataacttttccatgcaaccaaacatcacctgtttccccaaaactattattaaaaaaacctacag

SEQ ID NO: 665103 - DNA, 329 bp, Homo sapiens
ggcacgaggttttttttcaaaacgcaaggttaaaaaataaaaatgggccacgcatggtggctcacgcctgtcatcccaacactttgggaggccgaagaagggggatcgcttgagtcctggagttcaagaccagcctaagcaacaagcacaaaacctgtacctacaaaaaaatatacaaaaaactagccaggtgtggtggcatactcctgtagtcccagctactgaggaggctgaggtgggaggactgcttgtgccacggaggcggaggttgcagtgagccgagatcttgccactgcactctagcctgagcaacagagagatcctgtctc

SEQ ID NO: 665104 - DNA, 190 bp, Homo sapiens
agagctggtccttgtgggttgtagtctctctcggtcgtctcggcatactctcttctcgagccgcagcctggggccgcactgtgtgttggtgtgggttttcgaagcgtccgcctatgttggcattccgctgtgtcgtagccatccagcggcatagatgcaccccacagattacgaagcaggggtaccgatg

SEQ ID NO: 665105 - DNA, 218 bp, Homo sapiens
attctagacattcaaggagatactcattcatcatctaggatactacacagactactgactatactgccttccattctgtgccctccggttcattttccgcatcaaatctaaagagagccctttaaaacaaatctgatttgcatcactatgctgcgttgaggaccattactcacctctcattccctacatgaggccccactctctatctctggactaga

SEQ ID NO: 665106 - DNA, 350 bp, Homo sapiens
cccccccgggttttccctttttgcttccgggttggatgttgggggggattgggggcgggtaaccatttccccccggggaccggtatggcctggtttcggattttatacgcccccccttaggggatttggccccccgggcccaaaatttgggccggggggaagtcccaaaagcccccccccggccgccgcttcccaaaaacccgcccccgaaaaaaagcccgccgggaagaacccccctcccagggggaagaagcccgggggcttaactttttaatttgttttttccctaaagggccaatccttttgggccggttttttttaataaaagcccggttttcccggccggggga

SEQ ID NO: 665107 - DNA, 192 bp, Homo sapiens
ccctcgaaacccagtcttcagcttgcttgattcagtttgaacctggaattgccacatgccgaggtcaggcacttcgctctagttcaactgccactccatgcccaattggcacaagctgtggtgctgagtggcataacaagctgatggcggaatcccaagctgtcacatcttcaggtcacacaatttctgtcc

SEQ ID NO: 665108 - DNA, 121 bp, Homo sapiens
gtgtgataaacatgcaggggcagggtatgtttttgatatattgattttctcctttcagtagatacctagcagtggttttgctggattgaatgatagttcttttagttctttgaaaaaccat

SEQ ID NO: 665109 - DNA, 204 bp, Homo sapiens
  misc_feature (143)..(143): n is a, c, g, or t
agggaggaatgaaagatgtgggcagcgctcggacgcccagacggagggaaccggaccgtgtgaaggttagggtcccggggccaaagaacaggagtcccgggaggcgggcggggtacggtcggaagcgggctgactcctgcccntccgccggctgcttctgctgaggagggttgggggggagagcgggtgggtcctcccgcgcaa

SEQ ID NO: 665110 - DNA, 142 bp, Homo sapiens
catccaggggttgtgccaggccccacccctcacaactgctttgtttcagggtatcgtggatgggcccactcggtcccaaaatcagcccaggcccatctttttccatcatctcacttcaaaataacataataatttataaaaa

SEQ ID NO: 665111 - DNA, 134 bp, Homo sapiens
gtggtttgacttctatggtgttttaaaaaaacacagattttagtgttaatatagtgtaaatgtactcacctaggtattcattgaatgaggttatatagcatgatgtatacagttggtgaaatgtgcagtcaagt

SEQ ID NO: 665112 - DNA, 212 bp, Homo sapiens
  misc_feature (209)..(209): n is a, c, g, or t
agcacttatgaatctggtgacaattaacattgtctaactgcgttaccatcctcacatacaaaagtaattgatactcagcaatgaaagctgcatgtgcatataggggagagaaggaggtttcaccatgactgacaacatggagtcatggttctggtgaaggagcagggtgttgggttgcacatttggtcacctggggaaatactaccagncag

SEQ ID NO: 665113 - DNA, 125 bp, Homo sapiens
cccaaaaggggggccccctttttggttggtaattgggtttggggttttccccctttttttttaggaactttttttgggattttttttcctttgcccccccccttttattaaaaaaaatgggttga

SEQ ID NO: 665114 - DNA, 823 bp, Homo sapiens
aaaccaacaaagataaaaaaagacaaagaagggcattacataatggtaaagggatgaatgcaacaagcagagctaactattctacatatatatgcacccaatacaggagcacccagattcataaagcaagttcttagagacctacaaagagacttagactctcacacaataataatgggagacttgacactccactgtcaatattagacagaacaatgagacagaaaattaacaagaatattcaggacttaaactcagctctggaccaagcagactacagaatcagaacttgaactcagcttggaccaagcagacatctacacaactctccacttcaaatcaacagaatatacattcttagcagcaccacatcgcacttattctaaaatggaccacataatttggaagtaaaacactacacaccaaaaaaaaaaaaaagaaaaataaaaaaacaacacttttgggcgcgctcgggcccgaaaaaagtttttaaacccatcgtggggcccggggcccccaggaagggcaaacgcgggcccaggggcccaagaaaaccggcgcagaaccaagggggggtttcccccaaaaaaaaaagccccggcggacccaggtctggcacacccgaggggtccggagacaacaaggtcccaaccagggcccagggagcgcgaaataagcaggcggggcgcgcccaccacacatcgacccaccacaccacgcaagacaacacaacagcccgcacaacaggatacgcgaacctaaacagactccacacgcccccagctacaacgcagcactagcacacatccacgcaagacccaac

SEQ ID NO: 665115 - DNA, 424 bp, Homo sapiens
  misc_feature (28)..(30): n is a, c, g, or t
  misc_feature (33)..(33): n is a, c, g, or t
  misc_feature (35)..(36): n is a, c, g, or t
  misc_feature (40)..(42): n is a, c, g, or t
  misc_feature (44)..(44): n is a, c, g, or t
  misc_feature (46)..(48): n is a, c, g, or t
  misc_feature (50)..(50): n is a, c, g, or t
  misc_feature (69)..(69): n is a, c, g, or t
  misc_feature (75)..(75): n is a, c, g, or t
  misc_feature (93)..(93): n is a, c, g, or t
  misc_feature (150)..(150): n is a, c, g, or t
agctgcgcaccccagatggacgatatcnnnctngnncttnnngngnnncnagcggacaagtatcggctngccggnatatccactgttcatcancttgccgacgctgactgcggcgacgccagcatcatggcgtacgcgtacatgcaaggntggacagcggtgtatcgtcctgacaaagtgcggcaacgtcggaatagggcgcatggaaacacggtggatgaaaacacggcgcgcgtaaatggagtacggacggaccgtgcacgcagtgatgccgacattgtccgcagggcagacgtcgaaatcgatgtggacatggaagcgtatctagagcgcggatgctacttgtggggaatctgggatggagccacctaccggccctttgtgacgtggcagcagctgaactcggacgccgaagcgcgaaatt

SEQ ID NO: 665116 - DNA, 1007 bp, Homo sapiens
  misc_feature (337)..(337): n is a, c, g, or t
  misc_feature (404)..(404): n is a, c, g, or t
  misc_feature (422)..(422): n is a, c, g, or t
  misc_feature (431)..(431): n is a, c, g, or t
  misc_feature (434)..(434): n is a, c, g, or t
  misc_feature (447)..(447): n is a, c, g, or t
  misc_feature (449)..(449): n is a, c, g, or t
  misc_feature (463)..(463): n is a, c, g, or t
  misc_feature (474)..(474): n is a, c, g, or t
  misc_feature (487)..(487): n is a, c, g, or t
  misc_feature (729)..(729): n is a, c, g, or t
  misc_feature (785)..(785): n is a, c, g, or t
  misc_feature (794)..(794): n is a, c, g, or t
  misc_feature (799)..(799): n is a, c, g, or t
  misc_feature (801)..(802): n is a, c, g, or t
  misc_feature (812)..(812): n is a, c, g, or t
  misc_feature (828)..(828): n is a, c, g, or t
  misc_feature (941)..(941): n is a, c, g, or t
gggctgggtcggccggagttacgggatgagaattaatagagcggtagtctgtattaggaatgtgtgtcatatgtgtgttctataaactaagcatcggtgggtttagagtgttaaagtgtcagcacattccttctcctttgtctctcaggctaacatgagagaaaatagaaaagtcttggtgtggggattggaagctcaggggccaaatgtccttgccagatccttagagcattacttgactcctaaaaatagtagtgtatgttatttgatggctttgtttccatagttccatcactgacaaaactgtcaatactgttgatggagcagcagcatagcntagagtgatgcattcttacccagaggtggcaataggagagggtccatgtaaataggacgaggtagancagtggcatgattggtanggagaaggngtntgaagggaggacntngattccaaaaaagnatcgtcctcantggtgtcgtctgnactcaaccagctggcagattacacttgccaagtcgttccctttccttctaagtcagttggctccatattcacttgaatatgcctctgtttgggcaaagcaagatacctccacttaacctttatccaaggaagctctgtggtgtcctcttggtcataaagttgtctcctacctaacccagttttaccaaatggaagtaacaaggggacaaactatggaagatggactccatgccattgcagtncagccaccattctcttttccatataaggagccccattacataagctacgggtgaangttgaacantatgntnnatatttcaanagtggaccacctggtntagcatcatcatgggatgaatccattgaactttttggcaaaggggaaaccttttcactaaaaaggctacacttttccggtaaaggccctttctgggtttaaccttggccaaanttcccacttggcatttttttaaattttttaaaggattcaaattttacccctggaaaaaggggtcca

SEQ ID NO: 665117 - DNA, 769 bp, Homo sapiens
ttgtgtgaggatcccggggccgccgcgtcgctcgggccccgggatccacacacacacacactcatagcagagcagctctgctatgagtgtgtgtgtgtgtgtgtgttgtttcttttttttttttttatagtatccaaaaatagccctgaaaaattcagagtccttgcaaaattgtctaaaatgtcagtgttggggaaattaaatccaataaaaacttttggagagctgtggaaacaaacacaacaaaaagaaaacaaaaaacaaaaaaaaaaaccaaaaacaccacaacaaacaccacaaacaaaaaaaaaaaaaaaaagagagggggggcggcgcggcacaaacaaaaaccccgcggggggggcgcgcaccaaatctccgccccaccccgcctttttttgtcacaacacagggcgcccgcccaccaacgggggccgcactactaaacacgggcgggggcgagcggggcgcggcccacaacacaccgagcgcggcgggcgggaaccaaacactgtacgtcgggcaactcttggcgagaaaacacccacccctctcggggggggggaaccaatagggggcaccaccccccacaacgaaatcagattacacagcgtgcgaggggaacacacaccctggggcggctggaccgggcaccaccacagccaatctttctcgggcgccgcgagaacactgcgcgctccgacgctgatctcctcccaaacacttttccacccgccgcctccacataacaacccccgccacgacaaca

SEQ ID NO: 665118 - DNA, 221 bp, Homo sapiens
ggtctggtgctagagtcccttgtcagatgtaggctctgcggactttggtactgggccaaaaaatgacaacaattgagctagacagaaagttgcctaggaaattctcctccatttgagaaggaaagtgaacccgagtcacctatggatgtggataattcttaaaatagttgtcaagactcagaagcagactaggagaccagtccaggtagtttagcatttaa

SEQ ID NO: 665119 - DNA, 326 bp, Homo sapiens
tttctaactgcggttcagtgaatcgtcagaagggggcattactgctctgggtgagcacaggatgatgacaggtgtcatctactctgtgcaaccgtacacgaaggaggtgtgcagtcactcccgcttggatgagatcatacgccattaccagttgctcactgaggagaatatacctgaaaacccactgtgcttcctctatccccgaatcccccgggatgaagcttttgggtgctactaccagtagaaagttaatctccaggaacggaggaaatacctgaaacacaggctcattgtggtctctaatagacaggtggatgaactgcaac

SEQ ID NO: 665120 - DNA, 156 bp, Homo sapiens
ggtgagacgcttggcgaaatacctaactaatgtaaatatagagattgataggctcagcaaaccgccatgacatgtgtatacctatatacaatcctgcacgttctgcacatatatcccacgacttaaagtataatagaacaaaaagggtaccgcgcc

SEQ ID NO: 665121 - DNA, 138 bp, Homo sapiens
  misc_feature (15)..(15): n is a, c, g, or t
  misc_feature (37)..(37): n is a, c, g, or t
  misc_feature (66)..(66): n is a, c, g, or t
tggagcaaggctttngctgtattaaccttcccctgtnatcaccctgcatctgttatcttcattgtncctgctaccactgtgaagattgtgagccttggctggtggctgtaacatgatccagcctgtcaatgcggctgt

SEQ ID NO: 665122 - DNA, 382 bp, Homo sapiens
  misc_feature (1)..(1): n is a, c, g, or t
  misc_feature (15)..(15): n is a, c, g, or t
  misc_feature (65)..(65): n is a, c, g, or t
  misc_feature (80)..(80): n is a, c, g, or t
  misc_feature (127)..(127): n is a, c, g, or t
nagccctttagtgtnttaatgtatatgcacatataccctcattatacactagtgttactaatatnctcattggaattgtngtggttgttctcttagcactcattataaattagcaggaaatgcatanaactatgtgaatcaattgattcacaatgatttcacccatgaaccctttgtcaaatacacaaatagcatgacttcagtgtgctttatcctctcatgtgatctagtaaatgatttttttagctgccagaagggtgttcttcagaagcattgccactgtcatgggtcccacacctcctggacctggagtgatagagacagctctctttttaacagcattgcacgtggactcgtgccgtattcggcacgagctcgtgcc

SEQ ID NO: 665123 - DNA, 356 bp, Homo sapiens
ttgactctctgcggccagattccacacctagtatatgtagatacacaggagactgagttacagcacatccaaacaaggaatcctatgctgctgtgcagggataatgaaaatgaatatttctgtgaggaagaacttcacactctttggttgttaagaaacgggtgtggtggctcatgcctgtaatcccagcactttgggaggctaacgcaggtggatcacttgaggccaggagttcgagaccagcctggccaacatggtgaaaccctgtctctactaaaaatacaaaaactaggtgggcatgttggtgcacacctgtaaacccaactacttgggaggctaaggcacaagaatcgctt

SEQ ID NO: 665124 - DNA, 264 bp, Homo sapiens
  misc_feature (192)..(192): n is a, c, g, or t
ttcgacggaagcatacaaatcaaggatggaattaggtcacactggctagaaacatacggtgacaatgagtcttgctaaaactgtagatggcatctctgtaaaataggaaagagtaggatgaagctgctgaatacagtgtagcagccacgttgcttgcctatggtaaccactgatgactgagatgaacatccnatcatggacgtgaggcctttaaaatagtcccctgacgtgcacctttctgtaagtttcagattagtgagctcc

SEQ ID NO: 665125 - DNA, 331 bp, Homo sapiens
tgcaagtagggaaaggagcctaatatatgtgaaattaatacataactagtaatatgaaacatggcatatatatgagacatgggttcatctgcaccagatgtcagaaaatacagttttataggaatatagagaacagggatgatgtgtataatttagcttctgtcttcccttgggaggtacagaaggagaaagataaatgacatcagacttcgctggtagaaaatatacctcattctttgagtgcttctataggtgagaatgttcgttgaatcccccatttgcgtagactttagagtcccttacctaaaatataatctccttgcgggtatgt

SEQ ID NO: 665126 - DNA, 191 bp, Homo sapiens
atcgcgccgttaccttctcacattgtgaaagaagcacgaggactcaggccaaaccttcaacactttgcttagaaacctcatacaccccggtaatcccagctactcaggaggctgaggcgggcgaatggcttgagctgggaggcggagtttgcagtgagccggtatcacaccattgtggctccagcctgggc

SEQ ID NO: 665127 - DNA, 1126 bp, Homo sapiens
aacatttatggcctcaagatactatacattcaaagcaccccaatgtctactcttttatattttatttttacttcccttttcttcttcctatattataacatgaaagaaacattggttattaatctgcattattcaaagaatcttttgtgtatgtacacggtgtttaagggactatgtacgggatatcccaacgtgaaaagtgctctctggtgtatgcacaacccaaagtctcgtggtctatagtgttccagggggcgacatgggcgccattgtgcatactccttatcagccactgtgctcaaccaaaaatatatggtgcgacgatagctacactttaaactatgtgataacagtgtgataaccaataccattagcatctattacacaccagtgcgcacacattcgctcagcaacacagacgtcgctaacacattggctcactagaatgctccatatatgtgtttatcaatccgtgagacaattatcaatgcgacacactgtatcattgagtatcatagctacttgcatacaccgtgaaaagcttgtttgaggtgtaccccagaggtgaccaatacccatagacataagcctttgggtaaacttccatggctaagatttcccaaaaaacagaaatttccgatgggcccaaggcagtgtcacacacccattcaagaaacattatatttcccatcagtgcataatataatcataatagaacagtgggaatattcaaaaatttaacaactatcaattactgacggctaacaccatcgtggcaacaggggccgcagaaaaaaaacgaaaaaaatcaaagaggacgcagtgtccgtatctccccaacacgtttatttccgctgtacaacgagtgtcttcaccaacaacgattatcacgcgcggatacaccccacagacatgcgatcaatcagcaaaacaaaaaaagtcgagcaacccaactaacaaacaggacagactcagacacattaaaatacacggaataacggaggcacaaggacccgacaacatacaacacacacaagcaaccaaagaacaagtgggacaacaccccggcgccaccaccagctgagaaaacccaaagagacaaacggaccctcactaacaatcgcgt

SEQ ID NO: 665128 - DNA, 345 bp, Homo sapiens
  misc_feature (345)..(345): n is a, c, g, or t
ccgagcattttgggctcccaagacgctggcattgcaggcgtgagccaccacacacgccttacatgcattttttattaccacatactgatactctgaccctactgaacaagagcttcaaattccaccctcaccccagaccctggtaaccactatatcactatctttctgaatttcccttcatatgaatgggatcaaacatgagttgtccttgtgtgattagcattcttacttagcatgccatcaactgctcgaacagtcactgtagcaactactacatgcccagtggcctgcaggaaagatctgcagggtcaggccactctttgtcttcagctttgctcggctccn

SEQ ID NO: 665129 - DNA, 273 bp, Homo sapiens
gaaggggtacacataaaccactaagagacatgataataagaggtacggcagggtagctataagggttgaagaatacactatggggtacaatgcacactattgtagatgggtccactagaagctcaactctcaccatgacctgctatatcgcaggtatactagcatgcagatgtagcccccagatactaaaactacatactccgaatagcgtgagcaaaaccatttgcatcgaacacttgacgacgggcttaaagcaagtgctagaacgttgag

SEQ ID NO: 665130 - DNA, 282 bp, Homo sapiens
gacagagtcttgctctgtcacccaggctggagtgtgatggtgtcatcttggctcactgcaacctctgcctcccgggttcaggtgattctcctgcctcagcctcctgagtagctgggattacaggtgtgagtcaccacacacggccttccctctaggattttgaaagaattgcaacatcaccttccataattggctggttccttttcaggaaaatgatgccatttttgatggctgatctttgtgtatgagcctttccccacctcccccttctgtcgtcttctc

SEQ ID NO: 665131 - DNA, 868 bp, Homo sapiens
gctaattttgtattttgtagagacagggtttcgccatgttgcccaggctggtctcaaactcctggactcaagtaatccactgccccagctcccaaagtggtgggattacatgcgtgagccaccacacccggcctaatgtagacattttttatgattttggaaaagggggccaggcaccaaattctaacaatttgggaggctgaggcagatggatcacctgaggtcaggagtttgagaccagcctgacaaatggtgaaaacctgtctctactaaaaatacaaagttagctgggcatggtggcaggtgcctgtaatcccagtacttgggaggctgaggaaggagaatcgctgtgaacctgggaggcagaggttgcagttgagtcaagatcacaccatgtgcattccagcctgagcaagaagagcgaaactccatctcaaaaaaacaagcaggacacaaacaacatcattggcgccacgcacgggcccctccagacaggattttagccctttttttggggccgggggccactacggactacgaaacgggcgacaacattggtcgaagaggaacccgggacgaagaccatgagcggatccaacacaaaaaaaagcgcgggcgacacagcaggtttgcccacccaaggactcacgggaccaacggcgtctatcacgggctccagagccatataaattcccagcgtggacaaaacaccgagcacagcgagacacaaacacggacagacagtacaacatccagcagcgcatcacagcagacagacaaagagaagacaaagaagcaatgctaagccggcccagtcgaccaagacgatgacaacaccaatgcacgactagccgcacagcagaggaac

SEQ ID NO: 665132 - DNA, 203 bp, Homo sapiens
atcgcaacacctgtcatctgcccgtgcgctggcgatggatcccggcgtgatgctgtttgatgagcccacgtctgcgctcgatccggaactggtgggtgaagtgctgcaggtgattaaacaactggcgcactccggcatcaccatggtgatcgtgacacacgagatcggttttgcgcgcgaggtggccgataacatggatgaca

SEQ ID NO: 665133 - DNA, 402 bp, Homo sapiens
  misc_feature (23)..(23): n is a, c, g, or t
  misc_feature (88)..(88): n is a, c, g, or t
  misc_feature (91)..(91): n is a, c, g, or t
  misc_feature (96)..(96): n is a, c, g, or t
  misc_feature (135)..(135): n is a, c, g, or t
  misc_feature (257)..(257): n is a, c, g, or t
  misc_feature (278)..(278): n is a, c, g, or t
  misc_feature (312)..(312): n is a, c, g, or t
  misc_feature (319)..(319): n is a, c, g, or t
  misc_feature (344)..(344): n is a, c, g, or t
  misc_feature (366)..(366): n is a, c, g, or t
  misc_feature (370)..(370): n is a, c, g, or t
caatcgccgttcccacactcatncattaaaagaatatggcgacataccttattggcgacgtccatggttgttacgatgaactgatcgnatngctgnataaagtagaatttacccctgggaaagataccctctggntgacgggcgatctggtcgcgcgcgggccgggttcgctggatgttctgcgctatgtgaaatccttaggcgacagtgtacgtctggtgctgggcaatcacgatctgcatctgctggcggtattngccgggatcagccgcaataanccgaaagatcgcctgacaccgctgctggaagcgncggatgncgacggagcttgcttaactggctgnggcgccagcctctgctgcaaantcgnacgaaggagaaaaaagctggtggatggcccaa

SEQ ID NO: 665134 - DNA, 467 bp, Homo sapiens
tctctatccttatctaactcctgattcttgatatttttaaaacataaatgtagccagtcataaatacataaatgtcaaaagcatctagcagatatgacacattatgtatagaggaacactataattatggcagatttctcactggaaacagagttagctagaagaaagtgcgtgaacatctttatagagtactgagagaataaaggcaatgtgatgaatttctcagacattgcaaaggagaaagaatttatcaccagaagacctgtattacaagaagtgttaacagaaatcttttacagagaagaaaaatgctgtcagacggaattctgaatctacccaacaaaggaagagcactggaagtggtggctatgcgggtagatacaaaatacttttggccttttaaaacacaaatatccttctgagatataaccaaaagcatccagacaggttcatcagttagaagttat

SEQ ID NO: 665135 - DNA, 196 bp, Homo sapiens
gacctgttatctaataaaaaaaaattttgaataggctgggtgtggcggctcacgcctgtaatcccagcactgtgggaggctgaggtgggagatctcttgagccctggaattcaagaccagtctagtctgggaaacacagcaagacccgcctcgctgggcgcggtggctcacgcctgtaatcccagcactttgggag

SEQ ID NO: 665136 - DNA, 298 bp, Homo sapiens
cccccggttatgcatgtttcccccgagacagagtctcagcttcagcccaggctggagtgcagtctggccaatctcaattgctcactgaaacctccgtctcccaggttcaagcaattctcctacctcagcctcctgagtagctgggactacaggtgtgcaccacaaagcccggctaatttttgtatttttcgttgagacagggtttcgctatgttggccaggttggtctcaaacttctggcctcaagcaatccagatccacctgcctcgacctcccaaagtgctgggattacaggcgtg

SEQ ID NO: 665137 - DNA, 152 bp, Homo sapiens
cggcggtagttggcacaagctcagagccacatcaacactgccccctacccagcacccacagccctcacatacccctggacatggacccagggagagccagtgagaaagcaccctccctataggaactgaggagtgggcatcaggcctgagga

SEQ ID NO: 665138 - DNA, 122 bp, Homo sapiens
  misc_feature (29)..(29): n is a, c, g, or t
ccactgaaattctcagtgaaggtgggaanacaggggtcttgcctttgtcacccaggaatggaagtacagtgggcacaaatgaaaagctcactgccagccttgaacctcctggggctgaaagt

SEQ ID NO: 665139 - DNA, 111 bp, Homo sapiens
ggcccgccgtcacaacatgcacaggcgccgttcacaacatgcacagattaaacttcacctacaaactccttaatatgatctgtggagatagggtgggtgggggggggaggg

SEQ ID NO: 665140 - DNA, 339 bp, Homo sapiens
gactgtgtaaacgacatcaccaatattgacacttcttactgagtgctggaaatatagccagttagtatactaaggctctgaaacgatgagggatttatttccacataggatttatgatgtgtcttaatgtgataccgtttagctctgttttgaccatatttatgtgcctctctgttgggttaacaagtccagctttgacatacttcctgtagtcatcgtttcttaagggttgagtaattttatgccttatctgggacctcatgatatcatttatttgtaaacggtatttggaaaaaaattaatttgagatgccaaatggtattatttttcctctgatga

SEQ ID NO: 665141 - DNA, 1575 bp, Homo sapiens
ggcacattgctgctgcaagtagaagttcagtagaacgatactgttagcaggactacagaaacgttacattgatgcttctctgatgcaaaatccaaagagtttgcacatgatcatcaagattggccgtactcactactcagagatagttctagattgccacttactcttgggccatggaatttcatgtggttatcgtctcacaccaacgataaaagtatgcacatgacaagcacatacaacagctgtcatgacctacagaatctatgagtctcgctaggttgggtagggcgactgcctgtttcgcgtgacaagggttaacacctacgtaggacatatgcgtcgtttcgcagtacactagggttgctggccaacagagtgagttttgcaggtttaccagcgtgccttgccctttatagctgcagctgccttccgtacattaacattgttgaatgctcttctgtggcctgtctacaatgcatcggcctactgtggttggacggcctcagattgtggagccacatgtacacaacttacttggtccttgacaattcttgcacttgtcatgaattacgctgagactgaatagtttccggagttgctataggggattccttggtctcgccttcgcgcttcccagggtccttggggtcgcaatctgcattccttgtgtcctggaacaacaattggacacccttgtgacaacgccaggtactccaatgtgcgcatagggcataaagggttgaaattccactaatcctccaagctgtttgaaatatcccacattgaatcgccatttgcgaatttgccgaggtcccccaattgcttctatttagggcgggaaaacccaaataggtttgccccgttgtccaaacttgctcagaacaagcgtcgaccccataatggggtaccacttttttgggaacgcttttggaacactggtcttctccaaaaggccccaacactcgcacttcgcactttgcacatacacaagtgtggcttggtttacgcaattttcccatggccgcaacggcattgatcatagaggcggggacaatccgccgtttcccagcatccttccccttctctaatctacgaacaaatatcccttgggcgaatggcttcggtgcggaaaagttccccccgtgggccccaaaatttaacatagcgcacaacatggggcaattatcacaccacaccggggcctgttagttggacacattgacatgcgtccttcttgtagacgcggcgcttgagcgtgaatatcaaggccactccctacagaaatttccctcgcaataattaagggcgctacttggaaccaaaggggccatagcctgaaaagaattctgggcctcaacgtaataccgcttccagcagaaacaccagtgtggggatttctaatcacccgtttaaagccgacacaacacgctggctctatgttcgtaaagctttgtgggcgtatccttctccccaaaagaaatcctttgttcgtaccggaatcctgagggcgaacacaacacataagagggaccttcgctgagtggcccccacaagcgtcgcttctacccttaccat

SEQ ID NO: 665142 - DNA, 204 bp, Homo sapiens
tccctgcagctctcttacatgtattgccatccgcgaggcagccaccagcaacctgaagaagctagtggaaaacttttgggaaggagtgggcccatgctacaatcatccctctaaggtcttggccatgtccggattaccccaactacctgcaccgctattactacgctgcctctgtcctcaactgtgcatgtctgagagtctgtg

SEQ ID NO: 665143 - DNA, 222 bp, Homo sapiens
  misc_feature (92)..(92): n is a, c, g, or t
aaaaatttttcccggggggaggggggggggcccccggttttttttcccccctttttccccccggcccccctcccaaaaagggaatttttgtncaaaaaaaaaaaacgggggggtttttccccggggtttttcccaaaaattttttgggggttttttggggggtaaattaccccccgggcaaaaaggggggggttccctttaaaaaaaaaaggggggggttta

SEQ ID NO: 665144 - DNA, 392 bp, Homo sapiens
actagtccaaccatactatatcagagaaaccaccaagctgaaatgacaggattccactgttttgcaccctaagtccacagttatctgtaagggtccaccaattcagcccttctcaacctaagaaaacaaagctcgtgctgttgattgcacctccacagctgtccgttaaacttcaggagtttattatctgcttattactgacatttgtattttgtcagatttgaccaattttattaatttatctttaaaggactttcggctatttaattatacaacaaatttgctataatcaagaacttctctattcaatcagattagagttattaccataaaatcttgatttacttgcctccctcttcaattttcttacaattaaagaccatactggcagg

SEQ ID NO: 665145 - DNA, 440 bp, Homo sapiens
acggacgacgagtcctcgtgtgcacccaggagggaagaggcagaagggacagcaggagccacctcatgtaagtgtgaaacatcctggggtgtgtgtgggaactacaagctgtttgagattaaagaggctggagtgtgaggcaggatggtgattgaggctgagcggagagggcagctggagcagcctgcgtgcgtgatggagtgactgcattattctcattcttcatgtgtttgactttaggagctaagtagtttagttcatgccatttagcaaatgctgatttgggattatcatggaagactgatgcctaggttaattttggaaaatgctcaccagagatcccactgaacttttgcgtcttcagtactttataagcatgggtctggctatgctcccaaaacatttcatggagttcacagctgttcttagggtatcctctg

SEQ ID NO: 665146 - DNA, 773 bp, Homo sapiens
atttcagggacctcaggtgcacctccggctgcctagccctccccccagctccctgcaccgcgcgcagaagcatgcccctcgaggcctacatgaggaggcctcaaagcaacccgctggagcccacagcagagcctgtgccttcctccccgcctcctcccactgggactcccagcagagcccaccagccagccctggccctacccccctaggctccagagaagcccctgctaggggctgtctgggtgtccgccatccagggtctggcagagcctctgagatgatgcatgatgccctccctctcagctgcatgctgcaggagcccctgtgcccacttccctgcgcccttgaggggccccagcgtctgcagggtgactgcctgagacagcaccactgctgacgagagtctgaggactgtcctccacgcaagacctgcaactgaggggccctccatgacacagatgaggggcccactgacccaccctgcgcttctgctggcacgcgcagggtgacttcttggggccccaaaggtgcccatgtggcacggcacgcgtgctgctcgtggcacaaaatcgtagagagcttgcacccctccgcagcatccacgcgcctcacaccatgcggcaaagcgccttagccttgaaatgtccccagtcgcctcgttcgagagagaccccacggacggggacttacgcaaggccgatccacatggagcccagacccttgccttccactgttcctacaccccagaactcagcgaaacacaagggcctccc

SEQ ID NO: 665147 - DNA, 117 bp, Homo sapiens
actagcagatcacagagggccaacattaggagagagtcaggacagggggtcctgagagcagtagggactgagccttgggtccagcagcccctcctctctcctgcagggaactgccgg

SEQ ID NO: 665148 - DNA, 1003 bp, Homo sapiens
  misc_feature (91)..(91): n is a, c, g, or t
  misc_feature (238)..(238): n is a, c, g, or t
  misc_feature (388)..(388): n is a, c, g, or t
  misc_feature (909)..(909): n is a, c, g, or t
aggaagttttactgagagcatatcgtgatgtgcgctgcagggtcctcagtgaagatgtgttgcacagatggctcaataagctgggttcccntcaggatatcctgggctcgatgaagtagctgcttgggagttctcgacggagatagagatagaacgcagcggcgcgtaagcggatagcagctatgcaaacaacgtgctcaccgatcgtgcaagctatgctcgagcgcttcgagtgaantatcggaagtgcctagtgcaaatcgaaggtacgtcactaccggtcggagggcgtacaggatcagtacaagagtctcagcggcctcccgaacggcgtgaaaacaaggaagggaggtcggtgggaggctggtgaccaattgtaggagacacncacccattgggatgagtatgatgggcatttgttgcggcataccggtggaaaaacccactccgagagccttcacgggaccccttccaactgaacttgttcgttttgcactggagcaccaatcacgtggattgaaactgcacagaaagggccgttttcctattaaggaactttgggccataaaatccttaaggaacgaacggcccttttaacccaaagttaactggcaacagaaacactgggcagcgactgacgggacatggccaacggaaagccagccttgtgaagaaagggaccttttcagggcacgcgattgaacagacacagttacctggccaaaaggtcaattccgggtgttccatttgccccaacaacccccagaatggccgcctgggctgtccttctgggcgcccaagaaaagaaaaggggccccacccttggaaggggaagaatcccagggttgaaaccgggaggggcaccttgttgggaccagaggacaggctagggaacttgggggccccggncggaacgaagggccttgagagccaggcaagggtaacccctgttggaaaacccaaaggtaggttttgggcgcaagggcattgacggcactggatg

SEQ ID NO: 665149 - DNA, 884 bp, Homo sapiens
gtggtggggacctgccgcggtggcaggtgctctgagagccggtgccatcgggtgcgcgaaggaccgacggatgtcacgggctgggtgctgtgtcctggtgatgccactggatgcgctggccctgtgggccctggtggtgcgcgggcccggggttggtgcttcccacgtgcacgaccatgtgagacctgtgtgtttgcgaggctccctggggctcaggcttggacccgcgatgggggctggagcctgggcctccataaacgggggaagctgacttggtcctagcggagacggataagcatcgggaggggtgcgccgtcatcacaaccccccattagcccgtagaaactcgaggaaacaaccaccaccaaaacactataacgcattgtacacgagtgccaatgagccaaaagccacacacagctaagacagaccagagaaggagaaccaaaaagaataagcagaggccaagagcattgtaaccaggcaacaaccaaacacaaatgcaacttggggagcatgtaaagcacaatgaaagatagagactacaatgaatgaccaatcatcacatgagataaccacgaccacccattaccacaggtggacgagacaatacagcttgaaccaaagggacttggcaataatcccatggtcacatacaagagaaaaacccaaacaataaaaacaacatgaaagacactagaaaccgccgctaaaaccgaagacaaccagaagaggaagaacaagagcacaaaccacaattgagaagaaacaaatgaaaaaacaacacacacaaggaaggcaaacgaggggaaagaagaaaaaaaattataaacaaagtaaacggaagaagtagcaaaaaaacaacacaagaataaaaaaacaaa

SEQ ID NO: 665150 - DNA, 175 bp, Homo sapiens
ggcccgggggcccccaggcccatttgggaattttttttttttgggaaattttttttaatttttttttccccggggccccttttttttttccttttaaccccaaaaagtttgagaagatttttggaaaaaaatggttttttccccaaaaaaaaaaaagggcccccctttttgggga

SEQ ID NO: 665151 - DNA, 255 bp, Homo sapiens
tgactccaggatacccctcagctgagcacacgagtgaattcgtcccaaaaaaaaaaaagagaaagaaagaaagaaagaaagaaaacttgggcctgctcttggccaggcacaggtggtccatgccttgtaattcccaaccccaaacccttttgggaaggcacaggttggaagagatggcttgaggtcagaaaatttcaaggacccagacttgggcattacaggaaaaattaccaaaaatttaggcttgtgcattga

SEQ ID NO: 665152 - DNA, 315 bp, Homo sapiens
ccccccaaaaaaaaaaagggggggtcttgggggtttgggacaaaaaaaccccccctgggggggggccccaaacccccccctttggggggaaaaaaattcccccagttttttttttggccccccggccccccccggggggggggggggccccccccttttgggggtttttttttaaaaaggaacccccaaacccccccggtttggggggggggggggcccccctttttttgggggaaatttgggggggggggaactttttggccccccccgggcccccccccttttttttgggggaaaaaggggggtttttcccca

SEQ ID NO: 665153 - DNA, 907 bp, Homo sapiens
ctggacatgggctccgctccctgggccccggtcctgctgctggctgctcgggctgctgcggctccatggcgggggccctgcaggggccccggaccccgcgcttccaggagctgcttcttccatgcatggcgtctggaccactttcaacttcgatgcgcttcggcaatcaagacctatccctcagctgacttcctggtgtcaggacacggttctgggatccggggtcgaggggcccatcttacttctacactgggaacgagggcgacgtgtgggccttcgtcaacaactcgggcttcgtcgccgtgagcatggctggccgagcggggtgggctctactggtcttcgcggaggcagccgcatacgtacgggaagtcgctgccgttcggtgcgcaagtccacgctaacgcggaatcacatcggagactgctgacgggtggagcagtgccctgagcctgagcttacggcagagctgctccgtcgcgtctacgacgcgaggctcgtgaggcccaggatgcccccggccatcgccttcggtggaagtaataggggggatgctcagtagccttacctgatgatgaagtataccccacctggtgggcgtggggcgctgtggccaagtgcgcgcgttgctaacttgtgtgcagagcctctgacgagtccgaaccaagtttctttccgggacgtcaccgtgcgtgactttgaagcgggccacgaagacccaaatgcacccaggggtgtgacgggaaacgcgtttccgaccagatcaagggactgtttcctactgggaacgccaacacacggggccgatgagaaataggacctggcagtccgtttcaaaccgaaatggactgaccggccataattacgcgcggaaatctaacgggctggacatgttgaatccaccatg

SEQ ID NO: 665154 - DNA, 325 bp, Homo sapiens
  misc_feature (26)..(26): n is a, c, g, or t
  misc_feature (242)..(242): n is a, c, g, or t
cagttccaaagtcgcttgcatatttncaggtatcttcagcaacgccccactctagtggtatcagtttactgtattagtctgtttttgtgttgctgataaagacatacctgagactgggaagaaaaagaggtttaattggatttacagttctgcatggctggggaggcctcagaattatggcaggaggtaaaaggcacttcttacatggtggcagcaagagaaaaatgaggaagatgcaaaantggaaaaccctgataaaaccatcagatctcgtgagatttattcactaccatgagaacaagatgtaggctgggaggctaggctt

SEQ ID NO: 665155 - DNA, 102 bp, Homo sapiens
aaaaaaacttaaaaaagaaagagaggctcttggcgataaggctccaccaaagcctataacccaaggaccctttgacaaccaagcgagttgtattaatgaaac

SEQ ID NO: 665156 - DNA, 168 bp, Homo sapiens
cagttacaacagcgtactgaaggggaggaagaaatcaccagtgcgactctcagcctccctggcgagctgcaccgttcttggcactgaaactccagcccctctcactcacatgtgtggcgactgaggctcagaggaggtacggcacacggggctcagatgcttactggc

SEQ ID NO: 665157 - DNA, 348 bp, Homo sapiens
agcgtcctgagtgcgagccatcctcccacctcgggctccgaaagtgccgggactacaggcgtgagccactgtccctggcccctaaaacataattttatgtttgtcttctgaatgacgatctttgacttctgttcacttgcaaattaaagttccattttcatcacatcagtgtcacaattttaagtcatcaaaagtgaaaatttctgtaacattaacaagtaaaaaatttttgtacaatttttgtaaatacctttcatggatatactcaaaagggcagcatcataattccatccatatcgcaatggtttcgcaaatgcaacattctagtacaaagagtcacataaacac

SEQ ID NO: 665158 - DNA, 309 bp, Homo sapiens
  misc_feature (37)..(37): n is a, c, g, or t
  misc_feature (87)..(87): n is a, c, g, or t
tgaaggacaattttagtacacaggcatttaaaaacanaaggctgcagagaaagcacttaccagaaaggtctgattatagaagaaagntatctccatttaatttcatgtatagtaaccactgtaaagcttgggcttccgttcacacctaataaaggtgagtcagctcaccagttttgacatatctagagccttgtttgtctccacaataaattcctcactatctttagctggtgacatttgttttttgtttaaatatttgcaataaagatgaaagaataaagcagcagtgatgcaattttgtaaaaaaaa

SEQ ID NO: 665159 - DNA, 565 bp, Homo sapiens
agagatcaagtctcgctccgctgtccaggctagagtggagtggcatgatcatagctcgctataatctcaaactcctgggctcaatcaatcctcctgcctcatcttcctgagtagctgggattaccggtgtgcaccaccaccatgcctagctaatttttcaatttgtttatagagatggttcttgatatgttgcccaggctggtctcaaactcctggcctcaagcaattttccagcccttagcctttcaaaatgctggaaatacaggcatgagccactgtaccagtctactgttcttatccctcttttccttaatgggacttgctggtttatttttattttatttttggaagacagagtctcactctgtcacccaggctggagtgccgtgttgctcactgcaacttccacctcccgagttcaagctattttcatgcctcagcctcccgaggtcaagcttttcttatgccctaaccctcctgagtagcctggaattaccgggtggtcggccccccatacctggactaaatttttgtattttttagaaaaagatggggtttcccccct

SEQ ID NO: 665160 - DNA, 106 bp, Homo sapiens
gaacctactggatctcattgaactaaaacacaaggcaagagataaaccttatgatagtaagaagtttgcggactgcacttcagaaggagatcacaacgcgttatca

SEQ ID NO: 665161 - DNA, 535 bp, Homo sapiens
  misc_feature (3)..(3): n is a, c, g, or t
  misc_feature (40)..(40): n is a, c, g, or t
  misc_feature (43)..(43): n is a, c, g, or t
  misc_feature (82)..(82): n is a, c, g, or t
  misc_feature (85)..(85): n is a, c, g, or t
  misc_feature (102)..(102): n is a, c, g, or t
  misc_feature (105)..(105): n is a, c, g, or t
  misc_feature (143)..(143): n is a, c, g, or t
  misc_feature (178)..(178): n is a, c, g, or t
  misc_feature (180)..(180): n is a, c, g, or t
  misc_feature (186)..(186): n is a, c, g, or t
  misc_feature (190)..(190): n is a, c, g, or t
  misc_feature (194)..(194): n is a, c, g, or t
  misc_feature (196)..(197): n is a, c, g, or t
  misc_feature (209)..(209): n is a, c, g, or t
  misc_feature (222)..(222): n is a, c, g, or t
  misc_feature (234)..(234): n is a, c, g, or t
  misc_feature (236)..(236): n is a, c, g, or t
  misc_feature (269)..(269): n is a, c, g, or t
  misc_feature (271)..(271): n is a, c, g, or t
  misc_feature (275)..(275): n is a, c, g, or t
  misc_feature (277)..(277): n is a, c, g, or t
  misc_feature (282)..(282): n is a, c, g, or t
  misc_feature (286)..(286): n is a, c, g, or t
  misc_feature (307)..(307): n is a, c, g, or t
  misc_feature (312)..(312): n is a, c, g, or t
  misc_feature (318)..(318): n is a, c, g, or t
  misc_feature (338)..(338): n is a, c, g, or t
  misc_feature (354)..(354): n is a, c, g, or t
  misc_feature (373)..(373): n is a, c, g, or t
  misc_feature (392)..(392): n is a, c, g, or t
  misc_feature (403)..(403): n is a, c, g, or t
  misc_feature (410)..(410): n is a, c, g, or t
  misc_feature (412)..(412): n is a, c, g, or t
  misc_feature (438)..(438): n is a, c, g, or t
  misc_feature (448)..(448): n is a, c, g, or t
  misc_feature (463)..(463): n is a, c, g, or t
  misc_feature (473)..(473): n is a, c, g, or t
  misc_feature (534)..(534): n is a, c, g, or t
tcngctgtagacatttattgaatcatctgttgccccaacngcncattgtatttcccagaagattggccacaggcaaaataanatnacccaccacaaatccgnttntggggggcttcttcagctccttagtcatccagtgttcnctttggcaaacagaccagtttacagacttttgttncnaatccnaggncccntnnccccccgtagcnttccggctagagngagacacgtttntnctttggtagtttgtctaaggcggagttttcccncntgtnanccttncccnatccaagtgtgtgccagctgnttggngacctnacggcacccctacccctgangagtgtaccgtctaanccgggggcgaaccctgtcntccggacaggctgagaggnggcggggaaangggctcnanggcgcctgggccgaccctgctggggnggggcctggnctacaaccacctgcncccagaaatnacactgccttaggccggagacccagcaaaagccaactatgggaaatctgagcattagaggng

SEQ ID NO: 665162 - DNA, 159 bp, Homo sapiens
ccctagcacacctttgcatgccatagcaactagcagttgggtttttagttttgttttctgtctgttttgagaggatgtgtgtgtggggggtctcactctgttgttcaggctagagtgcagtggcacaatcacagctcaccgcagcctcgaacttccagg

SEQ ID NO: 665163 - DNA, 409 bp, Homo sapiens
gcttgtgatcccagcactttgggacgcgaggcagggcagatcacctgaggtcgggagtttgagaccagcctggcaacatggtaaaaccccacctctactaaaaatacaaaattagtcaggcgtggtagtgtacacccataatcccaggtacacaggaggctgagacataagaatcgcttgaacccaggagacgggtgttgcagggagctgagatcgtgccactgtactccagcctgggtgacaagagtgaaactccatcttaaaaaaaaaaaagtgaacccttgtagtttcttcctctgtttgacagagggaccctaagagggccccagtgataccccacctcctggtgtccaaggccatgatgttgatcacccttcccccaccttgaatgtaggtggcacatggaact

SEQ ID NO: 665164 - DNA, 394 bp, Homo sapiens
cgttctgggagacagctagtagccaaaaatcgacagatgcccagagcccatccttctgcatacgagaatcggatgttacgttccacgacagtcagaatctgaaagaagggactacacgaaatttgggaaatgacatttgatctcatttgcctctcaattggaagtcatgatatcaatgaatatcagatggaaaaataagctcagaagtaggtgagaattatgatctctaaaacgcaggtcctgatttctaatccttctcacaaaattccggatcacaaattgcgggctgatgagaagatcttacaccgaagcgactaactggcactaatgtgagtcagcaacatgtgacaaggctaatccaggagatgcagaaatgcacctgaggtccaggtgt

SEQ ID NO: 665165 - DNA, 252 bp, Homo sapiens
acaggcaatttaacagttaccacatctggacttcaatgaatacacagtctgggtagagtcttctaaaatggataattaccaaactacattagaaaggcgagcactatttgtggtctaacgtcaagagggaaacaaatcagattataaaaccatctgtacattatgattggcactctaaacatgtgagagtgtgaacaaggtctgagacgggtgaatacagggaatgacaatattgaaccggatagcttgccg

SEQ ID NO: 665166 - DNA, 345 bp, Homo sapiens
acagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagcccctgcacccagccctgtattcttattcttcagatatttatttttcttttccctgttttaaaataaaaccaaagtattgata

SEQ ID NO: 665167 - DNA, 542 bp, Homo sapiens
acttgcttcctgcacttcttgttgttgatggtttgtttattttgagacagtcttgctctgtggcccaggctggaatgcagtggtataatccggctcactgcagccttaacctccaatgatcaagcaatcctcccacctcagcctcccaagtagctgggtctacaggcatgcaccgccatcatgcctggctgcctggtttgttttgagggtttttgtttgtttgtttgtttttgtttttagagacagggtctcaccatgttgcccaggctggcctcaaactcctgggctgatgttatcctcctgccttagcctcccaaattaatctgttctatatttccattattttgtcatttcaagaatgttatgcaaatagaatcatacagtcgggaaccatttgggattggcttttttcacttagaataattctctggacattcaccgaggttgctgcatgtatctatagttcattccttttcattgctgagttggattccatggaatggatgtgccacattttgtttaaccatttatcttgtaaaaga

SEQ ID NO: 665168 - DNA, 126 bp, Homo sapiens
gcgccgtgttgcgctcaactgtggtagaagacgtggtgtggccacatagttctcgtccagctgcttaaaggaggaacggaccatgctggaggacatctgggtgacgctgtacgagctggacaatgt

SEQ ID NO: 665169 - DNA, 287 bp, Homo sapiens
cagactgctctaacagaccctattcaatatgcctgcaaagactgattgaaagacggagtgatccagacagtgtactaacatctgataagccattcccttcacagtcacatctgtgtactgcatgtagccaaactatgccatggtcttctctgaccatcactggccactatcgaacactctctatctgcctatgcctatataagctacacagaacatcacacagactttagcttactgtagattactacaaatatggacaattaggacagatgggtcccggctcccgc

SEQ ID NO: 665170 - DNA, 180 bp, Homo sapiens
  misc_feature (78)..(78): n is a, c, g, or t
cgagggtaaggcggactactgcgtgaggaggtactgttgtagcatatagagctctccctagcttggttatggaggctngaggttttgaaactgacaatttaagccataagatctggtcaagggatacccttcccactaaggacttggtttctcaggaaattatatgtacagtgcttgctg

SEQ ID NO: 665171 - DNA, 1641 bp, Homo sapiens
cggcacgcgctgggtcgaccacacgcgcttcgcggcacgcgctggggcgccgccacagactgtaggtgctgcctagtgtttacgcgctggctctttgtccgggcgttgagcggcagctctagcctcccttgtctagtccgagattcgcctgttgcgtggtactcaacggtgcaccatgtatatcccgacaggctcgagcagcaatgggctcggcgagatcactgcccactattttttaacaacgactcggccattcccgcaggctcgcctctgcgcaacgctcggctctagcaagctcgcttcacacctcagcacaacacagcacagtaaaccgtgcgacgcatgaccagtacggctctagcaagctagcacgcactacggcacgactcagcgcaagcgcacgcagcacgcacggctctcagataacgccacgcggcactacacacacggacacggactcctccgcgctcaaacggggatccaccggcaccgcccgctccctgaacgcaaccgcctccccaacgaacagcctcacaacgccagcagcaccatccaggacaaggcccggagcaacgccggaaacgcaacacgcactcttccgacagagcctaagaaggaacgacgcgcatgcatcggcatcgacacgggcacgccttacgaacagctccccgggcgtggccccgtgcctctcacatcccccgaacttcccatccgtggccttcccacttgcacaccccacctactatcacacactccccaacccacaccaactcccttggacaagccaaaattaagtgcaccttcctcaaaggggctacccccaacaaacacgcaatcaccaacccacccttgtactttgcgcacttgctcgacaccgcaaacaaactcgatataccatataactacatcaaaatgcaaacacagcaaacacacacaacacacacgcaaaccaccaacaagccatctcgctaacacaaacacgcccgcaacgctgcgcactccaccacacaccccatcccgcgacaccacccgaccggccaactccgccctcaggcggccccaacaatcgctccgctgcggaacaccccacacgccaacactctcaccgcctcttcgggctgcacatcgccgaaaacgccaacacatactcttggagcgcacacgacaagcgacctagcgtacacacacacgatcaacaacgcagcgttcagcgtacaacacatcccaccttggtcaccccgaacgcccaccaaccacaccccccaacaccgcgcactcatcacccaacctagcccgctccctacctttcgccaaacacacaacccaactatttcaccccccgacaacccacctctaaccacaatcacaccctgcaacaaacacccccaacatcctccacccactctccatcacctccaaccacaatatctaacatacagccgcacacactcccacacacccccccccccattcatttcactcctactctacctaccaccagcttccaccacttcactacaactcctcatccaatcagtccacactcactcaataactcacattctatcaccatacgtaccactcagcatcaaattcatatcactcatatcctaccaacacacacctactccatcactactc

SEQ ID NO: 665172 - DNA, 177 bp, Homo sapiens
ctgatgcccgtgatgcgagaaagtgttgtgtgtgtgcgcacgtgcgacgaacgtgtattatgtatcgggctggtgtgtgtgccgtctgcgtgagtctgtggttggggtatgggttgtagtttgttccccggtgggtttggtggaacaggacactgggttaaaattctcattctggtc

SEQ ID NO: 665173 - DNA, 274 bp, Homo sapiens
ctcttagccgacctttgtaagtaagggttcaagggcggggggaaagcccgggaaatgaatggggagggggttttcaaaaaaaagggcccccattgggggggttagggggggctcccccaaatacaaggggggggggccgggggggtttccccccccggagggggatttttttttttttggggcccctttttttaaaaaaccccccccgagggggggccccttttaaaccccccgggagggtttttttctcgcgggggggggttttttttttttt

SEQ ID NO: 665174 - DNA, 304 bp, Homo sapiens
aagtcctgagggctgacatacctgtactgcttccaatcatgggccaccgtcttgaggccagggaatctgcctgttttgttcactagcaagcttagtgcctgtactagtaagcttagtacataccgaaataagttgataactcacagatgtgttgcagggatattaactggtggtatagttccacactttattgattgattgattgagatagggtctcactctgtcccccacgctggagtgcagtggtgtgatcattgcagcctcagcctcctgggttcgggtgatcatccacctcagtctccca

SEQ ID NO: 665175 - DNA, 825 bp, Homo sapiens
tcgatttgaattcttgattttaatttaaacttagttttcatttgttcatactcaacccactcaaaatgagtgtcatttcaaatctatgtataggcctgaaggctgtccagcaggcattccaaagccttgggctccgtggtttgtctccagcttacacaccctagtgggatggcttcagtcttatcctggcttaccaagcgagatatatgcacgacagaacatacgtgcaatatctgtagcagcccactgctggatcacggggctgttgtatccaccagcaagtgcacaattgagatacctgatgggtctctgcagctgctccagcccctattcacaaccagtttccagctggaaaatcagcctgccattcatgaatgctagcacctcaattggtctgtttaatcctggagccaatcaaacataggatgagatagaatgacgcgaaggtagtccctaaaagtaggaagaagatgcacacaacaacatcgtgagaaaacgaaaggaatattgccgagaacaacaatctagacttgtttcgaatgtcgacagttttatctccaacctggcgcaacgacttacccgataaagcatcgagttcctatcgaaaatggcaaagcgggcccacccagatgcggagtagatgctaacaacacgttgattagttatgcacgtgttgaccaattaccgattactggatgatgcctcgaaaatgaaaacccacccacccggacgagtatcaattgaccccgtgcaggaaacaaccatggaccgcgtaatgtcaaaagtcgaagtggacccgaacagttgcctctgacaggaatacgt

SEQ ID NO: 665176 - DNA, 423 bp, Homo sapiens
taacgtattgaaggaaaaaattcaaaccagacagagaggactggaatatataactagcgcttcagtgcaaagacacagacctacatcatgagaaacaacagcccactaggaaccataacctcccccacccaaaaaaaaaaagtcactgaccatagcaagatagcaatatgtgagttctctgaccaagaatttaaaatagaagttttaagaatatgcagtgcatagcaattcacaaatttatgaaagtaatttaacaaataaattgaaataatttttaaaaatcaaatagacatcttaggaatcaaaaatgaatttgctaaactgaaaaactcattggaggctctgaacagaagaatggaataagcaaaggaaagaatcagggcgcttaaacacaggctatttgatattacactgttagagaaa

SEQ ID NO: 665177 - DNA, 479 bp, Homo sapiens
  misc_feature (441)..(441): n is a, c, g, or t
tatggtggctcacgtctataatcccagcactttgggaagccgaggcaaaacgatcacttgaggtcagcagttcgagaccagcctgcccaacatggtgaaaccccatctctactaaatatacaaaaattagccgggtgtggtggtgtgtacctgtaatcccagctactctggaggctgacccataagaatcgcgtgaacccgggaggcggagcttgcagtgagccgagatcgcgccactgcactccagcctgggcgacggagcgagactccgtctcaaaaataaaaaataaaaaataaaaatacttatacacctaacactattgtgcacatacttactgttcttatacaactaaagccaaaacatgtcacaaatacttgatggatgagatagacattatatggattctttttgaatctgtaatgcatgcttttactggattntattagggcattctctgactcccaatccagattagtcc

SEQ ID NO: 665178 - DNA, 472 bp, Homo sapiens
  misc_feature (1)..(1): n is a, c, g, or t
  misc_feature (19)..(19): n is a, c, g, or t
  misc_feature (34)..(34): n is a, c, g, or t
  misc_feature (100)..(100): n is a, c, g, or t
  misc_feature (108)..(108): n is a, c, g, or t
  misc_feature (459)..(459): n is a, c, g, or t
naatttgggggaagtaaanaccccatccttaaanggggtggtcaaaaaacagccttaagtcaacttcctattttggtttaatgccggctcccctcctccnaagtaccnacttcccttgggctcccatccccagataaaagaaatccaaaggccaaagcactacctcacaaaatgagttgctgaagacttcccacgataaataggttgttccctgagctcctgtttcccaatagacatttctccaatcttttttattttttattttttcttgagacagagtctcgctctgtcgccaggctggagtgcagtggcgcgatctcggctcactgcaagtccgcctcccgggttcacgccattctcctgcgacttcttttcttatttgccttatttcttgaaattctttctcttgcctgattgttctgactggcattccagtactatgttgaataggagtggtanatggtagacatcc

SEQ ID NO: 665179 - DNA, 105 bp, Homo sapiens
gtcctgcttctttccaatgactaggagcagcccagcctccttcctgccaccccctgcgcctgggcagtgccttgcgtttgatgttacctccacaccatctgcctc

SEQ ID NO: 665180 - DNA, 345 bp, Homo sapiens
cgcctactactactaactaaattcgcggccgcgtcgacctggtcggcgtagcgcccgaacggataccgcgactccagtgccttcagctttgccgtagcgctggtgtagctgtggttgttcaggtcggtctgagcttgttggtacagctcgacctcgctcaggttttcgtcgacgacttcctttgttgacgagcaagcagcagtcatggcgaggatggcgatcagcagcaggtgtttcacttgcatggcggcttgcgtccctatgacggccgctgtcttgggcggggccgtcctgttatgatgagcgccccttggagtcgacgcggccgcgaatttagtagtagta

SEQ ID NO: 665181 - DNA, 213 bp, Homo sapiens
  misc_feature (12)..(12): n is a, c, g, or t
  misc_feature (97)..(97): n is a, c, g, or t
gggccccccgangccgccccatttcccttccagcaaattcaattgggcaatccaagcccctaaataccagcccaagtcggttaatccctgtttggantgagcccccgttggcttttgaactggaattttgcagctaccccctccccgactagacccttaggcattggggagttttaaatggactaattttattaaaggattgtttttttttta

SEQ ID NO: 665182 - DNA, 271 bp, Homo sapiens
ccgcaaacgtggcaaaaccccatctctacaaaatacaaaaattagctgagcatggtggcaggtgcctgtagtcccagctactccggaggctgaggcaggagaattgcttgaacccaggaggtggaggttgcagtgagttgagattgtcccactgcactccagcctgggtgacagagtgagactgtctcaaaaacaaaacaaaacaaatgaatgtaaaacatttagtgaagtgactggtagctagtggagggtcattaagcgcttatatgac

SEQ ID NO: 665183 - DNA, 147 bp, Homo sapiens
aggatccctacgtaatatgtactcaggtgatctgctgtctcgggctccagaatgctgggatacgggtgtgagcacagtggctgggccggacttctttttttgagatgtgtatttcttgtgaggtaggaaagctcgggtcctttgact

SEQ ID NO: 665184 - DNA, 359 bp, Homo sapiens
  misc_feature (15)..(15): n is a, c, g, or t
  misc_feature (22)..(22): n is a, c, g, or t
  misc_feature (96)..(96): n is a, c, g, or t
  misc_feature (116)..(116): n is a, c, g, or t
  misc_feature (133)..(133): n is a, c, g, or t
  misc_feature (192)..(192): n is a, c, g, or t
  misc_feature (213)..(213): n is a, c, g, or t
  misc_feature (222)..(222): n is a, c, g, or t
  misc_feature (354)..(354): n is a, c, g, or t
tggatgttgtagagntccttgngggtagtcccgggtggagccccatagctaactcgatggagtgcagagcctgggcccagtgggacattggcatanagcatggcatgtgttgcatnactggcgtactggtggncttgtggatgtccatctcactaggcagtccccatgtgccttggattctcacattttctnacttacctttccttggaacancgtctggtnagtatctgggggggggctgctatttgggatgaagactcttcctataatcctgtaggcctggagaggggatagctaggtgaaagcggctggactcttcttggagtcactgctgcttcccacgcgaactattgntgtgg

SEQ ID NO: 665185 - DNA, 277 bp, Homo sapiens
  misc_feature (78)..(78): n is a, c, g, or t
catactcgtacttgtttgatgaatgccagttttctctgctggactgtaagccctgtgagagcaggtagtacgtctgtnttgttctctgctataccctccagtgcttagctttgtgattacgtggtacaagcacttgacactgttgattaccattctcgtaataaggtcattctaagcctgttgcactgacctgtaaaagtgcacaccttggaagagaatacagttggccttccatatctgcaggttctgcatccatggattgaacaaccacagattg

SEQ ID NO: 665186 - DNA, 532 bp, Homo sapiens
  misc_feature (5)..(5): n is a, c, g, or t
  misc_feature (202)..(202): n is a, c, g, or t
  misc_feature (228)..(228): n is a, c, g, or t
tcctnaccccattgcaagagaggatgcatctgggagagcaaagcaattaagggattcaggcatcagcctgcagagggctgagtctgggttagtcctgcccgcaggttagcgagatcctttgtgtgtttttgggttggacgggtgccgtttcaaaatagaggcacagattgcttcatgcacgagggggtcccgggcactgganacaagtgccaagttgaaggcaggggncctgccagagctgggtgtgggtattcaggccctcacctgccctgcctgcagggccagaccctgaggaaagggcgccccctgctggtctttttggatttaaaatgttgggggaaaaggttagttccagttcagttcccaatttaacaagagggaattaaggaaaagaaaagagggcgttccccggatcccaggaaagctgggctatgactgcaataaggagttgttccttcacctgagatgtgcttcttttggttcatttctggcttgacaacaagaaataaacgtggtatgttcctgaaaaaaa

SEQ ID NO: 665187 - DNA, 411 bp, Homo sapiens
  misc_feature (205)..(205): n is a, c, g, or t
ccctccaacacctctgggggctcttggctgcgtccccacaatcccagcgactgcctctgccgcctcacctctgaccttcccgactctagatgatttcattccccctcatctgcagaggtgggcccaccacagacagtcagccgcgcctctggctcctttggccccattaggcagacggcaccatccttctcaccaccacctccgntggtccctcctggcccggagggacctccgaagagtctcgggaggctgacctcacaggagcttgtttcggagtaccgattccagtcctcttactaaatgaagttttcttcttccccttattgggactgattcccaagctttccatcaagttaggaaggcttccattccgccttattcctccaaaaagattggcaaatctaactattg

SEQ ID NO: 665188 - DNA, 777 bp, Homo sapiens
ccgcgccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagcccgagcccaagcccacaagagcccctcttcactggcccaggctgaacgtctacagaggagctgcgtctgcgcatggataccactaccgagacctcatacttccaaggcatcctgagacgcaagcctgcacggtgactccacatgcacggctgcatagcgcaaagcatacactagcacctgaaccttcaatgtaccaccacatgcctgccaactgttccatacatggaacacaggaccaacaaaagagacctgctaacataggccaaccacgtgaacaaacgacacaacacaccatccaaacatacacaaacacaacggcaaaacaacacgtcacacgcaacgcagcgcccaccacgcaccccaggtgggctacacaatgcacagccgaagcagggtgagctcgacggaacaaacaaagaaccacaaggaccgccacaatcacccacagatcccacaagaagcaccaaaccacacaacacaaaccacaagacaagaacaacacacaagagacagcaaatcccacacaacccaaccaaactcacagacaacgcaca

SEQ ID NO: 665189 - DNA, 154 bp, Homo sapiens
ggcggttttggtcgttcgtttgggcggtgctggtttttcgctcgtcgactgcgctcttctcgggcagggaaggccggcggccggttcggaagaggtggcttaaaacttcggccgttggggtgaaaagaaaatggggccccgaacccaaggcaga

SEQ ID NO: 665190 - DNA, 1039 bp, Homo sapiens
  misc_feature (134)..(134): n is a, c, g, or t
  misc_feature (230)..(231): n is a, c, g, or t
  misc_feature (338)..(338): n is a, c, g, or t
  misc_feature (417)..(417): n is a, c, g, or t
  misc_feature (442)..(442): n is a, c, g, or t
  misc_feature (566)..(566): n is a, c, g, or t
  misc_feature (694)..(694): n is a, c, g, or t
accttgggtgggaaccaagggaatggttttggacggaatggccctgtgaattctaaagaaaggtggggcctgtgggtggtgtcgtgtcacagccctggtctgggtgaagaaccccaacttctgaacaggtgggncaacaacgggcaaggcccggcaaaaggcaccaagggggccaccccggccaacaagggccccgggcacgaagtgggggcaccaacttcctgtgaagnnaaccctgtgcttggtcacaggttggctaaggcccacagtgaaacaacacgaaaggttgagaaccacaattggggaacaaaggaaagggggaactttgtgcctataanaggcccaccgcaaggcaaaacttctagaccagaccaggaaaccccaaggaatggggcggccccagaggcgtctcttctncaatattgtgggccccaaaggtgcntttacaccaaacccgttaatctacaaacgggttgtgggcctatgggtctctatggaaacaccagagtctcctgtgagaccagagggggtaagaaaggggtccctttgtgaggacacgctgtganttgtggcccctctcgataatcgcacacaacatgtgggtatcctctcgcacacgtgtgtcccctgtgtctctggggtctctggcctgtgcgtatacaaggaagcggggggacaggtgggggcattctcncccgcaaagggcgcaaacgtgcctattgtgggaatgtggattggggggccctctctggggcaagtgtcaagcgggaaggggttggttacccccgcgtagggtagggtgcgaagggtgggggcctggtagagcgtcgaaccagagggcatctagggagaggagggccccaatatagtttccgtgcgttttagagccttgtgtataccacttccgggttttgggcccctgttaagggtccccaacatttaaggcccctgttgggttttaattggtctcccggcggtggttgggctctggggtgtttcccccacgctttcacggggggactcgttctcttgtttgcgc

SEQ ID NO: 665191 - DNA, 688 bp, Homo sapiens
gggataaaaaagccacttagttcaaaattaaaaaaaaaaaaatttaaaaaaacaaaaaaaaaaaaaaaaaaaaaagagaaaaaaaaaaaaaaaaaaaaaaaaaaaaacaaacacaaaaaaaaaacaaaaaaaaaaaaaaaaaaatattaaaaaaaaaaaaaaaaaaaaaaaaaaaaacttttgggcccttttttcccaatcatcttttaactttgcaacttttttacctgggcccgcaatttggagtcatttgcccctttccccctttaaggggggcttttcaaaaacaaggcgctgttttttaaacaatttgtccttgaaaaaccctgggttcacccacttataacccttttggaaaaatacccctttttccaggttgggcatatcccaaaaggcccccccccaagcccttttccaaaatggggcccccctaaattggcatcgggaattttccccgctaattttagtaaaaaatccggttaaatttttgtaaaaacccccttttttttacccaaagggccaatattgggaaaaccctttttaaaccaaggtaattccccccaaaagggctgaatgttgtcccactttggaaaaaaagtccccttttaataaagttggtttcacacttaaagggttaaaacccctttttaaagggggcccctttttttcctttccccttattttttgc

SEQ ID NO: 665192 - DNA, 1177 bp, Homo sapiens
  misc_feature (455)..(455): n is a, c, g, or t
ggaaacagacagacttctctcttacgcaaacaggttgctgaagtatgaagctacttaaagaaagatgtttgtacgtgcacggttagatgcttcataaatatcccatgtgcaggacttcatagtgcagccacacttgagagaaacaacaatagtgaaatggagcaaaaagtctaatcttataagccctaagtctatgagtccaaactatgtaaagatgtgtaacgacaagcaacagagaatatcagacaagacgctaacatctctgcgataggacccaggtaacccatactgattttctcaccaaatgtagtagacaggaccatgcacatgcaacagcacccatttgaggaatacatcactactaagaacacttagtcagaccaagcgagggacaggtattcactatttcttgagatgaaggtaattatgacacacgcaatatttcatagaactcnaaggaataataaaacagcatggaacatagaggttatatgcaagagaaggcaatagtgatgattgcttcagacaccacggttaagtggataaataattcacgtggcatcgatggaaagccaaagactatagacgatagacgacgcttagagaaacatgacgttgctctaagagtcttacagtgcaggcatcaggacaaaatcatgtattacaatgcctagatattgcctggaaactgtgccacatggtctaaccttccagcatgtgataatcaagtggattgcgcagttgtccaaggatctgggacaaatcgatatacccacagagaaaggaagcaaatcagaaaaaagtcgttgacatagaggtgtttccattcgaaccgaagtagcttccacttgaacttgttcgtgatccaagttctggggaaggaaggacacactttagagtcgagccaagagcctggaatgaaacttccagtgacacactgctgttgaactattccccatttgtacccgtcggaacagaagaaacgcagactgaagtggtacgcaagaaaccttgggacaacgcaagacgaatcccttcctgaatattggggtcgttgaacaccaacgacggaaactgggaaccttgggggattaacacattgggctcgccatgggacacgtacaggtgtgttcatggcagtgaattaccaatcatttgatatggcaattcacactgg

SEQ ID NO: 665193 - DNA, 208 bp, Homo sapiens
  misc_feature (189)..(190): n is a, c, g, or t
gctctagagtgatcccccgttgtggctatataagcccgtttggtacaaggtgcgtgcctggtttgcacggagaccgtgcacagcgacgcgctgctggcgctgatcctcaagggacgcctgcaagaagctctacgccgatgcgcacctgatgtctcacctggcgctgatgtgtggggggtaccggagctnncgaattctgtaatcattg

SEQ ID NO: 665194 - DNA, 1180 bp, Homo sapiens
gcatgcgactcctacatcggaccgataactacgactgtgccggcgcttctacgtccaccgtgtgtgagtccctgatcgaatgaacctgcgacgcgcgtatccagtgccttcttccgtgatcagcgcatcgcgcgactcgttctctgtgcgccgcgtgggctggtccctggcttggtcgccttggcagagagcagtcgtcgcagtgagagctgtggcgcaggccattcgcgtcgtggtagtgtgtcttgaactgagcggttgttcgcgtggatacgagcccgtgtgtgcgtttgtccttggagtcgtgtcgatgtgcaaccgtggagtcgattctcgtcgtaggtctgcgtggcatgtttctaatgctcggtctggatccagtcttgtggtcgctgagggttccgatgttggtgcacctgtgtcttgtgaatggctgtcgaggttgtgcgctcgtaatgtagactgggctggccagagttctgggtctcgtggcccctgcggtccgtcagtcgcggcgttcccccgggtcgatttgagctccagtctggtgggagtgtacagtacttgcgatggggtccacggctacggtggccctgagggcctaggtccatgggtttcggtacccctgcggaagtgtgggtctaggtccgtcttttccgtgtcgacgtttcaagtctggtcatatgcccacaaagggcctaccttaacaaatgggaagctctccggttggcagcccgtgtaccgccctgacattgggtttgtgcatttgctgacttggttgcaaagtcggaaggtgcgcagacctaatttgaatccccgcatttttcccaaagggcaatggatgaggggggccaggttcgggcgtgagagatgctttacgacgtggggtgaccaccatgttggattcccgtggttaaaggcattcgttcacagtcggatcaggatccgctcattcctctcagactgtggtgtagcgattaaggaagagctggcaattagggagatcccaagctcggataagttcgccttgaccgtggttaaccaccgttgagaccccctgcgagacagttgagatttgtcagacccaaatagggccaaaagtcccggcctttgggggcccacgaattggaatggcgcagttttcctaaataaggcgaacagcgtttacgcgtaaacacgc

SEQ ID NO: 665195 - DNA, 487 bp, Homo sapiens
gatgcttatagtactctactatttgtagcatacagactaacttattctaaaagggaaagctctgtctagctgctatgtgaaaagttatgtggtatctgtaagccatttttttctttatctgttcaaagacttatgtattaagacatgaattacatttaaaattagaatatggttcatattaaataataggcctttttctaggaaggcgaaggtagttcataatttgaatagatgacagatgtgcaagaaagtcacatttgtcatgtatgtaggagtaaacgtgcggtggatcctctgtcttggtaactgaggttagagctagagaggtcgtgaggtctcactacattcgtgagtgaaggcagctgttaattcagtgttgccttatgtgtgcgtacattgcaactgcttacatgtcactctactgtaatgcattccgggcacccttgttacttgggagaggtggtagctcaagaacattccgagagat

SEQ ID NO: 665196 - DNA, 380 bp, Homo sapiens
gccagtagtactgtggagtggtggtgagctgagattgctccactgcattccagcctgggtgacagaatggtactctctctttctctcacacacacatgacacacacaaaataaagaaaaagggctggcgtggaggctcctgccataatcccagcactttgggaaaccgaggtgggcagattgcttgagttcagttcgcagagagcctgggcaacatggcaaaaccccatctctacaaaaataaaaaaattagctgggtgtggtggtgcctgtagtcccagctcatctggaggctgaggcaggagaatcgcttgaacccaggaggtggaggttgtggtgagccgagatcgtgccactgtgccccagtctgggtgacagagc

SEQ ID NO: 665197 - DNA, 775 bp, Homo sapiens
cgcagcacagcaaacccgccgggatcaaagtgtaccagtcggcagcatggctacgaaaggtgggaatcgtggacccggctactccacccctctggaggccagtgaaaggacccaggaaagagatcgtctaccagccctgcgttgaccgaagacacagcgcactgatggccccagagttatgctggaccaactggtggatgatgaccccaagtctcctccagatatggccaggtcattccaccgggctgacccatgcaccaatcctagaaggacgagctgcatcactcaggactggaacacctgcgaagcagctgctatcgtgtgatagcaccaatgtcgtcgcaccaagctggtgctgcccagtcatcatctcctctcgacatctatgtggtggacgtgggctctgagccccgggccccaaagctgcacaatggtcattgagcccaaggacatccatgccaagtgcgaactggcctttctccacaccagccactgcctggtccatcgtgggaagtgatgatcagcgtcccttgggagacgtcaagggcaatggcaaagggggttggtagctgctggatggggagacgttcgaggtgaaggggacatgggagagacctgggggtgctgcaccgtgtgggctatgacttctggtaccgaggctcgacacaatgtcatgatcagcactgagtgggcagatcccaatgtcttacgagatggcttcaaccccgctgatgtggaggctggactgtaacgggagccactatatatgtctggg

SEQ ID NO: 665198 - DNA, 1637 bp, Homo sapiens
ggaatgaagctgagcctgctgagggcctccggggctcctcctcctgaggggaggcagtccgtggagctgccaaagggagacctgggcccggcctccccgagccaggagctcggatcccagccggtgcctggaggggatggtgcgcctgccctcgggaagagccccctggaggtcgaggcacagtgggcagtcgaggagggggcctgtcccaggacagccaccgccctcgctgaccgggctattaggtggcagaggccgtcctcaccgccccccttcctgccggctgcttcggaagaagctgagcctgctgagggcctcagggttcctggcttggccaagaatagccgggaatatgtgaggccggggctgcctgtcaccttcatcgatgaggtagactcggaggaggccccccaagcagccaaactaccctacctcccgcaccctgccaggcctctgcaccctgccaggcccgggtgcgtggcagagcttcagccccggggcagcaacaccttcacagtggtgcccaagaggaagccaggactctgcaggaccagcacttcagtcaggccaacagggagcctcggccacgggaggccgaggaggaggaggctagttgcctcctggggcccacgttgaagaagcgctaccccaccgtgcatgagatcgaggtgattggcggctacctggcctgcagaagtcctgctcaacaaggctggctcctcaagaaagaagatgaagatctccttcaacgacaaaagcctgcagaccacatttgagtacccttccgagagctccctagagcaggaggaagaggtggaccagcaggaggaggaggaggaggaggaggaggaagaggaagaggaggaagagggatccggctcagaggagaagccctttgcactcttcctgccccgggccacgtttgtgagcagcgtgagacccgagagctctcggctgccagagggtagctcaggcctgtccagctacaccccgaagcactctgtggccttcagcaagtggcaggagcaggcgctggagcaggccccgagggaggcagagcccccgcccgtggaggccatgctcacacccgccagtcagaatgacctctcggacttccgcagcgagccagccctgtatttctgagcccagcactgccaggaccaaggctgagcccagctgtgggagtcccggaagctgggcagtagccagggactactgcacccgcttctgccttgtttggcctcactgtatcccacccacccctcctggccctggaagcagctagggtgcctcctgccatcggggccaggtctgggtctcactccccggccctgatttgggagggtccaagggggaagtggggtggggaactgcctgtgggtgagtgccaggggcctgctgggtggtggccatctgcgacccggcagggggctgtgcagattctgcacctggccattccctgtcctgtctcctcagcctgcctcacagtggccatggggtgtcggggtgaagggctgtcccagctacttgtcctctgcaggaccctaagcccctgcccgcagcccacatgccctctgtgatgagtggcgtctttcctgcctctgatgatggactcaataaacagcactggacaaggc

SEQ ID NO: 665199 - DNA, 584 bp, Homo sapiens
  misc_feature (258)..(258): n is a, c, g, or t
  misc_feature (290)..(291): n is a, c, g, or t
  misc_feature (344)..(344): n is a, c, g, or t
  misc_feature (393)..(393): n is a, c, g, or t
  misc_feature (402)..(402): n is a, c, g, or t
  misc_feature (429)..(429): n is a, c, g, or t
  misc_feature (434)..(434): n is a, c, g, or t
  misc_feature (479)..(479): n is a, c, g, or t
  misc_feature (573)..(573): n is a, c, g, or t
gatctacaatggcttcaccagttctgccactggtactctggtctgtgagctggcttcggggaatggtctgtcctctatgatgatgtgatcgatactgttagaaatacgagtgaatgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagnatggtgtcagggatttcctaccattaagattnnggatccaaaaaaaagacagaagattaccaaggtggcagaacatgggtgaagcnattgtagatgctgcgctgagtgctctgcgccactcgtgaaggatcggcntggggggangaaggggaggataaagttctggaaaanaaggnagaagtgatagttcaagtaagaaggatgtgattgagctgacagangacagctttgataagaatgttctggacagtgaagatgtttggatggttgaattctatgctacttggtgtggacactgcaaaaacctagagccanagtgggctgcc

SEQ ID NO: 665200 - DNA, 530 bp, Homo sapiens
  misc_feature (56)..(56): n is a, c, g, or t
  misc_feature (83)..(83): n is a, c, g, or t
  misc_feature (112)..(112): n is a, c, g, or t
  misc_feature (125)..(125): n is a, c, g, or t
  misc_feature (127)..(127): n is a, c, g, or t
  misc_feature (171)..(171): n is a, c, g, or t
  misc_feature (202)..(202): n is a, c, g, or t
  misc_feature (219)..(219): n is a, c, g, or t
  misc_feature (301)..(301): n is a, c, g, or t
  misc_feature (317)..(317): n is a, c, g, or t
  misc_feature (347)..(347): n is a, c, g, or t
  misc_feature (372)..(372): n is a, c, g, or t
  misc_feature (393)..(393): n is a, c, g, or t
  misc_feature (399)..(399): n is a, c, g, or t
  misc_feature (420)..(420): n is a, c, g, or t
  misc_feature (423)..(423): n is a, c, g, or t
  misc_feature (456)..(456): n is a, c, g, or t
  misc_feature (482)..(482): n is a, c, g, or t
gcggcttcattagagatttcaattttcctcttcagtttgaatgtggagtattaggngagccttttgcatgtcaaggtacaggnagcagagatcacccctgcactgctacctncattttcctgctngnagtaaaaattagttaagtggaaatgattatcatatatattttcnctcttccttttgaatgtacacaatgtaacangagtgacagacctgcanattccaatccccaaacaaacccaagatagttgttgtccactttcattggcaaatacagcacagggggcattgtctgcgaatnggcgatgtcatccccncgggggtggtgggggctcatttcctttatngctctcttttaaatttgggctttcnaaagcgacatctaaaggcatnatatcnccccagcccatagcgccaaantcngccatctccccccgctcctcctcatctgggggngggctctcttcacgcactaaagtggncggggggggctcttggggggaggggggggggggggggggggggggttc

SEQ ID NO: 665201 - DNA, 1760 bp, Homo sapiens
cacgcgtcgaccaacgactccttcgagatacggccggcccccaagccagttatggagaccatccccttgggggacctccaggcccgggcgctggccagcctccgcgcaaactctcgaaattctttcatggtcatccccaagagcaaggcctccggggctcctcctcctgaggggaggcagtccgtggagctgccaaagggagacctgggcccggcctccccgagccaggagctcggatcccagccggtgcctggaggggatggtgcgcctgccctcgggaagagccccctggaggtcgaggcacagtgggcagtcgaggagggggcctgtcccaggacagccaccgccctcgctgaccgggctattaggtggcagaggccgtcctcaccgccccccttcctgccggctgcttcggaagaagctgagcctgctgagggcctcagggttcctggcttggccaagaatagccgggaatatgtgaggccggggctgcctgtcaccttcatcgatgaggtagactcggaggaggccccccaagcagccaaactaccctacctcccgcaccctgccaggcctctgcaccctgccaggcccgggtgcgtggcagagcttcagccccggggcagcaacaccttcacagtggtgcccaagaggaagccaggactctgcaggaccagcacttcagtcaggccaacagggagcctcggccacgggaggccgaggaggaggaggctagttgcctcctggggcccacgttgaagaagcgctaccccaccgtgcatgagatcgaggtgattggcggctacctggcctgcagaagtcctgctcaacaaggctggctcctcaagaaagaagatgaagatctccttcaacgacaaaagcctgcagaccacatttgagtacccttccgagagctccctagagcaggaggaagaggtggaccagcaggaggaggaggaggaggaggaggaggaagaggaagaggaggaagagggatccggctcagaggagaagccctttgcactcttcctgccccgggccacgtttgtgagcagcgtgagacccgagagctctcggctgccagagggtagctcaggcctgtccagctacaccccgaagcactctgtggccttcagcaagtggcaggagcaggcgctggagcaggccccgagggaggcagagcccccgcccgtggaggccatgctcacacccgccagtcagaatgacctctcggacttccgcagcgagccagccctgtatttctgagcccagcactgccaggaccaaggctgagcccagctgtgggagtcccggaagctgggcagtagccagggactactgcacccgcttctgccttgtttggcctcactgtatcccacccacccctcctggccctggaagcagctagggtgcctcctgccatcggggccaggtctgggtctcactccccggccctgatttgggagggtccaagggggaagtggggtggggaactgcctgtgggtgagtgccaggggcctgctgggtggtggccatctgcgacccggcagggggctgtgcagattctgcacctggccattccctgtcctgtctcctcagcctgcctcacagtggccatggggtgtcggggtgaagggctgtcccagctacttgtcctctgcaggaccctaagcccctgcccgcagcccacatgccctctgtgatgagtggcgtctttcctgcctctgatgatggactcaataaacagcactggacaaggc

SEQ ID NO: 665202 - DNA, 2081 bp, Homo sapiens
ggaatgaagctgagcctgctgagggcctccggggctcctcctcctgaggggaggcagtccgtggagctgccaaagggagacctgggcccggcctccccgagccaggagctcggatcccagccggtgcctggaggggatggtgcgcctgccctcgggaagagccccctggaggtcgaggcacagtgggcagtcgaggagggggcctgtcccaggacagccaccgccctcgctgaccgggctattaggtggcagaggccgtcctcaccgccccccttcctgccggctgcttcggaagaagctgagcctgctgagggcctcagggttcctggcttggccaagaatagccgggaatatgtgaggccggggctgcctgtcaccttcatcgatgaggtagactcggaggaggccccccaagcagccaaactaccctacctcccgcaccctgccaggcctctgcaccctgccaggcccgggtgcgtggcagagcttcagccccggggcagcaacaccttcacagtggtgcccaagaggaagccaggactctgcaggaccagcacttcagtcaggccaacagggagcctcggccacgggaggccgaggaggaggaggctagttgcctcctggggcccacgttgaagaagcgctaccccaccgtgcatgagatcgaggtgattggcggctacctggcctgcagaagtcctgctcaacaaggctggctcctcaagaaagaagatgaagatctccttcaacgacaaaagcctgcagaccacatttgagtacccttccgagagctccctagagcaggaggaagaggtggaccagcaggaggaggaggaggaggaggaggaggaagaggaagaggaggaagagggatccggctcagaggagaagccctttgcactcttcctgccccgggccacgtttgtgagcagcgtgagacccgagagctctcggctgccagagggtagctcaggcctgtccagctacaccccgaagcactctgtggccttcagcaagtggcaggagcaggcgctggagcaggccccgagggaggcagagcccccgcccgtggaggccatgctcacacccgccagtcagaatgacctctcggacttccgcagcgagccagccctgtatttctgagcccagcactgccaggaccaaggctgagcccagctgtgggagtcccggaagctgggcagtagccagggactactgcacccgcttctgccttgtttggcctcactgtatcccacccacccctcctggccctggaagcagctagggtgcctcctgccatcggggccaggtctgggtctcactccccggccctgatttgggagggtccaagggggaagtggggtggggaactgcctgtgggtgagtgccaggggcctgctgggtggtggccatctgcgacccggcagggggctgtgcagattctgcacctggccattccctgtcctgtctcctcagcctgcctcacagtggccatggggtgtcggggtgaagggctgtcccagctacttgtcctctgcaggaccctaagcccctgcccgcagcccacatgccctctgtgatgagtggcgtctttcctgcctctgatgatggactcaataaacagcactggacaaggcaaaaaaaaaaaaaaaaaaaaaaaaaaaaaaaaaaaaaaaaaaaaaaaggggggggggccaaaaaattcttcccggggggggcccaatttgtccccgtttttttgaaaagggggccccctaaagggggggggcgtcgattattaaacagcgccgagagcaggggggcgcgggcttataaacaacgggtcgtgaggcggggaacaacgcgggcgtcgtggggagcctctttgggggaggaagggagccctattatttgtcggggggggggagacaatagggtggggacaacaccttcccctatacgaggatattataaagcgctcctaaggggaaaattattaaacttttaaaggtgtaatctgggggtaaccccaggcgggaaaattgtacggcgggttaagaaatttggcagggggatattagttttgagaattttttcgagga

SEQ ID NO: 665203 - DNA, 411 bp, Homo sapiens
  misc_feature (2)..(2): n is a, c, g, or t
  misc_feature (25)..(25): n is a, c, g, or t
  misc_feature (86)..(86): n is a, c, g, or t
tnttccaggattttaaaactcaggnactttcagatgcccagccatcaatgatattctctcactggaaagtgggttctcaaagcaanggtcctgacaaaagcatcagcgttactggggaactttgttagaaaagcaagttcataggctgggcattggtgctcatgcctgtaatcccagcactctaggaggcctaggcaggtgggtcacttgagctcaggagttttgagaccagcctgcacaatgtggtgaaaccctgtctttactaaaagtcaaacaaattagtggtgcattcctgtaggcccagctacacgggaggattgcttgagcccaggagactgaggtgcagtgagccgtgattgctccacttcattctagcctgagcaacggagtgagaccttgtctcaaaaacaa

SEQ ID NO: 665204 - DNA, 927 bp, Homo sapiens
ctccctggggcgcggtgatgtgtgccggtgcccgccccggttttgaacgtcgttcggggagcccttgccgcgtctcccttgtggctggtcacaccgaggctcgcaggcccgccggaatttttggcgctgaaccccgtagggaataggtgctttgttattaagcgctccctttttcacggggatgttcccccggtcatcatctcgaggtgggtgccctcccccccccccaagtgccgcggcctgcggcaacacccctttttgcggccgacaataattcaggctgttgcgactttttctttctcgtcagaacaccagtgtgtctggcctatcttttccatctcggcgataattggctgggcgcccgaccgcagaaagggtggcccaccagtgttttgatatctgcgccccccgcaaaactccgagtggttctagtagaggccaagcgaccactgttagtgctttggggcacgcagaatggaagatataatcgaccgcccttcgaatattttatcggtgagggcctacaggtggcaccctttctggcgctacccggcgatttgcgcgagcacccccgcccgatagagcatctcccccactctagtcgttgtgggtgcgcaactaagtaaaaatgattggcagtgtctgcgcttttatttgcacgcacccccgagtgctcctcctcgttgcctcatgatgccagcggagaaccaccccccgcccgccccactcgtggtgctgtcccgcgagacaccaacagaatctgttagggaggatcccgcccacgatggccctcctgggttctgccccacacttattgctccgtgatggtccctcgcctcacggccttgaccgccggtggtctcacgaaggtatcaacgttatatggagttctgcaaaaaaactcaaaaacccctcgcccacaaaaca

SEQ ID NO: 665205 - DNA, 708 bp, Homo sapiens
  misc_feature (397)..(397): n is a, c, g, or t
  misc_feature (399)..(399): n is a, c, g, or t
  misc_feature (405)..(405): n is a, c, g, or t
  misc_feature (444)..(444): n is a, c, g, or t
  misc_feature (450)..(450): n is a, c, g, or t
  misc_feature (465)..(465): n is a, c, g, or t
  misc_feature (467)..(467): n is a, c, g, or t
  misc_feature (477)..(477): n is a, c, g, or t
ataatcgtggacgtgtacagtggttcacctgtgagaatgatcaacgatatttattatttgctgggggtcaggccctgtacacatcgctgagaacagaagagcaaaatcactgccctcacagagcttgcatttagtgaggagtcacacagaacacactcactgtgcaaaatcagtgtacttgcaaacaagagttgaacaagaggcaggctcacacaaatgagaggttatcccttagagcagctctgtccaatagaactttctgtaatgatgaaaatgttctgtgtctgtgatgtctaatacatggggctagagcaatgtgggactgaatgtttaatttcatttaatttaaatgtatttaaatctaacttaaataggctggtgtggtggctcacgcctntnatcccngcatttgggaggccgacgcgggcggatcgcgtgagctcnggagtncgagaccagcctggncngcgtggtganaccctgtctctactaaaatagcaaaaaaaaaacaaggagaagagatcacgccagggtgtgcatgcagagacgcctgtaggcccccgggcaaatacggaaggcatgaggcaccgagaatgggctgggggccgtgggcacgcatgaaggttgcagtgacgccgggaatctcggcggggtgcacctcaagccgtggcggagaaaacggcggagactcatatctcaaaaaacaca

SEQ ID NO: 665206 - DNA, 221 bp, Homo sapiens
agaggttccccgcccttaccctctgcgctccacggctgcagcatagccttcttcccgcccgcctcccactctctctcccttatcctgggtgcccgcgtggctgctactctccgaggcttctgtgtcaccgggtcgtggaaatgtcaccgagtatcagagcttcgagcctcctccatatccatcccaggtggcatcactacgtggcatttgtgtgctacgca

SEQ ID NO: 665207 - DNA, 290 bp, Homo sapiens
agtgactccacaaacagcctaattattagcatcatccctctactgattttttaaccgaaagtcaacaagcaacctatttagactgttccccaaccttttcctccgacccccgtaacaacccccctccgtactactaacgtacctggactccataccccgtcacaagtcatggcaacgccagacgccaacttatccatgtgaaccacgtatcacgagataaaaactctacctcgtctatactaagtctccactacagaatctccgttcagggtaccgcagctcgacattcg

SEQ ID NO: 665208 - DNA, 271 bp, Homo sapiens
cagtttttttaaaatgggccccaccaaaaaagccccagttcatgcacctgtggcaaagttcacgttttgtggtttcatgttagttcccctataggtcctggggaattagggccccttaatgtttgttccccaaaataaatatttttccccccgcctaaagggaggattttttggaaaattgggtttcctaaaactgtcccccccaaaaaaaggggattggttttttaaaaaaaaaaggggttttggaaataaagtccaatggaaaattcca

SEQ ID NO: 665209 - DNA, 954 bp, Homo sapiens
agcggaggggccgagacgtcgggcgtgcgggcggctgcgagcatgatcctggtgctgcaccacatcctcgactcgactgttgtctcacatttgccttgcaggtctgggggccattatcgatctttcttcaacggcgcaggagctgaagcgcgaacggcgtcagaccggcgacgtcagtgcagacccgaccacctctgcgggggaaactggctagcgcctacctatttggatgggtgtagttccctacttgggtgttgtttttgaaccgcactcgatgattgatctagggccaagaagtggaaagtcccgggggaaagcgatatatctcccatgaaagcgggttgggtgctgccaatggggcttgaaggcgtttcgtcaagaaacctggctcacgcgggtaaggacggcccttggtggggcaagggcgttggttgaggctactcccaacatgggtcttcgatgaagtaaacacccaaaaggttggcttgggtggtattgcccggctcaagatcgggagccacccgggcagggggcttgggggggggccccgagggggacacggcttgttaaatctaatgtgggcgccagcaatgggtggaggctcaagcagaagagtgtgaccacatggggagagagaagtttgtgagggcccttggcatgagacggtgttgtgacagataagacatacacccgctttgtgtgtcagcgcccccatgccggggtagagggagttggcagcgaggtaaccgtgccaggcaaggcagcgcggggggctcgccagggggaacggcctcacccaccagaaggcgccgatcaccatgaatagaaccaagcgccccggaagaaggtgtgaacggggccgggacaggaaatccataaaaggggggcagaggggggcaggggcggtaacaggacaggaacccgggggaagcacggcacaccgaatcaccttcg

SEQ ID NO: 665210 - DNA, 320 bp, Homo sapiens
ctgtgtgtagcacaacctagggtcagttttgcaggtggtaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 665211 - DNA, 181 bp, Homo sapiens
gggcccccccaggggggttttccccccgaacccaatccccttggggggggggggaaatccttttaaaaaatttgtggggggaatttttcccccccccaaattggggggtcggggttttaatttttttcccccaaaaaaattttggcggcttttccaaaaaaaacccccctttggggggtta

SEQ ID NO: 665212 - DNA, 851 bp, Homo sapiens
taggctaggtagaggctggtgttaatcggacgaggttggtccggttgtgtgcgcctaatctcaggtggtccacccgagaccccttgagcatcaaccctagtcccccgggcggccccttattcggtccgacaagatgaaagacacaagtcatgaatccatggaacagaactcgccaaactgcaggcacaagtgcgcacttggtgggaaaggaactgctcggcacaaaaagcatgacaggtgcgttcactatgaacagaccagctagtcatgatgacgagaaaaacttcagttctccttaaacaagttgaggggtaaactaatatctctggtattgaagaggtgaatatgtttacaagaccagaggcaacacgtgatccagtttaacaaccctaacagttcaggcatctctggcagcgaacactttcaacattagaggccatgctgagacaaagcagctgacagaaatgctacccagcatcttaaagccagcttggtgcggatagctctgactatgtttaagggaagactggccgaagctctgcccaagacaagtctgtggactggacatacagcaccacttgctactggagaggatgagtgattgatgaacgtttccatgatcttgtgcatgaactctcgatagaggcttccagagaactgaggcaacacctgaattgagtcaacttctgaagatcaagaagctgaagaagttactgggagctgcctagttttatattatgactgctttttaagaaatttcgggtatggatctgactaaaatctagatctctaatatcgttaagcccagtccctgggacactgcaggctctttgcagttgggttatacacaa

SEQ ID NO: 665213 - DNA, 143 bp, Homo sapiens
ggagctcggtaccggtagacacttacgattcacttacaagctgcatagaatgtacaaaatagaaaagaaaataaatcaagccacaaagcttctaaaaaaggaacccgcaggcacttcctctggtggaatgttgtaaaaagctt

SEQ ID NO: 665214 - DNA, 566 bp, Homo sapiens
gagcggggcggggcggggacccccgggaggggcggggaggggcgcggcgggggcgcggagagagggagggaacgagggtgacgcccggctgccaccccgtctgggaagtgaggagcgtctctgcctggccgcccatcgtctgggatgtgaggagcccctctgcctggctgcccagtctggaaagtgaggagcgtctccgcccggacgccatcccatctaggaagtgaggagcacctcttcccagccgccatcacatctaggaagtgaggagcgtctctgcccggccgcccatcgtctgagatgtgggagcgcctctgccccgccgagccgtctgggatgtgaggagcacctctgcccggacgatgacccgtctgggtggtgaggagcatctctgcccggacgacccatctgagaagtgaggagccgatccgcccggccagccgacccgtctgagcaagtgaggacgcctctctgcccggcagccaccccgtcatgggaaggtgagtgagcgtctcccgtgtagccgacccatcctgggaggcgacgttgggagggtcagacccgaa

SEQ ID NO: 665215 - DNA, 329 bp, Homo sapiens
cacgaggtagggctcccaccctgataggcttggagcagaggactatgtgcctcacccagtttctgagggacccctgtggctgcggactgttcccaacaagcccaggatagatggtgggggccatgtggagggaggtgccatgtggcacatgtccaccgatcacctgtggcctgagaggctgggtgcctgtcctggcatggatggggagtctggtggaagcatttatgatgggtttggcttgcactgaacagcggggtgtgagggtctcacatgatccatatggggttggatgtccctgttgctggcccaacagaaagacttggggacat

SEQ ID NO: 665216 - DNA, 698 bp, Homo sapiens
taaaaaagttgtttgttggaccccataagtgaatttcaagcagtgaggatttgggggtgcctgaaatggccgagggcacagggagtgagctgtatgtgtgaggaattgggtgagcgagataaaagtccacgggtgtcaacccctaaaacatgggtgaccgtacatttttatacatctccactctacggcctttaacaggcttcccgatttaacaggccttaccaagtttccattctccttagagagagaacggtgcttccaaacagaaatcaggatgtgaccacaaagcctgaaaacaccttgggccacccagcaaagaacggggcacactggtgttggggtctagcattgagccatagttgcccgagttaaaactggcaggccactctgccttgcagtggcctctgatatcattggtggggtgcatccacaggggtgcccgagcatgtactatacagacggccccagggattgagacccaagtcatcatgaaaagggcccaagtacagtcttaaggcgataaatccacatagctaagacgtcagagggccaacaccagcattcaagccgggttgggacaagtctcaggtcccgtgacacagggaagggcggggctgccaaggactgcccagcaaatttgggcagaggaaccccaaaccggaaaggaacggtctggcaggtaagcgacacgcgggacc

SEQ ID NO: 665217 - DNA, 121 bp, Homo sapiens
gacctggggactgaattgatgcgatgggaggctgtgcggctcgcggggcgcttttcggattcgagggggaggagacgtcccggagccccggctccctctgttggaccatcagtgcgccgcc

SEQ ID NO: 665218 - DNA, 475 bp, Homo sapiens
ctcgcgtccctggtgttgagtgtcagcccgtggttgtttctgcgtctggtagttcctcccccgcccgtcctcccactggggaaccgccggccccccaaggacgccaatgcaccaactgtttcccacgccgtttagaatatatcgggccccaaccccccgcccttgggagagaaacttgcgggggggtccctgtccactgtgaaccttttccagaccctgtgggggatgttccccctgcgccccggctgtttacccgtgtgtacccacaacaaccccacttgtggcctgtgatggacggcccgcgcacgtttaccgccctaatgagggccgcgggaccgtccttatatctcggcgcccgaacttctccggggccgcctcgtcggcccggcggagctcctttccccgcgcccggacatctcccccccccgggccccccccattgggccaatccaatttctaattttatcaaccaaaa

SEQ ID NO: 665219 - DNA, 630 bp, Homo sapiens
taccggagagagaactgaacagctgagaagtatcttagggtccccagacatgcattgagatctcacagaggggcccaagggccattgactccaggagctgagaccccccagtgagggaggtacctctagactgagacactcacaaagggaccccagttcagcaagggtcagaggaaggtctggaggagaagagagtaaagggccctgggtgggcaggaggctgaggagggagcctggggagagcaccaggtcggggcatcaggccagtgcctggaaggtgtggccaaaggggtctctagctgctgctctgttgctcctgctcatggatgagtttggcgatggggccggtgatgccgcctatcaaggtccagtactcatcgaagctgatgcgcccatcatgattggcatccaggttctggatgagcttatccggagccttccggttccctgttgtccgacagcatgtggttcagctctttctggagcatctcgcggaagctgctctcgctgatcttgttcttgaccagggtgtacttagacacatatttgtagaagtttccaccaggacaatgatggcttctccagctccgtgtagcagtctctttcctggagggaccgagcccaaattgg

SEQ ID NO: 665220 - DNA, 269 bp, Homo sapiens
  misc_feature (37)..(37): n is a, c, g, or t
  misc_feature (124)..(124): n is a, c, g, or t
  misc_feature (133)..(133): n is a, c, g, or t
  misc_feature (156)..(156): n is a, c, g, or t
ttgagctatgaaaatggctttcagcagagaggcaatntggggctcgggggaatggttctacttgaagttcctcctgtgtggctgggtctggggccttttatggactcagaatggggagtgagtnctgattggnttgtgaggaaagcgcaccaaacnggaagacaagtcctccatctggtccgaggatttaacttgtagcttggctttcaagctttaaaattcttcagcatggaggtggggtttcaccagggacccaaccctgtctgcct

SEQ ID NO: 665221 - DNA, 546 bp, Homo sapiens
gcccttcttgaaattggtgtgaaacttggtgtctgagatccttaagggaacattggccacccttactgctgtcggaagggcgttgttccaggttgatgaagatccacccaccttgtgggtaatggctagtcatcccggagaaagagcttgcgatccaactgcatactggaatggcactttaaacagaactcacttgacacatgcaacaacgtctatggggaaaaaagtactgaacgcggagctagtttatggttcactacaaccagtatagacgcagcagaagctgggatttagtctaaatttattggagttggatatacgtagaactctagtcctatgtgtcagtttagggggtcatcctgcgaacttggcagcctacagacctatagtgccagatacagagcaatgtctttcatagagttgaagaggtggatacgttctgtacaagagttcgtgtgctgctcgacacaaaagccactgccctagatctgaaaatatggaccaaacaaaggcgctaaaccctaacccaagagccctcagaccagt

SEQ ID NO: 665222 - DNA, 87 bp, Homo sapiens
ttttttttttcacttgaatatcgaagaagtttaatacgctgccataaaataagcgccttgaaaaagctcatggaatagaagtcagtg

SEQ ID NO: 665223 - DNA, 886 bp, Homo sapiens
  misc_feature (611)..(611): n is a, c, g, or t
  misc_feature (822)..(822): n is a, c, g, or t
  misc_feature (876)..(876): n is a, c, g, or t
gaggggtgggaggatcatcagcccggcagtggccctgtggccagcaggtgcactcaagaagctaaggccaggccatctgagcacaaagattgcgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaacacaacaaaaaaaaaaaaaatntttgggcggccttggccctgaaaaagttttttaaccctttgcgttgggcgcggggcccccgttggttagtggactgtggccaagagcgtgtcccaggggaaatccgggccaacagacgaaggtgcttggatttcttccccagattatataagagccgcgggggacaacgcatgtgttttctgaacaatctccagagtgaagtcgggagggncaaaagggagcctcattaccaggggtgcccacagaaactagaataaattctcgnggtgtgtggt

SEQ ID NO: 665224 - DNA, 72 bp, Homo sapiens
gagactaaagagggctgaccgtttgtccgaagttggccgaggcctacccgctaggccgtgtttgcactcccg

SEQ ID NO: 665225 - DNA, 1003 bp, Homo sapiens
  misc_feature (728)..(728): n is a, c, g, or t
  misc_feature (939)..(939): n is a, c, g, or t
  misc_feature (993)..(993): n is a, c, g, or t
attcctccatgtctttagggtctttgcctcaggtgtcccttgccgaggctctgccagggggatgtggctgatgcccgttggctggggctggagaaaagctgcgtagacccttgtgtcttcctgagcactgggctgtgggatcacagagggaagagaggtggtgaatggggagagggcctggctgagggtggccacctcctgtgtgtccctgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaacacaacaaaaaaaaaaaaaatntttgggcggccttggccctgaaaaagttttttaaccctttgcgttgggcgcggggcccccgttggttagtggactgtggccaagagcgtgtcccaggggaaatccgggccaacagacgaaggtgcttggatttcttccccagattatataagagccgcgggggacaacgcatgtgttttctgaacaatctccagagtgaagtcgggagggncaaaagggagcctcattaccaggggtgcccacagaaactagaataaattctcgnggtgtgtggt

SEQ ID NO: 665226 - DNA, 981 bp, Homo sapiens
ttcttttactatatccacaataatacgggttcctcaacacaaatgttagtacttggtcgcaacacccttgttggagtgttgccaatatacccctgctatacctcattagtggtggcccgccctgtttattattcccccgttggttcttatacttatattcatctaggtcccacatacgtggtagaatacacttggtggcaacggaagacactattttaacttttttctcccacagtagtagtgttgccaacaccctaccctctgggttgttctatgcttgggaccactctgtcgggggtgcattatccctctttttttgtctgttcatagctattctgttttgctgacaaacacagcgtgcttaatggcttctctttctcatcgtgtttttagcgattcttgcagtggtttctgtccaacattttgcagagatgacacagagtctgtctctacacgacatagagtccccctctgggggtcatagatattattgcttatgattatattgcgcagcgaaatctggtggcgtttctcctgtggttaccatatagagtgctaggctgtttcaaacatttttgtcttttacattgaatatagtgtctcaacattttctgtttttctgtggaaggctgtgtcttcctaataggatgttcatcggcttattgtgccacagggcgtcacatggcgttaagcattgtatatcccagacaactattgggagtgcacgtaggtcatgtggcaggattaactaacggtcaggagttcgagaacagccttggccaaaaaaggcgaaaaccccgtttttacgtataaaataccaaaaagttagccgggcactggtggtgtgcgcctgtaatcccagctaactggggaggctgaggcagaagaatcgcttgaacccaggaggtgaggttgcagtgagctgagattgcaccaactggactacagccctgggtgacagagccggagaactctgtttca

SEQ ID NO: 665227 - DNA, 1233 bp, Homo sapiens
  misc_feature (1)..(3): n is a, c, g, or t
  misc_feature (958)..(958): n is a, c, g, or t
  misc_feature (1169)..(1169): n is a, c, g, or t
  misc_feature (1223)..(1223): n is a, c, g, or t
nnnaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaacacaacaaaaaaaaaaaaaatntttgggcggccttggccctgaaaaagttttttaaccctttgcgttgggcgcggggcccccgttggttagtggactgtggccaagagcgtgtcccaggggaaatccgggccaacagacgaaggtgcttggatttcttccccagattatataagagccgcgggggacaacgcatgtgttttctgaacaatctccagagtgaagtcgggagggncaaaagggagcctcattaccaggggtgcccacagaaactagaataaattctcgnggtgtgtggt

SEQ ID NO: 665228 - DNA, 798 bp, Homo sapiens
  misc_feature (755)..(756): n is a, c, g, or t
  misc_feature (759)..(759): n is a, c, g, or t
  misc_feature (784)..(784): n is a, c, g, or t
agcggcagaagaatgcttgaacctgggaggcagagattgcagtgagccgagattgcgccattgcactccagcctgggcaacaggagtgaaactctgtctcaacaacagcaacaacaacagcaacaacaacaaacttttgtctcccagtttctgtgggtcaggaatccaggtgcaccttagctgggtcctttggctcaaggtcttgcacaaaatctccatcaaggtatcagcagaggctggggcccatctcaaggctcagatgggggaggatttgcttccaagctcactcacctgaatgctggcaggattctgttcctcatggcctgttgggctgaggggcttagctcctcgacagctgttggccaaggcatctctcatgttcctggccatgtgggtgtcttcatagggcagctcatacagtggtgggaggcttcgtcagagccagcaagccagaggaggcaagcaggagggaagccaggtcctttcgtaacctactctcagaagtgacatcccggctgagtctggtggctcatgcctgtaatctcagcacttgggagaccaaggcagatggatcacctgaggtcaggagttcgagaccagcctggccaatatataatgaaaccccatctctactaaaaatacaaaaattagctgggtgtggccagtgcatgcctgtaatccccagctacttgggaggctgaggcaggaaaattgcttgaacctggaaggcagaggttgcagtgagctgagatcgnnacnattgaactccagcctggcgacaganctagactctgtctc

SEQ ID NO: 665229 - DNA, 658 bp, Homo sapiens
  misc_feature (383)..(383): n is a, c, g, or t
  misc_feature (594)..(594): n is a, c, g, or t
  misc_feature (648)..(648): n is a, c, g, or t
tcctggtcccccacggcaggggacttatgctgttttcatgtttagaaacaaaaaggagttccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaacacaacaaaaaaaaaaaaaatntttgggcggccttggccctgaaaaagttttttaaccctttgcgttgggcgcggggcccccgttggttagtggactgtggccaagagcgtgtcccaggggaaatccgggccaacagacgaaggtgcttggatttcttccccagattatataagagccgcgggggacaacgcatgtgttttctgaacaatctccagagtgaagtcgggagggncaaaagggagcctcattaccaggggtgcccacagaaactagaataaattctcgnggtgtgtggt

SEQ ID NO: 665230 - DNA, 1350 bp, Homo sapiens
cctcgtagtgggattgagtatctaggataatgcatgatcgagtgcaagtcattctgtgtggtctgttatctctgttgatgttagtattacgcagtgaatatagtagcagttcgtttatgctgtagctcgcactactacagactgtatgatacacaactgctggcttgcttttggacctgtaatcttagaagcacgctgttttgttacaacaaaagcgttttataaatttctgtttgttctctcccctccgtcttcaatgcttgcgaccccttttttgataccaggtcttcaaaaaaaaaggctgcttcttgtcattagtgtagaatatatatggacacggggaccattatatattgggacggcctttttcaacactggttagggtgatttttccccccaccatatgtgcctgtgcttccaaccgtgagatgccacacacctaaagctcttgtgggattcaatgaagggtggcccaagacacaacaggggttgcttttgttgtgatggtttatgttgttttttaggcgttttccctttggaggagaaataaaatgggttaaatggagagaactattgttaaacagggtcctgggttttctttcttggcaaacaccacgtatgctaaaactttgccctgcttttataataatgcactttttgttaagggatcacgccttgggtagacccggtatttatagcgggaagtaagcacccctctggagttctttggtttgcaaaagccccttttcccactcaagtgcctatgaataataggcccctggtgtcaagccaatgcacagggggttgtttggttataatgcggttgcgtgcacacgcaagtggggcactaaatgaaataataaatttaacccacgtggagcacaaaggtgtgtaccacaagtgagaatttaaaataaattggtggtggaattggccacgtaagctaaagtgggcttttataaagagagtaattgaaagaattgaaaagggtttttctttcttttttaaaaaagagaaaaccaaactattgagttgtaagaaaatggaaaagctaagggtttgccctcttcaagtctaactctccttccacgatagtgtaaaatcccaaaactgtttttccctctcccctaccttgtcccccctattaaaatagagaacacgggattgacttaaagtcccgctcctgagaaaacacagtataaaatttgtacacaaaatattctttctatggaaatgagatttgtaattctgtagaacttattacctgggagatgttttgatgtaaaatcccatcctttgggttgtgggttttttgttttctccaaactcaatctgatctttaaagttcca

SEQ ID NO: 665231 - DNA, 696 bp, Homo sapiens
  misc_feature (40)..(40): n is a, c, g, or t
  misc_feature (58)..(58): n is a, c, g, or t
  misc_feature (135)..(135): n is a, c, g, or t
  misc_feature (142)..(142): n is a, c, g, or t
  misc_feature (421)..(421): n is a, c, g, or t
  misc_feature (632)..(632): n is a, c, g, or t
  misc_feature (686)..(686): n is a, c, g, or t
ggggaaaacccgtggggaattccggggattggaaaacccnttgggtttgggcccaagnttattttcccaagttcggaatttcttgaaaccggggtttgccccccaattgcaaggatttatttggcccccacgganattcccnaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaacacaacaaaaaaaaaaaaaatntttgggcggccttggccctgaaaaagttttttaaccctttgcgttgggcgcggggcccccgttggttagtggactgtggccaagagcgtgtcccaggggaaatccgggccaacagacgaaggtgcttggatttcttccccagattatataagagccgcgggggacaacgcatgtgttttctgaacaatctccagagtgaagtcgggagggncaaaagggagcctcattaccaggggtgcccacagaaactagaataaattctcgnggtgtgtggt

SEQ ID NO: 665232 - DNA, 215 bp, Homo sapiens
  misc_feature (68)..(68): n is a, c, g, or t
  misc_feature (91)..(91): n is a, c, g, or t
  misc_feature (162)..(162): n is a, c, g, or t
  misc_feature (175)..(175): n is a, c, g, or t
  misc_feature (204)..(204): n is a, c, g, or t
gtaccgatgaccctcggtaggaattcggcacgaggagtggcagcgcaaggcagccagtttcgcgaagntgtcggcgcgcccggcccgcagnacccggcacgcgcttccccgcagcacccggcacgcgccttccccgccgccacgatgcccaagaggaaggtnagctccgccgaangcgccaaggaagagccaaagagaagattngcgcggttgta

SEQ ID NO: 665233 - DNA, 606 bp, Homo sapiens
  misc_feature (331)..(331): n is a, c, g, or t
  misc_feature (542)..(542): n is a, c, g, or t
  misc_feature (596)..(596): n is a, c, g, or t
cagatgagctgggccggctgcccgcaagagactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaacacaacaaaaaaaaaaaaaatntttgggcggccttggccctgaaaaagttttttaaccctttgcgttgggcgcggggcccccgttggttagtggactgtggccaagagcgtgtcccaggggaaatccgggccaacagacgaaggtgcttggatttcttccccagattatataagagccgcgggggacaacgcatgtgttttctgaacaatctccagagtgaagtcgggagggncaaaagggagcctcattaccaggggtgcccacagaaactagaataaattctcgnggtgtgtggt

SEQ ID NO: 665234 - DNA, 184 bp, Homo sapiens
cactcacacgactgaccgagagaacctgcggatcgcgctcgtatatacaaccagagcgaggctggttctcacaccctccagatgatgttttggctgcgacgtggggtcggacgggcgcttcctctgcgggtaccaccagtacgcctacgacgtgcaggattacattgccctgaaggaggacctg

SEQ ID NO: 665235 - DNA, 101 bp, Homo sapiens
acaccagtgcacacacagcacacacactagcacacagcacagacacaaagacagcacacgcatgcacgacggcacacgcacacacagcaaacacataaaca

SEQ ID NO: 665236 - DNA, 315 bp, Homo sapiens
  misc_feature (1)..(3): n is a, c, g, or t
  misc_feature (220)..(220): n is a, c, g, or t
nnnaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgtngagtaccgtttccctgttcccaggggcgctctgggtgctgtgttgatcagggaccagtgacataggtacaataccatgttaacttgtttaaccgg

SEQ ID NO: 665237 - DNA, 204 bp, Homo sapiens
cacagtcatatcgaattgagctggtcccaggacttgttcacggtagccagttctgctcagcgcgcgatccgcagtgctgcagggtgcgtgtgggcgaactggagcaggactggctgccggtgaacaagtcctggtgcctcaacgagcgccactacggcggcctgcagggcctggacaaggccgagcacgccgccaagcacggcg

SEQ ID NO: 665238 - DNA, 285 bp, Homo sapiens
ctcgactcttagagtatcccccactttacgcaggcgcagagaccatggtggtcctctcttctcagcccctccctgaacactagtacatcacctggaaggtggtcctgctcacagcatcacttttaaccttctgtaacctgcctatcactgctcaagtcacgatcgaatccctgacactccttgtccccgaggagcaatgatgtgcttctacttatccactatttgcctcataatcttgctggttccatcttttacaaaggacaactgatggacctcctaccattc

SEQ ID NO: 665239 - DNA, 135 bp, Homo sapiens
aaatgcaagtgggccgaggacccaagaaattgcacccctttcgcttctaggtcctgtggttcaacataacatataggacaatctgcaaggagatgccagagatctaataataaaatgccaacaacatagagatat

SEQ ID NO: 665240 - DNA, 359 bp, Homo sapiens
gctgtgtgttgctccagtatgtcaacgacctcctgctgggacaccccacagcaattgggtgcgccaaaggaacagacgccctgctctgacacctggaggactgtgagtataaggtgtccaagaagaaagctcagatctgcagacagcaggtacgctacctaggatttacaatccgacagggggaacgcagcctaggatcagaaagaaagcaggtcatttgcaacctaccagagcctaagaccagaaggcaggtgagagaattcttaggagctgttcttagggttctgcaggttatggatcccaaatttgcagtactggcaactctgtacagttacagaggtgacatgacttcgatgggt

SEQ ID NO: 665241 - DNA, 106 bp, Homo sapiens
ggctatcgggcccattaccccaggaaatgttagtctatacccttcccgtactaaattaatccccctcggcccaaccctttcatcctactttaccatcttgtgaaag

SEQ ID NO: 665242 - DNA, 116 bp, Homo sapiens
tgcatcttcatggtttgctgaagatggcggtatataggctgagcagaggtggtgtggctaggctaagcgtttgagctgcattgctgcgtgcttgatgcttgtccctgaagatgctt

SEQ ID NO: 665243 - DNA, 161 bp, Homo sapiens
tcactagtacggcgcagagtgtggaatacggttacgggaaccaacacttaattactaggatgatagtgacttatgagttaccggtatgaatgaaaattgatactgtagtctaattggcaatgtatgtattcaaagtctggtttaccctatatttcgattga

SEQ ID NO: 665244 - DNA, 121 bp, Homo sapiens
tagagatccatgacaggagacgatatcattgcctgagaaaagagcatgacatgtgtcatgagtgagggtgctatgttccaatttggtttcatgtgattttcaatgtcagaaatatacttat

SEQ ID NO: 665245 - DNA, 425 bp, Homo sapiens
tccagcgtcacccggcctggcgtggtgctgcatgcctgtagtccccgctgtccgcgcggctgcggcaggcagctcacctgcgcctcggactttgctgttaccgtgagctatgatcataccactgcactccaacctgggcgacagcaggaccctgtctctaaaaaaataacctttgtattaactaaatcataaaactcttctaatactgtcggtttagttgcacgagctgtaagaactctaaatatagtattacagatacaatctggataagcccaatcgaaaatacacttaacgatactgaaataagtataacagtgtcaaactgtgcatcatacatcttgtctaaaatagcttccagcctaattggcttaactgcaaataaaaatagtgatctgcttaaaaaatacaccaataataatgtacca

SEQ ID NO: 665246 - DNA, 831 bp, Homo sapiens
gggcttctggctggccctgcgtggccctggcgccagcctggaggtcttcggcacggctactgcacctgcgctctacctgcgccagcgcctggctggcgcccccgcgcccaaggcctacgtgctgggcagcccagccctggcctgctggagctggagtgcctgtgggctgtcgccatgcgttgggcggttggggccctgaggccaactgcgagggcggagggctccctggcgaacttgtcttgcatcggctgccggttgggaaccccgaacgttgcgccgcggggtggatggtagggcttttgacccccggcaactttcaagctaaaatttgaaaggcttcaccagtggccctcttgcggcctacctcttgcaggccagcgccccgggcttgccctttgcctccggtggggccacccaaccatttggaccaacccggtgcttacccgcctttggacgaagcgtggccctgctttcatccggcgggggataacccgggggatgtcatgactcgcgggaagccctggttgtaaaattaggccgccccaaggtgtccggggcccgacattcattcggggaagccccagccggcattcagtttatcgaagtgggttgcccccagggaaattaccgggtaatacacccccggaagacgcacccgtcattgggtggggaaaacccgtccttggacaacagaacatcctcctaggcgccatcttgttgccttgaagaaccatccttacccctcaacggaatcaccactccagaggattgtgaggaaaaattcgggaaagtaactggcgttctaaaaagaacttggtcctgaattcaaag

SEQ ID NO: 665247 - DNA, 487 bp, Homo sapiens
ggcgtagtacagtccaccgtagtccaaagagtacatatagtgcaccaagtgtcacctacatacacactaagctatcgaacatacatctgctgtccaggaacgcttaggagacattcctgcctttctacatggaaaacacatagtacaagtattggaataatctgtaattcaacacggcatattcatgtactacatatttcagcactaaggcggttgcttcactttatatctatataacacacagtggtaacaatcttttccttttgtgcagataaacccatcctacattcagattctctcaagcactaatacaaatacttatttggtagaggaagatttcaggcaagtacgggcccttccaaaggccactgtgagacctcccccgcccaatccccgttatagctcccattgtctttataactcgagtatgtcacaagtagaactgggtggaataagccacaaacttaaaaggctagttaatacacag

SEQ ID NO: 665248 - DNA, 378 bp, Homo sapiens
tgtttttaaaagaaccagtactggccgggtatgctggcttttacctgaaatcccagcacttgggaggccgaggcgagtggatcgcctgagatcgggagttgagaccagcctggccaacatggtaaaatcctgtctctactaaaaatataaaaattagccaggtgtagtggcgcgcgtctgtaatcccagctactcgggaggctgaggcaggagaatgcttgaatccgggaggtggaggttgcagtgagcctaggtcgtgccactgccctccagcctgggtgacagagcgactgcgtctccaaaaaaaaaaaggtaaaattaaaattaaaaaaaataataataaccagtatttggtttactaaaataaaatgccttggt

SEQ ID NO: 665249 - DNA, 117 bp, Homo sapiens
tctacacggatcccccagaggtcaggctcgctcatgtcaaacaaattgaacttattgaaaggaagacgagtacctatctttagtggggagtctagtagactattctcatgctgcgtg

SEQ ID NO: 665250 - DNA, 272 bp, Homo sapiens
tcaggtacaacagcgaaggaatatgaggggaagacttgagcgtcagtcaccaaagaaggcccggaactgtccagaggagtgaagaagagaaaaagaagcaggagagagaaaaaaacaaagttcgacgaacctctgcaaaatcatgaaagacatatcggagaaaaaagttgaaaacggtgagttgtgtcaaatccgatatggtgacagtctccattgctggtattggtcacagagcacgatactggcgtggacatgcaatacataggaggaga

SEQ ID NO: 665251 - DNA, 176 bp, Homo sapiens
ttttttttttaattttgaaaaaaacgcccttttttttttgtaaagggctaggaaatttccaattgtttccaggggcttttcctttttccttgccttccaacttttaaaccaaaccctttttttttttttttttaatatttcctaagggctttaaattaaattttttttaaaaagga

SEQ ID NO: 665252 - DNA, 1009 bp, Homo sapiens
agcggattgccgtgtgcgcacccggacgtgcggtcccctcggctcctcgcccatggacgcggacgatcccgggcccccaagggctccttgcgggaagtttcctggagcacctctccgtgggccggcaaggcatcggcgtgctgaccagcggcggggcatgctcaaggtatgaacgcttgcgtccgtgcccgtggtgcgcattgggtatctacgtgggggccaaggtgtcacttcatctacgagggctaaccacggggcattgggtgggaccggagcgctcaaaacattccgaagacggcaccagacgtaggaagacaagtggttctccaagcattccttgcaaagttgaggccgaggaccgaactcatttgggacaatgtgccagcgaggtatgccagagcccttttccggcacggcgggaacaggggcctgcctgcaaaggggcctgggttttggcacacaaccacgggcagtggcaaaacgcggccggggataatcaaccaaacaacgctgtgtggccgcatgacatcccgcgccggagagggcaccagggaccacgccccttccacaacggggggggccccaaaaaccctatctattcccggggaacaagtcgaacgagttgtgaacacgttgggagcaatgggcttgggacagcagacagcactgcggccaccaaacggaaaaacgggagcccagaacatattccggaaaacagagacagaggaccgggatgcacagaaacagatcacaggaccactacaccgaataaacacgagcgcgacgacggcacgccgatagcggagggggcgcccacccaacgccggacaacaatagggacttaccctatggcaggagaacaccaccggaacattttgaaacccacgatcgggccagcaggaccagcacacggtacccatgcgaacaaggaaatacaatcagaagagccggacgaacaagccaccgacacgaaccccaacgggccccaacaagccacaccaacgaagat

SEQ ID NO: 665253 - DNA, 122 bp, Homo sapiens
  misc_feature (11)..(11): n is a, c, g, or t
  misc_feature (34)..(34): n is a, c, g, or t
  misc_feature (109)..(109): n is a, c, g, or t
  misc_feature (119)..(119): n is a, c, g, or t
gtggcgatganaccactactgctgtattgtgcanacgcggggctggcgaccctcagggtggagctggaatctccagccaagtcctccgtgctcgtggtggaatcgtcanggtgtcttgntac

SEQ ID NO: 665254 - DNA, 265 bp, Homo sapiens
gtggccaggccgcgagcgcccctatcaaccccctattgtagtaaacttggaaccttggaaatgaccaggccaagactcaagcctccccagttctactgacctttgtccttaggtgtgaagtccagggttgctaggacaagaaatcagcagacacaggtgtagaccagagtgtttcttaaatggtgtaattttggtctctctgtgtcctggggaatactgggcatgctggagacatatcactcaattctctgaggacacagtagga

SEQ ID NO: 665255 - DNA, 131 bp, Homo sapiens
aatatgaatcatatgagataatgaatagaattcattcttaaggattgattcattcagttagggaggcagctaggcatggtgaacaggtgagcacaccttagttataattaactggaaggttggttaactat

SEQ ID NO: 665256 - DNA, 347 bp, Homo sapiens
  misc_feature (217)..(220): n is a, c, g, or t
gcaacaccctcctccccgagttataggaatagtacgcatcatgagactatatatgccagacacacgacgctaggtggtttgtatatctttataccacaataaccttgatgttaggtagtagtatccctgttttactgtgagaagacgtgaggcccagaaaggttaagtggataattgtatggctagtttgtgataaactaatagatactacaactannnnatttacctttctggttcttgtttttcagtcttacctttctctagcaattacatatttaagctcttttagagctagtttacaaatatatgttttatgttaggacttactgtgtggggagttttgaatt

SEQ ID NO: 665257 - DNA, 777 bp, Homo sapiens
  misc_feature (340)..(340): n is a, c, g, or t
agcgggggagccccggcgacccgggcttctgtgacacatggcgggtaggctgggaccataacacaatcatgactatctgaaggaagaggacggttttcctgaagatgaggtcgactgaatcggagatagataacactttaaagtttaggtagcagagttggatgcctttccgaaggttcgtgagagctatgtagagacttcagccagtggaggtacagtgtacctctaaatagctatttactactatggctttattagccatagatggaattctcagtatatcaaggatacatggacttgcaaagtactgaactacggaacgtagatcacaggcactttnattctaggcatagacttgacatgaagttccatcatatgatattactcgtttgccaatgcaagtgtcaactatgattgggagcggatgtgttggatttcgcagaccccatggttgcatctgcagatggtttagtgtatgaaccaagcagtcattgtgatctttcaccacagcagaagagcagtggctcgaggcatgctgtcagctgacttcagtagtaggctacaagtaagagcattcacgttccacgatgtgatatttcaagagagtgcttttgaacgagtacattccacagcgtcttccacctaaggagaagcatgattctgtccaccagtctcctaggatgcatgcgagaattccctggccatgctactttgtcgaataaaagtagcgagggcaatttttcgcataaccaggtggggcgacaggcaagtgccaca

SEQ ID NO: 665258 - DNA, 129 bp, Homo sapiens
  misc_feature (45)..(45): n is a, c, g, or t
  misc_feature (116)..(116): n is a, c, g, or t
  misc_feature (124)..(124): n is a, c, g, or t
cagcgtgaaatcaacttgttggcctatcatgtggcatgcatgggnatggtcctttccctaccggttcactgcttgaccttcgcttcctcagcaccttcaagcccccagcctacgangaaggatnttgtt

SEQ ID NO: 665259 - DNA, 252 bp, Homo sapiens
  misc_feature (6)..(6): n is a, c, g, or t
  misc_feature (198)..(198): n is a, c, g, or t
ggtttnttgggggtttggtttttcaccctttttgtgatttgcatgatgtgcttgcccactaacttttgaattgcactttttaataaatattcttaacatttttgaagaggtattttatctcatttgagatcatggtaggtaagaaaatatgctgttgtgaagtaaaagaatttatgaactaaaagggtgattgacctnatgtttacactccgtctaatgtttgatatataaataagtatttcaattaggaaa

SEQ ID NO: 665260 - DNA, 102 bp, Homo sapiens
aaatacatttgcctatgaaatgatcaaaggatttaagattttttttgagacggggtttcaccattgcactccagcctgggagacagagcaagactccatctc

SEQ ID NO: 665261 - DNA, 549 bp, Homo sapiens
aataccaataaaactctgaggagtacacacaggtacaagtgttttatgctatttgcttattctataccagagttataaacccttaagatagatggcaacataattgttaaattctacagattaacttcgctgcaattaaagcaacactcctcatagccaatagcatagtcacagtcttgagttgttatctggtgtgaacacagatttaagtccgataaagacatgtataaaaacattaatttatttgattgtcacagttagagctcctattagtataaaatggctgttgaacatcaaaacataaaaattttatttatacgatggcaaatataaatggcagaaaaatccacttttgaaaaaaattagaaagatatacaaatatatgtgcctaaaagtcagtgccacaatatgttacggtgccttaatacatagtgtaacttgacactaacaatttccagactcaaggaacatgtttttgtctaatataactatcctatttgtcaatattatggtggttttaccatttcagtgttctctattttatcccca

SEQ ID NO: 665262 - DNA, 532 bp, Homo sapiens
cctgggcagcgctgctgcagcgcacggcctcggccctgtgccacattctccacggtgattggtctgtgctctcagatctgcctacacttgtcataggattctggccactggccggccctttatgcccatcccatttagcctctctcacctctcagcatactgaccaaacccattacttctaacattttccaacaaagcttcctggacagcaaaaccttatgccctggctcttactttgccaccttcttaccttactctctcctggttaatacacaactctgacaaatccccaactctcatttcctaatattcccatttagccctctttaatgcccttccatatctgttgtttttctgcactgcatgttctggcccctacctcattcacacgttctctttccctatttagcatccaacctccatctttggttctctccttctttgcgatattgcatataagtctcctcagttgcttctctcacttttgggaagtcctaatatgcctcagttcagagcccggggggatcctcta

SEQ ID NO: 665263 - DNA, 451 bp, Homo sapiens
acagagcatctcatatggatgcgcgccagcttcagccaggtgagtatcacagtccatactagaatagtagcagagttcgatatagacttcagcagcatggatcggtaagccgatgagtgaatgatagtctggtatgcacattgcaagcttgttacataaggcttgatttaacgtgagcattctgcctgaggaaaatggcttaagcagtgtgagatgtgtgcgcatgtcatgataggcctgcggattaggtgcaccgtctatgaatctccggtctgagcccagcaagataggtataatctgggtcattatgcagatcaatgctcccatggcccttattctgggcatcctcctgtgagcgttgggtgattggaggctatgcagagtatttcatgatgctattacacacacgtcagttgtagcgcgtagagcgtacagggattgctagtataag

SEQ ID NO: 665264 - DNA, 123 bp, Homo sapiens
actatatttcctttagcttcctctctccaaactcctggactcacagcgatccttctactggtcctcccacacagtgctaggttaccactggcgtgaaccactgtgcccgtcccggtattttct

SEQ ID NO: 665265 - DNA, 1094 bp, Homo sapiens
atgaatcccctggcccaacccgtacatctattctaccatcttgcaggcacactcatcacaggcgctaagctcgcgacgtgagtttttgtaccctgaagtaggcctacgaagatagagacatgctagcgtgtatgatatccagttcatacccaaatagaactgaaccctcgtatatcaacagaaggctgccatcatggtatttcctcacagcaatgctacacgcatccataagtcctgtctaaatagcgtatcctcttcattcaatatacgtctcacggagcaagtgagaaccagtaaagcgcaagtgcatagcaatacaattacatcagtcactttaatcaactccactacagtggtcctacatagcacatgtagaacaggtaggacagtagccggccttctcagatgtggtggagatcccctacgaagggtttaaccacgcaaaagtggcaatgcgcgctcgtggagcacattcccgtggcacatgtcgtgtgcatttacttacaacgattgaatacaaaaaaagctaggaccgccgcccattacattctaacttcacattattacacaaaaattggcgtacatcgagcgtcccacatcgaaagcggtgaaggcccagttcgtcacggtcaagaatccgtcgttcgaaaattctatttagctcccaatgtcaataaaggctagagagcccagactatgaaaggggttgtggacatttactcaacacgaaaaaaccacgagccataacgacgaaagaaactcatgtcagacgattacctccagtacaagttaaaccgcaaagtagtgcggggcgtggaaaattaattaagaccggatgcctaccggctagaaaatacgccgtaaaagcaagttatacccaaattgcctttaatattgcaaccgtaagggaacttgtttgaataccataaaagctactttaacggcgattgcgataactaaagtcagacgtcacaggattcagaagaagacgagtgaaacagcgtaactcaacaaatcgtcgacacccatggaaaaccaagacgtaaaagagggcactaaagaccaatgagattccaatccaaaccatgcatcag

SEQ ID NO: 665266 - DNA, 1177 bp, Homo sapiens
  misc_feature (961)..(961): n is a, c, g, or t
ttaaattgacctcacagtgtctgcaggctgaacaggaagcattggctggggaaggccctcaggaaactgacaatcacggcaaaaggcaaaggggaaccaggcacttttggccagtgtttggagcaggaaaaacagaaagatttgaaggtgggagggcttgcacgcttttaaacaaccagaattcccacaagcgcctcactcaattattctacgagaaacagcaagggggaagttcggcccccattaagcccaattcaccttcccaccaggttccctcccaacaaacactgtgggaatttacaatttgtgaccattgtaaatttgtgggtgtgtgtggatataccaaagtgtgtaaaccagtgttcaaggggtataagtttcaacccgggttgtgaaagaaatatgtgattgtgatttgtgaatgtgaactgtggaagaaatgtgtgaaagtatccctagtgtcactctgtgtgtatcacccctatatgagagctggtgtgaagtagttgcaagatgtggacgcacaaatctctctgcgaaggctctctcacagtggagaaaaccctctcccgggcctactccccagaggggtgtctccaaggcacaaatttgtctactctcagtagtcctctcctaaggcgactctcctcacctattaagaatataatgcactttgggggagtacatatcatcggagggacagaacacgagcgccacaaacacccagagaaacaccactggtgtgggagcatataaaaaaatgtgtagagggggactaatattataattataccaaaagttaatacaaaacaaagcagagggggagaggtttattctctacgcaccacatgttgtattttttgatggccccgccgggatactgtgggaaatcaatgtttgtaagaaaacaagctgatcccccgtatgtaaaccccgcttgcggtggttagaatattaacanaccccccggttggtgcctactacacggaggagtagtactagtcaaacagatatttaaagcggccattggggacacaattttctcaacccaggggggcgcgtgttttgaaaaggccccaaacgcgcgggaacaccccgcgggggggaaaaaacatagaacacccacattgtggtagaaaactttttatacgaacaaacagaggggcagcaagggatc

SEQ ID NO: 665267 - DNA, 227 bp, Homo sapiens
agtgagaatgatcttcatgtagttagcatggtagaggacattgtgtggtacagggcattattgagtaatgaattataagtatagcagaatatgtatagtgtttataccatgatgctgctttcttcaaacctacatatccgcagtagtactttttctctattataaagtattaatttagagtaccattttatacttctgatgtcttcattagaaatacaaaaatacaa

SEQ ID NO: 665268 - DNA, 234 bp, Homo sapiens
gccatcgcactccagcctggacaagagcgaaactccatctcaaaaaaacaaaaggatatggcctgacacacaataaccattcctaaatgattcactctttttgtttgtttgagagaaaaggtttcattatgttgcctaggctggtctcaaactcccaaagtgctgagattacaggtgtaagctgccgcgtccggcccaattcatgattggggggggggggaggggggggaattc

SEQ ID NO: 665269 - DNA, 99 bp, Homo sapiens
ctcccacttggtagctcctgttcagaagtgtacttcaagcggataaatttcccatcaacatcactctcttcgatgcacacatttccagtggctagaggc

SEQ ID NO: 665270 - DNA, 344 bp, Homo sapiens
actagtctcccaatggctccaggggccccatttgtagatgtaccaagccgactctataccctatggcctgtgtcccttccttttcctctcttgctccagccttacttgtaattcctcagttcacacctccatcatgtctgtgagtctcaagatctcctagcccttctccagacctgttcaagacacccctagcccttctccagacctgttcaagacacccctagcccttctccagacctgttcacgtgcccctttcatcaatccccatgtgcagaaccatagttgtccatttcacattgacttccatgtatctggagggcaaggagccagctctgacccaaata

SEQ ID NO: 665271 - DNA, 383 bp, Homo sapiens
  misc_feature (35)..(35): n is a, c, g, or t
  misc_feature (328)..(328): n is a, c, g, or t
gccaagcccagctcagtgtggaccagcgcaggggnctatggaggcttaggaaatgcaaggtacctgcatggaccaggcaaacgtgtagggtgtgtgaagttcgagaccaggcggatggccctagggtgaaaccctgtaggagcacagacagggagggccctggcattgggccgtgtgaggacgtggcctttgttttccccagccctgagaagatgcataccattgaaaagcgtttccaactgaaggcaagagaaaggaaatgagaacacagagcaattaattttcacaaaattgacttttaaaagaattaattaacgtttaagtttgntacttggaagtctttggaatcatgtttcaagtgggtgttgttgagacagagaagt

SEQ ID NO: 665272 - DNA, 642 bp, Homo sapiens
  misc_feature (32)..(32): n is a, c, g, or t
  misc_feature (34)..(34): n is a, c, g, or t
  misc_feature (43)..(43): n is a, c, g, or t
  misc_feature (53)..(54): n is a, c, g, or t
  misc_feature (60)..(60): n is a, c, g, or t
  misc_feature (69)..(69): n is a, c, g, or t
  misc_feature (80)..(80): n is a, c, g, or t
  misc_feature (100)..(100): n is a, c, g, or t
  misc_feature (107)..(107): n is a, c, g, or t
  misc_feature (169)..(169): n is a, c, g, or t
  misc_feature (178)..(178): n is a, c, g, or t
agtacacgagacgcttcgaggagggtgaagtncnacgtttttnatgcgtggcnnaagacncccgtatcntttatggaggntctgtgatggggcaacctgnaaggagntggccagccagcctgatgtggatggcttccttgtgggtggtgcttccctcaagcccgaattngtggacatnatcaatgccaaacaatgagccccatccattttccctacccttcctgccaagccagggattaagcagcccagaagcccagtaactgccctttccctgcatatgcttttgatggtgtcatttgctccttcctgtggcctcatccaaactgtatcttcctttactgtttatattttccccctgtaatggttgggaccaggccaatcccttttccccttactataatggttggaactaaacgtccccaaggtggcttttccttggctgaaaaatggaaggcgtggtgggatttgctcctgggttccctaggccctagtgagggcaaaaaaaaaaccatcctttccctttttaccccgtgaggccaagatcccctcaaaaggcaggagtgctgccctttcccatggggcccgggcctttgtgctgtgtatgtgaaccccccatgtgagggaataaacctggccctagga

SEQ ID NO: 665273 - DNA, 108 bp, Homo sapiens
gggcgctgtggcctggtgggtgcgccttgtgcctggaggcgtgggaggcctgcccccagtcctgcgtgctacccacgcagatgccgtggctggcttcgcgggggcggc

SEQ ID NO: 665274 - DNA, 138 bp, Homo sapiens
caatactgtataccacctcatctcaaaccccaggaccgctcacagatcttgtctcgctgtgctgtgaacacaagacatgcagcaacctggacctgcctactctcacgccctgaaacatgtacccgtgcaaaactgttc

SEQ ID NO: 665275 - DNA, 226 bp, Homo sapiens
  misc_feature (142)..(142): n is a, c, g, or t
  misc_feature (160)..(160): n is a, c, g, or t
aggaccctttgtgcccagaacgacgaccagccttaagcaatcttatccgaagtacggatccggcttagcgatatccttacctacatttgtgcaccatgtcagagggtgtgccccttgggacctgtgcggatatgggtacggnccggtgcgagatttacancctcttcccccagtaagaacacaagggtttaaaattggcatttactttagattgttcatttcaata

SEQ ID NO: 665276 - DNA, 82 bp, Homo sapiens
aaccatattaattggtattggttaatttgtccagggttttgacagaattttgtttacaagtaataaaaattttatctccaaa

SEQ ID NO: 665277 - DNA, 118 bp, Homo sapiens
tcttgaccctccgttactgacatgaggcggagaacggcgtaagtcgggaagcggagctgcgtgagcgagattgtgccacttctctccaacctgggccacagtgatgagactccgtctc

SEQ ID NO: 665278 - DNA, 366 bp, Homo sapiens
  misc_feature (166)..(166): n is a, c, g, or t
  misc_feature (198)..(198): n is a, c, g, or t
  misc_feature (298)..(298): n is a, c, g, or t
tgttcttgaaaagtggttcagcttccacggtcatccctagacaatttgccttttttttttcaagacacggtcttgctcctgttgccaggctggatgacacgtggcgcttggatatgggtcactgcagccttgacttcccagtgtcaagcaatcctcccacctcggnctctggagttgcagcaggacgtgtgccaccanaccctgctaatttttaatttcattttttcagagatggggtttcactatgttggccaggctggtcttgaactcctgacctcaggtgattgcctgcctcggnctcccaaagtgctgggattacaggcgtgagccatcacgcccagccagtacttctgcaaggaacccacg

SEQ ID NO: 665279 - DNA, 130 bp, Homo sapiens
gcggggattcaaaaacggaaaaagcttcccaggtttacccttgggggggggggggttttttaaagaaaagggggttaggggggaccccccttcccccccccggccaaaataaagttgggcccccctttca

SEQ ID NO: 665280 - DNA, 173 bp, Homo sapiens
attcggatgatgatggagactgtgagcctttcacatatgatggaggacagagcttgctctgtaacatgcacaagattcccgtgatgatggtgagtatgagagcctgtcacatatgatgtagggccccactgcttcctctgtatgatgctcaagattcccgtgagcacacagga

SEQ ID NO: 665281 - DNA, 355 bp, Homo sapiens
ggcaagggacatgggttggagggatcgcttacacctgagacgaactacagaacagcacgtaccagaggttggaagtccaagtcaaacgcagaaggacttcctcacttagcaaccaagagtttcagttttacccgaggcgttctcagcagcagcaagtaccttttggtggatttccaggctgaccttaggcaggcattcttagctgagacaccagggaggtggttagcgccatattggagtagcggggaatctgattccaggcaaacacgaggctccatcactctgtagaggcttctcccagcttacattgctctgtaggagcaccgcgtacactatatcaggatcgctcccgaga

SEQ ID NO: 665282 - DNA, 755 bp, Homo sapiens
  misc_feature (433)..(433): n is a, c, g, or t
  misc_feature (511)..(511): n is a, c, g, or t
  misc_feature (537)..(537): n is a, c, g, or t
  misc_feature (545)..(545): n is a, c, g, or t
  misc_feature (582)..(582): n is a, c, g, or t
  misc_feature (595)..(595): n is a, c, g, or t
gccttttcccgcgcgtgctgccttcgccgctcgggccgccgggggaaaacatggcatctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttggggcggttccttggtggtttggttgggagagtgtttctatagtgcccgagtgctcccgagattgcaaagcgctattctcagcgtttagcatgctcttcatcaggcagttgtgatggggagcacattcgagtatgcaaacagacactttgctgggctttgcatcagctaacaaatgcacttgtggaaagaaaacagccctgcgaggaattggcatncttaagcaagccatagacaagatgcagatgatacaaaccagctgacctcaatacatgctgatctctgccagctttgtngctagcaaaatgctttaagcctgccntccatatntgacgtgatatgatggatatctgtaagagaatggagnctatgatgcaaanactttttatgtactatcatcatgggcgggatgatctatatctgtggtgaagagatttggatggagctgtctactttatgaacaggctataactactcctgggcttggcggagctatatcatgttggatcatactaaaacgaaattacggccgtgaatctg

SEQ ID NO: 665283 - DNA, 591 bp, Homo sapiens
gatatgatgcacctgggcgagtgcttggggatggtcggctgaggtgtgaatgccgatggcggcacgcacgctgcggtagcatgatgtgtaggatggcatgctgaacagttgtgatggcggtggcagaggctgtagctggctgctgaatgtggatgggttgcaggactggatggatggctggcggcctttgtacagctgaagcatgagaaaggcctatacattgctatggccagaatgctgctagctggatgtgttgctgacacagcaatgcatgaaagcttgctgatactatatccagtctccataaagggagatgaaggtgattgggcttggccttacacaatgagggccagacgaaaagcatcctcaagaccccagtctgtagaccatcaaatacgtaggaataccacacatgaacagcgtagcattaactagaaaggacaatgctcaaagagtcttgtgtgcttactaagagcacgcacaagataggaatacacaaggagccttggcatgacttgattgataatacaagggaacatccagggaagtcccccattcaatgaaggtcaggagaagatagaaatgagagag

SEQ ID NO: 665284 - DNA, 179 bp, Homo sapiens
gttgttggcagtgtagtgactcatgtaacttgtggcgtgtggagctgtcgccaaattttgattgtgaacataggtgtggctgattcatgagaggaccgctgtcctcagatgaaggagtgggtcggagctgtgatcgtgaatgaatatagggagtgagactcaccaggaagcagagggct

SEQ ID NO: 665285 - DNA, 368 bp, Homo sapiens
cggaacgcgtgggcggtgagcgagcctatcgcacacgaggacactgcctctcgccaaggagtctccttcactccctctccacgaagaaggagaagaggaaacacccagaaggaacgcctggtgcagagcccccattcctacttcactggaatgtgtaatgcccccggagtgctattaaatcaccaccggtctttagccacatgcaccaacgggaagttttgtgtgttggctgctcccctgtcctttgccagcctacaggaggaaacacaggcttacagaaggattttccttcaggaggaagcagcccttaaagccctttgagtcacagatgagtgggagaaccatttccattaacaccttttggatta

SEQ ID NO: 665286 - DNA, 431 bp, Homo sapiens
gtacaatcctcacaggtgctgagtcctgatgaaggggtgttggttggtgttagggagcacagaaaaggtgctgcgaccccatagagttatggaatctgatggagcagaaagtgactctaaaccggaggtcacgatgtacatcttcaaactgcacacgtaacctctgagcagaagcccctaggaggtggggaacaccagctacagacgcctccccggcacatagaatcacagtccatccccccaattcaaaaaaggtcctgccactactcaggactgtctaacaaagtacaagcagtgacagcaagttaactacaatcctacctcctacaccccttacgcccaaaccccagcatccctaagaagtgacccctagttagaggctgtggtgagctatgattgcacgatcctccactcaagggatacctctaaag

SEQ ID NO: 665287 - DNA, 233 bp, Homo sapiens
  misc_feature (223)..(223): n is a, c, g, or t
tcttatcgaattcgacggtttctcccgctatgggttgagtggaagagagggagacttttttacctggggttggtggtgtagtgaaacacaaggatgggagaggttttgcaaatagcctgagaacagaaaccaatgtgcagtcaccgacacacttgaccagttaactttgcacttgtacttggctgtggctgttcccggctgtggctccccttcggcttccttngtcttcttct

SEQ ID NO: 665288 - DNA, 165 bp, Homo sapiens
ctagatcttgagcatcacctgagcaaagaggagaatacggatgatatcaagaacaatgaggagaatcacaggtgatatcagaatctgctttactgaggcgttggctactatgtaaagtcaagcatctttcagtagactcataaaagcttgtagagcagagttgtc

SEQ ID NO: 665289 - DNA, 100 bp, Homo sapiens
cccccgtcagagctatctacaggcagcaggcttgtagcaggctgtgggtttggtgtggtttgtcagaggctaaggtctgcagagtttccacacccagaag

SEQ ID NO: 665290 - DNA, 226 bp, Homo sapiens
taataacatcgtaatcggtaggcttggaactgagagtaccgcgtaataatcggagcccccgagatggcgtctccccgtataaacgagataagcgtctgactcttacctccctctctcctacgcctggacgcatctggatataggtggaggcacggagccaggaacacggtagatcagtctacgctcccttagcagggtaactactcgcaccctggagcctccgaag

SEQ ID NO: 665291 - DNA, 207 bp, Homo sapiens
ctcgagcatagaggtaaagcattttaactaaaaaaaaaaaaaaaaaaaaatcctaatttggtttttaaagaaaaaaaaaaatctataaaattccctattggcttagataaatacgaatataatatcttactgtgttctcacttgggtggaacacaaatggtgccaagaaatccacgtcactatactgggcaaacccaaagggtgggg

SEQ ID NO: 665292 - DNA, 689 bp, Homo sapiens
ggctgctgcagtgttgtgagttggaagctggggagctcggcatggcggtccccgctgcggccatggtggccctcgtgcgttgggccagagcggccccggtctcgatggccccgtggtgctcagttgagcagcgtgcccgtcgtcgctactgtgcttgggatgcacggagtctgttccggggccacagcaagacgacgcgagttcctggcgcacagcgccaaggtgcacatcgtgtggccatggaggttgcgacgggagtcgccttagcctcggggtcctttctgacaatgacggacaagcgtcttcttgctggagaaggaccggttggtcaaagaacaacaatttatcggggacatggggatacgtgtggatccagcctttgttggcattccaacgtaattcctgacgctattccgtgtacggtcgtctggagattaataacccattcgcaatctgggactgtgaggatctacaaaatgcattgccactgtgaacactaaaggggagcaacattcaatatctgctggatgtcctcgatgggcagatcactggctgatacggcaactaaggatgactgtggtgaccgtaatagtggatgccaagcagcacacctgttccgataggccgaagagcaggtgcagaggttcgaggtcagacgaaatctccctggaacaatgacaatcagtatg

SEQ ID NO: 665293 - DNA, 331 bp, Homo sapiens
atgccgtgagacaacagtgaaaccccatctattaaaaaaaaaaaaaattagccggtcatggtggagggtgcctgtagtcccagctactcgggaggctgaggcaggagaattggcttgaacccgggaaggcagaggttgtagtgagctgagattgcgccactgcgctccagcctgggcgacagagcaagagtccatctaaaaaaaaaaaaaaaaaatttgcgtcctaaatgagcgaagacgaaatgagttcccttgaatgcccccaaaaaataattcagaaattaacaaaggtaaacccagtaacggtaattttcacaattaacttttggta

SEQ ID NO: 665294 - DNA, 283 bp, Homo sapiens
ctcttgagcatactaggcccattgtccggacgatgggtctgtagcatccagaaatccctctataccttgtggctctttcttctcatctgtgagctggcctaccacccgagtctcgtcattcccgctctcctctgggcccatgagaaccgattgacccctcgctatgtatacttacaccatgtcgtctgtgtctacacagcttttttcttatgagacagggtcttgctgtgtagcccaggttggtctctaattcctgggcccacgctgtcctcctagctcagcc

SEQ ID NO: 665295 - DNA, 272 bp, Homo sapiens
gttggtgcagccatgtataaggtatatagttgacaagcaaaaaaagtgctgccacctttgatgatgatttttgctaaatggagaaacatttggctgcatccacatagacctgtatgttttgtttcaagttgaaagcttgcctccctttggcaacattcgtaaatgaaagcagaattttgggggtgcttttgccaaatatgtgagttttgtgcttctaggatgtatcatgggtatttgggctctagtaataacacccattttaggtagcatgt

SEQ ID NO: 665296 - DNA, 304 bp, Homo sapiens
gtggtatctttgatagtagcagagggtccgggacaactgtgaaccaggacaggaaatgccaacattctcccacctctttcccacccaacagaattaagacagtgagtgggcagagctcatgtggcagtgagggtgccaggtggctgtagggtggaagtctaccctgcagggcagaaaggttctccattctgagccctctcttcaatggctcagaaagcctaacccgcgacaaccaatgtataccttgaccgccctccaagccatcaaggccctgtctttgttctgcaggataagtgtgatccct

SEQ ID NO: 665297 - DNA, 134 bp, Homo sapiens
tccaaagaattcggcacgaggcgactccttgacgttgacaatcgagtactactcccgattgaagccccattcgtataataattacatcacaagacgtcttgcactcatcgagctgtccccacattaggtctaaa

SEQ ID NO: 665298 - DNA, 1318 bp, Homo sapiens
  misc_feature (483)..(483): n is a, c, g, or t
agcggggaacgagattggcggcttcgtggtgagaagcggtgtaggagtacaaattggtatgcttcataaagcagatgctaagacaggcaggtgttcttctgtctatgaatcatccttgttttgcattaccgacttgtagtcatagcactgctgtggaacactagcccactgggcgtgtgagcatggagctcataaaatggagtggattggtctagaaggagaagctatcttgacaacatctttattaccatgtacagaatggacgactcttatattggtgttgtgttatcaaactcctacagtatgtactactgtgcgttacgcaagagtgacatgatagagttggagaacgtcatgagtcattgcctaatgaagctctactagatgggtacgggacaacaatagtgatggtaatcgacgcttcattatgttggaggaggggcacattgatgagaaacagcggcactaaagccataattcgcncttcaggcacacaagtattgcgctgaatgaaccactgaagttgactcgtcgcgaccgcgaaaggaacagcgattgtaatgccagagttgctctcgtgagaagaacccaagaattttgtggacaggcaaaagaagggttgtactatcaatggctttgtaggggcaaagtgaaccccgttatttgcagatatgaaaatcaccacggtataacgtctgaagacacttggttttaccgtataataccttcgaaactaagaaggcctacctcgggaaagagggtcaattgccatccgagtgtgtaacggcgctaaccttcacccatccatttgcatttcggattacaaagtacacttcctcggaatggtgctccctctccagaagcccggaaacttgaactgaggttagccccaagtaggaggtttcggcgatgtgtggcgacggaaaactccaaatcacgaatggaaataactgtctggctcttcgaagattattttggcccaatttttttgggtagcggaaaccatactttccaaggctcgtgggcctggtttaatttcctaggacgtaggggtcacctacattaacgttctcaatacgcctgcaccataccggtgtaactcataccacgagtagagttactttccttccaccaaattatttgcagaaacacggtggattaccctatggtacgagatattttcaagcccgaaaacacatccacgtgcgagacggatatggataccacttccgcgcccaaatgtggtcgttagtcaacagcttcctttgaaatgtcttcacacaagggggtaccccacagacaggcacaaaaatacttg

SEQ ID NO: 665299 - DNA, 173 bp, Homo sapiens
  misc_feature (37)..(37): n is a, c, g, or t
ccccagggaaaaaaaattctttccccaatagaaaggnctgcccagaaaagaaagaaagaaaagttcccctttgctttgggctcgctgtatattgataagggtaagaattgtgttgcatgaatacccgctttgggggggatttgaagtattttgatgttgtgttttgcaaatat

SEQ ID NO: 665300 - DNA, 439 bp, Homo sapiens
cagagattcatctcttgacctcagtgtcacatgtctgaaaatatcaagtatgtttgagtgtcagaacctgagaaagaagcgttgcctataataaaaccttcataaaataaacaactgatttctcaccaaattcatgaaggcaaaaactcattgaggtggcgtatcaaaagactgaaatacactgtcaatcaagaattatacactttcaaagaaaccttcaaaagtgaaggagaaattaaggtgaagataaagaaacaaacgctgatggagttcatggaacctagacagtccttatgagaaatgctatatggagtcccacagactgaactgaaaggagagtggagaggagcagaaaatcttacacctaaaaagaacaacagcaacaaggaaggtgtcccagaaatgtcattacatttgtgtatgtgagcgcaatagtgtt

SEQ ID NO: 665301 - DNA, 829 bp, Homo sapiens
tcgctggtgttgccctggctcccggatgtgcgattgttgggctgctggtgctgtgatttgctgtgatgtggctgcccagcctgcatgcatgcctgccgtcagctctggtgccctgtgctgcctgccttgccctgtgtgtgcattgaatgctggtgagtctgtgatgcttgtgatgctttgcctgtgttgccctggatgctgggatgtgatgactggatgcctgatccctgtgccttgagcaatgctgtgcctgcgcacattgaggtgatgtgctgtgctgtgcctgactggttgtgctgtgctggtggattgcatggaactgagcctctgactccatggttatcattggattcccatgctgctggtgacagccatgggtaaccatggatgcctgaacaacagagtccgttgacgcaagtggttcagccttttacataccatcccattttccaccaccctccgcaagaatggaattcccacagagtatggggtgccacacgactcaagactatgccggccagaccggtgagcataagcctgacactctacggaagtacgcaaggcccacgggtatgcagagcagcaactcacccagcacacaaaatggatctcttacgcagacagaaggttggagcacagacagacggccagcagtcacaggacacaaagtaggtgaaaattcgagagagtaatctaccccgaaacggttgcatttctctaatattccttccgcttccgggacctgacttcggcagatttttggggcggttggcaaatctagatttagaagtaatctttatgaacgttgtctaaggtgaatattgctacg

SEQ ID NO: 665302 - DNA, 653 bp, Homo sapiens
ctcctgcgatacacgttcacccaggcctggcccgccaacagctactcagctgcttaaactggccccacaagtaccagacccgagaccaagccagagaagaaaccagagactcgttggccccgggccgagaagaaggctgctggccaaggggacgtccccacgaagagaccccctgtccttcgagccggagttacaccgtcacccccttggtggagaaccagaaagctcagctggtggtgattgcacccgacgtggatccccatcgagctggttgtctttctttgcctgcccctgtgtctgtaaaatgggggtccccttactgcattatcaagggaaaggccagactgggacgtctagtccccccggaagacctgcacccactgtcgccttcacaccaggtgaactccggaagaccaaggcgctttggcttaagcttggtggaagctatccaggacccaattaccaatgaccagattacgattgagatcccccctcactggggtggccatagtcctgggtcctaagtctgtggctcgtatccccacagctcgaaaaggccaaggctaaagaacttgcccctaaactgggttaaatgtacactgttgagttttctgtacattaaaataattgaaataacaccaattttccttcca

SEQ ID NO: 665303 - DNA, 1950 bp, Homo sapiens
  misc_feature (96)..(96): n is a, c, g, or t
tagtctgcgtgctgttgtgtttctgggcgcgggtgtgcgtcgttccgtattttcctggttggtgctttgtcggctttggtgctgtgctctctagcngtctgctgtgttcgttgtgctgcttggtctgtctgttgctgcgtcgctgagtgttgtctgtggcgccgacgcgagtgctgtggtcgtgtcgcgcgtggttcttcggtgcggttgtctgtctgcttgcgtttgtttctgtgcctggggcgctcgtcgtgtgggttggcgggtggttgggtgggccggcttctgggggttgcgttgtgcggtgctgttctgtggcgtctgtttggttggttttgggcgttgtcgtgcgtgggtgctggcgcttggtgtctttcgtcctgtcggtctgtggtgtcttgcgtgtgttgttgtctcgctagtggttaggttttgtgttgcggttcccacgtttgtgttggacgctggtcccgtctgtgtgggtgtgtgcagatgaacctcaccgacttggcggctgttggttggtgggtgggccccccacttgtctgttgggatctctctgctcgagtggtgggggtgtccaccacagacgtgtgtgtgttgttacgccaccgtataagtctccgcgggctgttttggtggtttttattctcgtcgcggtgcctctccgttggtttctgttagtgttatccgcgttgtcgtttgtgtaatggtgttttggtcggtgggtcccttgtggtgtggggtccgtccatatttttctgtgccgcttccgttggtgggttttgtcctcttgggaggttgtgctcctccggtggtgctgatcgtctttggctgttgttcgctcctccaggttggtggtgtctcctcaacgatgagtgactctctattctgttggtccacagtgtggtgttcctgctcgggggaggttttttctctacttcgtatggtgatgtgcgactctcgtcgtcgcgatgagtctcggtacgcccgccggtggggcttgtggcacaagtgtgtggtgtgctgttccgctccccctgggaggtgtttctcgccccgtggtgggttactgctaggggtgtcgcccccctcttgtttttgttcgtgatgtcgctcttgtagcggccggctgttttgttgggggctcttttgtgtagagattttgtttgtgagggctaccccccgcgggcattattcgcccctcggtggtcggcccccccagaggtggaagtcgctccgcatctccccttgtggctgctctctgtggggcgcgctctcacaccgcgcttgtcttgagatgatagacgagatgtgttgtttttctcttgtgagagagagtgagagtgatgatggatgatttttgtgtgccccccccctccgggagcgctttgcgcactctctccgcgcgccccctggaggcgccacacccacctgtgtgctcaccccgcggtgggtgtgtgtggagaccccgcgtgtgacttcggcgtcgctgtgttccgcctctggtggtgtgggtcgccgcgccgttgtgggggtgtgcggtgcgccctgatgtgtaccgcgccgcctccgccgcgatatgtggccgcggggggatattgtgttgtgcagagagttgtgtatatatgtgtgggtgtgtggtggatgactggagaagtatatgtggccgttgaatatgtgtggagaagtgaaagtagtgatgattgtgttaccatgttgtgtgttgtatggctgtgggtgttaagataaggaggtccacgatgtgaatagcctcttggactttgtgagaggagaaaatgtttgttatgtttggagtgtttttgtggacaccagcgtttttagggtttgtttgacacatggaaaaaatagaagagtgatttatcccccccccttgtcgtgtttccccaaacaccccaaataaggggggtaccacccccgaaataaaat

SEQ ID NO: 665304 - DNA, 1459 bp, Homo sapiens
  misc_feature (321)..(321): n is a, c, g, or t
  misc_feature (944)..(944): n is a, c, g, or t
gcagctcctccgcccgaccgggcgctcgcactctgtcgctcctggtgcagtcaccaggacctcctcgcccgcgcgcgcgaccgatgctacagccagtcaatgatagaagatgcaagaatgctgaacgctcgactagggtagcaatctgcctatggcatcgagctgagcacggcgcgatgcctgacaagattggctggcggaagatatgacgcactgagactgtgagagtattgaccctggcatgttcaacatgccacagagaagaaaccttcgaaggtgacaccgaacgaatgagagctggagtaatatctacgtctgagnggcgtctccagatgaatgccgcaagagtaaaatatgctgtgatgctgagtcgagatggataagaatggccatccgatggccttgatagcccggacgcttagcatttcatcttgcaaacgaggacgacatccaagcatggattgaagggacagcagttcggcatcggatgcgcctagggcagcgtcgtaggccaactagcttttagcaggacacccgtgtgacgtgataggcttgatgaaagcgcatgcaagagtagacgaagatgaagcacgaagagctttgaaactccgttccatatgagagcagtccgaggcaccttgaaagaggacttgaaaccgacctgacaaagtagggaaggattgtcccagcgtacggtactacccaagatctgcaagacattggagggctacaactgcccataattagtgcgggcaaagaaattgtcggaacgcggacaaacaatactcgtagattgacgggtggggaccctcagcctaagaccatcgcgttcttagtccacttggagggatgccgaaccttgggggacacggttggacgaagtatcggaagctggggcttggaatgggtcgtcctagaaaaggggtcccaaaggttcgcggaanaaaggcgtgaggaacaggaagtgcaacgtttaaatgacactttgtgtgtggaattctcaagaagcactgtttgaaacagagcgcatttaacagtgggcgttggtgagaaagagggataataggtatagtttctcggctcaacacagaggaaacatgagacggaattattttcgcgtagtagaaaagttatacaagggagcgtagtatctagaagaaaaactgcacaaagacaggaagtctatagaaaacatgagggagggaaataatagcgcgcgaaaaaggtggtcaacaagcgagaattgggggagaaaaaaagaatgatatgaaattatataagaaacgaaacagagatatagtaacaaaaataaaaacatcacatattataacaacaaatggacgtcagagaatcacaaatacagatcaggaaacacacaaagagagaagagcagatcgataagacaaaaccttcttaataagaggggaaagaatgatgaacaaacgagactcgcacgaaa

SEQ ID NO: 665305 - DNA, 120 bp, Homo sapiens
tcgtgatggcacgttgatcgcgcaggatgaagtctagtcgtcaacgaaaaattcgggattcgcctcaccgatatcatcacccccgcggagcggatgcgtaagctccgcggcggataatcg

SEQ ID NO: 665306 - DNA, 156 bp, Homo sapiens
ctggacacatggtgaagacttggacattccttcaaagttactagataaagaaaacaatatttagtaaatgaaactagatttcaaggtaggaaaagtagtactcaagaatgtatttttggatacaaaaattcagttacacaatctgtcaatcataat

SEQ ID NO: 665307 - DNA, 343 bp, Homo sapiens
agcctgttcatcttctgcctcagtcatcagaacctgatggagttttgccctgaccaacccagagaagagcatgcaccaaagaaacggagagaaaggaaaccaaagcctgatggaggagctggatgcctgaagtcctggatggtgtaccacccgacgcatgagtggcatggcccttcagccatggataggctagtccctgcagaatcccatttattggctgaatcttcagactggggaaagagagtgcaaaactccaatatgaggacaagttcctgaaataacttgaaaggcaaaaggatggatatcaacaccaacacctacacatctacaggatactcaatga

SEQ ID NO: 665308 - DNA, 138 bp, Homo sapiens
  misc_feature (1)..(1): n is a, c, g, or t
natgtagcttctcgtgtacatcgcgcatcattggatatggtagtgtgttggtagtaggctagtattaggagcgttatggagtggaagttaaatcacatggctaggccggaggtcattaggagggctgtcgggggggta

SEQ ID NO: 665309 - DNA, 364 bp, Homo sapiens
cgagctgctggggaggctgaggcgggagaatggcgtgaacccgggaggcggagcttacagtgagcagagattgtgccactgtactccagcctgggcgacagcaagattctgtctcaaaaaaaaaaaaaaaaaggttttttttggcggggggaggaacatatttttcatggaacttcccaaacggtggcctttttttttggggggtttttgttggaggctgaggttaaggtttttcttaaaaaaaaaaaaaagggtttgggggaggagaaattttcccggccctttttttttttggcggttcccccttgtttaggcagttcccccttgggtaagaacttcccccttgattaaccacctccccctt

SEQ ID NO: 665310 - DNA, 1236 bp, Homo sapiens
gaatatggcgacctccacgggtccgctggcttctcctccgagcttgcactattcggcttcctctgggaagcgtcctggcggcctcgactcgggggcctcccgcgacgacgacttgctactgccctatccacgcgcgcgcgcgcgcatcccccgggactgcacacgggtgcgcgccggaaaccgcgagcacgagaagttggcctccgactcctcgcgactcccgcgaccgccggcggatctggccgtgcagcacctatcgtagtcgcaacttcagggaacccgcgccggtgaaccggaccaccggtgacgcgggaccagtagaggcccccttagcgccaccgatcctcgggtagcataggaagccaccgggatggggcccccaggggcgggcatgcaggcggggcggaggactgaacggcgccccaccggtgggcatgggacgaaccgggcggccgggagcgggcccagagctggcccgtggtacggccacgcaagaacaccgcggcccagctgtacttaccacggccgatgggcaacgtccgagagcacgaacgtggccattgcgacgaacaaccggtagggctggcaggacgaaccgaacggcggaccgggcgatgacggccaagacattcccacgcgggagagagactttgggccacggtaaaaacaggacagaccaacgtacacgggggggcaagtcccgggcacccggcggcaaagaggggcaaaccccctttgggctaccaaacccgggggagttaaacccgtgaggtctatgaagggcacaagcgaagggtacgcctaggccacgccaccgtggggacgaaaaagccccccaaggagatgcggagaccaacggccttgctctagcaacattcggcgaggcgcccgatggtgggcggccctgcgcgaccagccggacaaatagggcgacaagacactccataaccgcatgcaaaccgacaagcagcagcccaaagagaccaaacacaggacagggtgggacgaccacgcacggacccagccccggggcagtctaccacggggctagcccgctggtgaaggcacagcaagctatgggcgcacgacgctcggcactacagtcaggcccccacggcgaacacggggacccgacatgtggaccacggccacaaccccgtgagcacaaggagcgccacgacacatggacacgcccccctatgacatgggggcaacaaagcgcgccacaacgggggg

SEQ ID NO: 665311 - DNA, 541 bp, Homo sapiens
cccggcgcccgaagaatctgtcagaggttcccctggcccctccaaagacacgaaggatctttccctggaggaaacttccgaacgaaattacgaagctgcagaagaaagagcaagtcccatgaacgctgaggtctgaagcagctggctgagaaacgagagcacgagaaagaagtgcttcagaaggcactagacgagaacaacaacttcagtacaatggcagaagagaaactgacccacaaaatggaagctaataaagagaaccgagaggcacaaatggctgccaaactggaacgtttgcgagagaagtatcagcacattgacgaagtgcggaagaacaaagaatccaaagaccctgctgacgagactgaagctgactaatttgttctgagaactgactttctccccatccccttcctaaatattcaaagactgtactggccagtgtcattttattttttccctcctgacacatattttagaagctaatgtaggactgtataggtagatccaggtccagactgtcagatgtagttctagggga

SEQ ID NO: 665312 - DNA, 318 bp, Homo sapiens
cagagtccaacagtgcccaaatagcttaaaataagtttccttgactcagtctgatgaacgaatttcctttcctggccaacgcactaaaatgatacggctctgatgagtggaggaacaccagggttcttggtgctcatgccagtttagataaaacgacatggacacacgtggagtggttttaaggagcggagagtttaataggcaagagggacaagaaggaagggagaaggaagaagctcccctatacagagacagagggaggggggctccaaagccaagagagggaacccccatgacccttagtcttgagccatgagt

SEQ ID NO: 665313 - DNA, 141 bp, Homo sapiens
gaggatttagtgtcatcccctttgtgctgtcatctacttcgtggggtgcaggatccaccatcgtggggtgctgtgagggttggaggtcctgtgtgagccctgggaatgcatggttatctgagcagtagcatttcctgtgga

SEQ ID NO: 665314 - DNA, 215 bp, Homo sapiens
tctttcctccaggtcctgaaacctgtccccgttccagcatgattacaatcctcagggcgctcctgatgtatatggatgtgagatgatgttctgtttttattcccctctggcttttgtggaatgaaatgattttcactttgtaatcttgttaaccgtatcctctggacactgagactggaaggagaataataggatcttgttgtttttaaactata

SEQ ID NO: 665315 - DNA, 122 bp, Homo sapiens
taggccttttgctgcttttgacgtagactgttttcctgcaaatggtgcctgattatagaaaatttatgctctgtatatatgtggtatgatgaaactctgctactttcaaaaggctgcgataa

SEQ ID NO: 665316 - DNA, 1295 bp, Homo sapiens
gctacgcccgacttgtgcgcgcgggacgaccccgtcgttgcccttttcccctggactggacagtcgcggagtggcacgcacgatgcctggatgtgtaactgttaatactgacgttgacaccacggcagtgcatgcttcagtcaagagtctcctgttgacaagtactttcccgtcatccaatgtccgggagaagctagaagaagtccctcggaactgggctcggatactcgtaccaatcgcatggaccaaagcacatacaagaagtttgcgtccactatgactgaagaagcctgagttcctatgactgcggatccttgcttcgcgacaagactgcgagtacgctgtgaccatcctgtgggttggctgctttggggtgtttcggacattctccattgaggcgataggatcgttagtagagtgcgagtacaggtaccaagaaagaaagcaggtggtttccaatgactcgcgaagggtaaccgtatcgatgtcccgtaggagccatccccaaaaggaagtagtcgaggtccacgtggccagcggggttccccgttccaaaagcgccccatgccgtatgggggggcattgcaaatagatttgggtttgggaaatagacggtacgcaaaggcaattgtgccagtggccgcagcgcaaaaccattggacaggcactctccaagcggggacacgaagaacggaggtatctctttgggtaacgagggcaaatccagccgtgtgtaccagtgggttgtggccatgtgcgtcggcacaaaaagcgatacggcaaaggagcgatttttagtagaaacagaaacagctactggtgctaggggggatctcattagcttaaaacactttggggccgttaccaattttacgggtttgaacagtacgcgtgggaaagagttgaggcaaaagagaaagggaaaggaacttgtatgcgatatacagcataagacttgaacgatattaaaagaaagaatgggtcgcgagtgagggaagcaacattgcatgaaggggagggaagcggtgagttgaagcttcggacacaaagagctgaagttactagataaacgcagagtagggtgagagcttgacaagtgttggatccaacgcaagcggtagggtgtgacaactcaaagtagggattagggaacccgcttggattgggggtgtaagtagaaagctgggatggacgaaaggaaaaagatatcgggtggagaagcgggattctggagggccccatttggaagttacaagttgagcggggcgagacgatatagagtatatctccaaatg

SEQ ID NO: 665317 - DNA, 618 bp, Homo sapiens
  misc_feature (22)..(22): n is a, c, g, or t
  misc_feature (62)..(62): n is a, c, g, or t
  misc_feature (66)..(66): n is a, c, g, or t
  misc_feature (79)..(79): n is a, c, g, or t
  misc_feature (91)..(91): n is a, c, g, or t
  misc_feature (182)..(182): n is a, c, g, or t
  misc_feature (307)..(307): n is a, c, g, or t
  misc_feature (312)..(312): n is a, c, g, or t
  misc_feature (341)..(341): n is a, c, g, or t
  misc_feature (357)..(357): n is a, c, g, or t
  misc_feature (377)..(377): n is a, c, g, or t
  misc_feature (480)..(480): n is a, c, g, or t
  misc_feature (505)..(505): n is a, c, g, or t
  misc_feature (508)..(508): n is a, c, g, or t
  misc_feature (530)..(530): n is a, c, g, or t
  misc_feature (539)..(539): n is a, c, g, or t
  misc_feature (558)..(558): n is a, c, g, or t
  misc_feature (583)..(583): n is a, c, g, or t
ggactagactcttctggtaggnagagagcccctcctcggccagtttccgagcctggtccacnactnctcagttcttctngctcttggcttntgtggccttggcatccagcgtgcacggggcatgagtaaggcgcttcacagcatcaagcacacatggactacagtgctagcaccagcaaaanggcattaatgacagacaaagtaaaaccagaagtagagagggtggcccagcactccgtgctggaatccgtcgcggtgctctgtcaggaagtagagtcacatccccaaagatctcgcgcccacaganaccanaagctgtagaatgaagcggaggggatgcnggcggagaaaggcgancaccacccaaaggctgagtngtccccacaagcaagcagtgatggtttacatgcacacatgtgatagttgttacccaggatgtaccggctgtctcccttggcatactctttccagagttgaganaagaaggcttggactccaagcaggnctncgtagtagagaacgaaccagcnctcgatcancaggagaatgaacccacanactgcaaaccagcacagggacagtngccgccaagtccccaatgggacaaccgcagcacga

SEQ ID NO: 665318 - DNA, 97 bp, Homo sapiens
  misc_feature (2)..(2): n is a, c, g, or t
  misc_feature (87)..(87): n is a, c, g, or t
tntacaatttaatatccaatttaattttttaaaaacttaagtaaaaaatataacagaattgaaacatttaaggtacactcactaccnatctccagta

SEQ ID NO: 665319 - DNA, 150 bp, Homo sapiens
tgctaggattacaggtgtgagtgactgcctggccagcagagatttctgaggtagttttcctgctatagtaacactttggtcaaagtgcaggtctcgttaaggagaacaagtattccagtacatctttaaataccgttgcttgttccgctg

SEQ ID NO: 665320 - DNA, 105 bp, Homo sapiens
  misc_feature (5)..(5): n is a, c, g, or t
  misc_feature (34)..(34): n is a, c, g, or t
  misc_feature (62)..(62): n is a, c, g, or t
ctcgnaattcaagtcttctaacagatgtacgggngacatgaaaagcgtaaggagtgtatatntgtaatcaatagaccaacaactaaaataaaggctgatagatta

SEQ ID NO: 665321 - DNA, 225 bp, Homo sapiens
ggattttcatttggttcattgtatttaaatgtgagggatggatggctgcggggctccaagtaagttattgggatgttttttatattccaggtgggctggacatttttattttattttcccaaaagctttgtgatgtaaatgctatttccatgagaaaattcataaagggggttttgttcctttgaaatgtataatgtaaagacattaaatttcctcatttaagga

SEQ ID NO: 665322 - DNA, 709 bp, Homo sapiens
cgcacgcgtgcggtggacgcgtgggtcgacccatgcgtccggagatgtgtcagtagaagcatgagctttgaatataaagttatgagatgtcttcataggcagtatggcctatgcttctgccgacagaaacatacagtacaaagttctctaggagtgtctagtgtgttccagtgcaggttcgaagagaatataattatacttccgtcagctcatggttttgctaacactatctgggactccacattccacttcttaattgagtatgagggtggttggaaagctagccatacgttgaagtggcgtttgattgactaatcaaaaatgtacgcagacattatagcgcgaaaagaagcttacagacggaaggcacgtttcaagaagctaattcagctgtgccaggatattattcctagacatattcgcaccgtggaataggccacacaacgtatagaccatagacactaaggtgtgcatctcttagacgtggagtagtacacggcatcacgaacgaatttatagcattacagcagaaatacctgttgtcatggctcatgtcggtgcggggcatcaaggtccgtgtaagtcccatgcacatttgggacggccgacggtgtggcatgatcaccgagaggtcaggacgttcgagacccagccttgccaacgatagtgaaacccgtgtgctcgtactgaaatataactagatggcacg

SEQ ID NO: 665323 - DNA, 904 bp, Homo sapiens
ctctagaataggttgcgactgtctataggctcgtgtgctgtcccccctgttgtcctccccagtttgtgcccagcgaggttgaatgcgcggctctcgccttccgaaggcgttaacccttgtcgtcaggtgaagccctcctccctgggggcccggtgtttcccacgcagccgagggctcttttttcccgaggaaccggggttttctttcctgtccttgggggtctttacgcgcccctttcgaggggtatccttctcctaccggacgcctctcttttggtgactccttggacgaaggtgggaacccatttggtgacaacgccccccccctcgtgtggcgccgcgagctgacaccacgtcgtggtggcgaccaaactttagggccccccgggggccaccaaagggaaacgggccggccaaccatcccagcaaagttccccaagggtgcccccgcccctttctcatcacgagatggtcccctggccaccccctgatccagcggagctttccccacaagggggctcgtctcagaccccgtctactgaccgaacagaggttccccatcgagcgccatactttaatactggggggtagccagcgtggcgccccacgaacgcggggactccacccacggggggtctacacagggaaaggaactcccatcggggtgcttcccccacagggcaaccccacctggggggccccacgcgcgggcagtaaccaagcactaaggccgctgcacacattctcgctctgcccacccgtgaggagcatccccggaaacgaaatcacctccacgaggtgaaccggctcgtaactcaggagtcccccccacgcgagagtcacatggcagggccgctggcaccccttttcctttatcattattttcaacccccgcccacaagcaa

SEQ ID NO: 665324 - DNA, 157 bp, Homo sapiens
catcaacttctgactctgaggggtctgttccacttcggaaaacataggggcaagcacaaaagcacaaacatgggtcaaaggaaatcttaaaatgagaacacacaaaaaagtgaaagagaaattggaaggggaaaaaggacaaaagcataaggctccc

SEQ ID NO: 665325 - DNA, 863 bp, Homo sapiens
ggatgttatggaacttgagccttgatgtgaggaaggattctctgctgtgccggtgctgacttggacagtgattttccccattgatccagatcagattctatctggtatcctcataaaaaggaggccgggttcctactcccaagctgagagaacttggtggaatgcagaggacctcatcagtgatctcacgtactccagcatgttggtggtgctggtttagtgtctccatctaggatgaagcctccaggccctgaacagaggagaggattgacctctcaggattgtgtagaaacttcaggagaattgattccttagtaagaaagatggtcgtgctgtatccctactgacttctccagctgctggatataaaaagcatgtttgatcctctgcctttgcgggaccgattctgaaggacaatatccaaataatttgctgaggcaaactctgtccagtgtcaataaattccgttgatatacccaataaatcccccctggatagttcggcattctccaccatatgttccatgcctactgtgctatccgtcgtcgacgaatgcaagggctctcttagagagtcctagagtttcaggtagaatgtgggaagagcaggatgaacaattgtggagttaactcaaatgagggctttatgtgcacgatgggacacgattgctgagaatttctggtcgctctggaagtttaggctacggggtttgaaaatctgggacgagctaggaaagggggcgaatttggggtgaaactaaactcagggaggtgcttatttagggaaaatgggatttttaagggcggggacattggggggttccaattaggaagatatcaaacggtggggggtgggtgaatgag

SEQ ID NO: 665326 - DNA, 533 bp, Homo sapiens
  misc_feature (159)..(159): n is a, c, g, or t
ccccaagaggttgggttggccatccaggcgccgcgggtccagttttttcctctccctcccccagggagttttttattagataatgcggggggagagaaaccaccccctttgcccttggtcccgcccattctcgggcctagggtgccccccgatagaaangggtttccgcgcccccactattgggtggaattttttccggaaaagggctccccttttgcggggagaaacaccgtcccccgggttaggggtgggtccgtttttaaccggcccagggttcccccccttgggccccccccccccccgcccctggttggttttacttaaggaggggctcccctgtccccccccgggccaagggtttccggcaagaagcccatttttccgtttcccgcggtgaaaggttccattcccgcccccccccccggtccgaaggttttggtttatcccccctttatgggggccccaaacctttttttttcccccaatatgggggtctccccaaaaaccgcccctggatcctccaatgcctttga

SEQ ID NO: 665327 - DNA, 115 bp, Homo sapiens
atgtacagattgctggggcttggtgtaaaactaggcgggtgttttctcgtgtgaatgagggttttatgttgttaatgtggtgggtgagtgagccccatagtattgtggtgtgttg

SEQ ID NO: 665328 - DNA, 152 bp, Homo sapiens
  misc_feature (104)..(104): n is a, c, g, or t
  misc_feature (124)..(124): n is a, c, g, or t
cttaaatgcctgttgtgatatcttctttaaacctggagagattgaatcaacctttctctaaaattcctttcctttgcctcctcctctaacttttcctcctttcncgcttttcctcaggctttgnttttcctcatgctttgcttcactctatt

SEQ ID NO: 665329 - DNA, 310 bp, Homo sapiens
tggcatccatacgaaagtctcagttatttatggattcaatcatggtattccccaatagagatcacaatagagatctccaacagtgatctcaggcatttaagaggaaaaatattcccgggtaaaggggaaaatggtgcggatgtggcttcgggaaaacctccattctaaagcagcgtcatagtgaaccattccatttaaaactcgggacggtcccttctccagctgggctgtattccacattcagggagtaaaactggtatggatcatgggggccccatgtgggtcccaggggctctggggtaatttctgg

SEQ ID NO: 665330 - DNA, 245 bp, Homo sapiens
acacctttgattaatccagttaaagcttctgaagagcctacatcttagtggtaggagacaagaagacaaggaatgtcaacatagtggttacatgaaccctgtgctagattcagagaagacctgtggggaggttggaccaccagaggaaagatcttctttagaacagatcctactttatctaacacattcaatagccagaactctgtaagtgttttgtagcacttgggtaaccgacagctcgaatt

SEQ ID NO: 665331 - DNA, 238 bp, Homo sapiens
ggctttttttttccccctcctttggcccccctttgaatgtttccccgtttattgggatttttcccgccatcaaacccttcagggaaaatttccctagctttttactacctccgatcaaggacttttggtaattggcataacctcctggaatagttgaaacagggatatttttctttgcttccctctgttgtctttgtcttttcccgtcttcataaaagtgctggtgcccggggtttta

SEQ ID NO: 665332 - DNA, 556 bp, Homo sapiens
accggtcgccgagcggacagcataattaaaggaagtcgggatggatgctacgtttaaatacatgtgaaacatacggtgacaaacatactggggtttactattttttatcctaaagccatcaagagtgcctcccaaaataagaccagtgaagacaaagtatactatcaaatatggcttccagaacaaaaaccctctaacaagaatcaaacctatttacaaaattttacgagtcttttaaagtttcatgtgaaacaaaaggtctgatatagcagtggtaattaacatagaattttcttagtttcattcttcctctcttttaaacagatgtcacaaggtaagacccagaatggcgcttaggacttggggttcgactggattctgtgctgtcagtttgggaatctggcttctttgtgtggttatgcactggagttgggatctgagatgggcgagctgaagtgctatctgcgctgcttgtcctagggcttgggtggtaattaaaaggagtcactctgcagcaagagtcccagtaggtgaagtgtgtgtgcttgttccgctg

SEQ ID NO: 665333 - DNA, 1058 bp, Homo sapiens
gggcggtctccgtgggacctggcaggttccactgcccggaccccctggactccccaggccgagaaacgatagggacttggctgacggaggggcgaaggacagacagacggacggacacgcggagggtcgcagacctgggccgggactccctacctggtccagctgctctccctgactggatcccgtcgtccctccgcgtgtggggacccctcgacccagcccgatgactccgagatcccaggaattcatgcccgaagcggagagaccctcctagccttcgaggcgaccaccctaggctgcccacgccccttctgaagcacagggtggacgcagaagtcagcaggtgggcaggaggatgagaaagcgggcacggagcacggcagggacggacgcggacggcgagggagaagggggcggcgcatgggagaaggggagctacagcggagtctctgcgtgcccgcatgcgacgcgctgggtggcaactggaccccgggacgggcgacggcggcagggatcccgtcggcccacaacataggacgcacaagtcctgggaaccatgtaccgttccaggatatccaccagatttcccagaatacccgtgaaactgttgcaggtgaaggtatgatcaccacgtgactatcactacttgacgctggagtccgtccacagaattggaaccaccccgggtcgaatagaggtgcgcacaaacatcacacccttgagagtgggagacatatccccgatggcaaccaaggaggggaccagggaaggagactttgagccaagggggcaccaagagctagtaccccaggcggacaccagaaatctcactggagaaagagtcaggttagccaggggagtttaagccacggagaaagatagtttcggggaaaagatgtatggcctcgaggagtagcataagtacgggatgcaaattgagagagagagtaaatacgtagcgtattgtacagtaggattttgatagacaagattgacaagagtagtgcactaggtgatgggagtgcatatatagtatatagattatgttaagatatgaa

SEQ ID NO: 665334 - DNA, 1365 bp, Homo sapiens
gggaccagaagctttcagatttgatggtggtgtttgcaagcccatcgctacaagcaccaacacatgcaaacacatcactcaccatctttcacggcccagcaagttcatggcagcacttcacatgtatcatgctggcagcactgcactccatgatccacacagtactaggcacacatgggcctgggcaagccgtcagcaggccttggcaaacacccattgccagcagtgacatggcaggcatcattcacgtgccatcaagggcatgatttcaccattcatatcatgcaggcagtctatcgcatgcatgtgccagcagcagctttcataccctgcgccagcagaacaattgcaaatacatttgtacccttaacgtagtcttgccactgcaccgcacggagtcattccttccacactggaatgcactctggactcttacaccgtacgacagacggccaacagtcatcacatcgccattctcccgatccgctagcaggattttcgcaccgggacagtattgacagatagcagacaggaggcaaattaaaaaacgaggagcattattcgagtaatctgaaactttcctggacatcccagatacacacgtactcacctgtgtaattgccatttacaatcaattttaaccacagcacagccgccaccatccagcgcccacaaccaaccgcacgccacccgcaccacacccagcgcccacgaggaccgcacaacaaccgacaaaccaacgaaccaacgacgccccaacacaatgaccaaaaacatccgccacggcacacccaggcagcgaaccataccaacaaccccgccgaccgcaaactcacagcacaccaccctagcagcccccgccgcctatcccgacacaagaggaaaaacgagaaacaaaggacagccaaccagcaccaccacgacgagacgacaagacgaaaccaacgcgcacgacgcgcaccacaagcaaatcgacacactccaaccgcatggagacgacaagcagacgacacgccaccgagcatcgaagcgaaccgcgcccccgcacgtgccagcgagcaccgctgacgcacacgaccgacagagcgcagaacgaaaggcgaagagaacacacgcgaagggaaaggagccgggcgggcgacacggagcccaacacgggacgacaacgtagcccgagcggccgccaccacgacctagaaaggcgcaacgccgcaaacgaccagcaccacagcgcacacaccgctagcgagaaagacacggaatgcgagcagcgacacacggcagcccgtagctgcgcagaggcgaaagcgacgacgaaaaggagcagccgccaccacgaggacaacagcggctagcacaaccggc

SEQ ID NO: 665335 - DNA, 314 bp, Homo sapiens
tcgaactcttgacctcaatgtgatccacccgatcgggtcccagagtgctgggattacaggcgtgagccactgctccccgcctaaatgctacttagcttggttgctgattttgctgtgtgtttatgttttttttttttgggccatatttcagggcggggaagagcaggtgtctagtttttttccagccaacatcagagccggcagaattcttttaccatagagagggagtcgggaattcagccagtatgtgtgtgaccaggggtgtgtggttgaatgtgatgcctggtggaatattccatcctccagggtgctga

SEQ ID NO: 665336 - DNA, 575 bp, Homo sapiens
gtgacgcgtggggttgacggcttctggcgggtggcgggtgttgaaggcgagagacttgttatggcccgttgtcgcttctgtcccaagaaccggacggagagtgagggcacgagggtcgcgtgtcgggggtgctgtcagtcttccactgtacactgtcgtctgtgaggagcgctagtccgtgacatcttccgcgcaaccccttccggctccctttcctgaacgcctcgaggcgagcggcggccacccggaagaccagggcaaggccggcaaaccattcgccccccgaatgcgccgttaccacacgagagtccgccgagacgcgcggagaggaaggcgacaacagagaacaagacgaggccagagaccagcgaagacaacagagtgcacaaacgccccgcaaccaacaacgcccaacagacgagggcaccaacaggactagcagaaagagcacaaagacgaaaaaccacgaaaaaaagagaaggagagacgggacaaaaacacaaagaaaacgaccaaagaacagaaaggaagtgggacacacaacaacaaatgaaaaaagacaaacacgcagcgca

SEQ ID NO: 665337 - DNA, 235 bp, Homo sapiens
ctcgagaaggaagtcatcatgtatactcataaaacacaatttcattccttggtattattctctctgctgtgtgttaggtaagggctgcagagaaaataaggggtacactcacatatacacacctgaaactatcttgcaagtgttcccaaaccgtttctttgctatttattcccaaacattttaggaatttgttgactttaagatctcggtaagtttgtctcccgggggtaccgga

SEQ ID NO: 665338 - DNA, 393 bp, Homo sapiens
  misc_feature (2)..(2): n is a, c, g, or t
  misc_feature (33)..(33): n is a, c, g, or t
  misc_feature (314)..(314): n is a, c, g, or t
anaaaccccccacccatagggcctacagaaccnagtcgggagaaggaaggtggccttggcagcaatactcacccaatcccagacaccccctcaatggggctacagacagatatccctgtgatggggtacagttaagggacatctcaggactatttctcccattgcaattaaatccatgcacattgggtcggcagtgccccaccagtagagagagtaccagagtcagtccccagcccaagagaactaggcgactgcttgggttggcttctggatccatccataaaaggggtgccaccgaaccacaggcatgtacncacaagggcaatcccagacaagcccttaaatttgtaacccacccgaggggttcgccttgcccactccagcctggggaac

SEQ ID NO: 665339 - DNA, 119 bp, Homo sapiens
  misc_feature (12)..(12): n is a, c, g, or t
  misc_feature (38)..(38): n is a, c, g, or t
gctttggccctncaaacaaataaccggcccctaaaagntatgttatcccttttattaatcatcatccaagccctaagtttggcctatgagtgaccaccaaaaggatttgactggaccga

SEQ ID NO: 665340 - DNA, 414 bp, Homo sapiens
ggtcgacggagggatcatgaggtcaggagtttgaggccagtctggccaatacagtgaaaccccatctctactaaaaataaaaaaaattaactgggcatggtggcgggcgcctgtaatcccagctacttgggaggctgaggcaggagaaccacgtgaacctgggaggaaccccggaggtggaggttgcagtgagccgagatcgtgccactgcacttaagcccaggtgacagtgtgagactctgtctcaaacaaaataaatacctctctagtgaggtggctcacgcctgtaatcccagcactttgggaggccaaggcgggctgatcacttgaggacagaagtttgagaccagcctggccaacacggttaaacgccactactggtggcgggcactagtagtcccagctatttaggag

SEQ ID NO: 665341 - DNA, 225 bp, Homo sapiens
cacattgaatcactgttgacattacatgccaatggtttactcatgttgctgctgtggacgacagtacgggaaacgagaacaaaattactatcactaaatgacaagggccgttaggagcaaggaatacattgaacgtatggtccaggaagctcaggatgtacaacgctgaagatcagaagcagcagggacacggtgtcatccaagaaattcacagacagttcctat

SEQ ID NO: 665342 - DNA, 176 bp, Homo sapiens
cggcctcctgcccattcggggacatagcctgggatatctggatcttgggctgggactgagtgtgccaatggccattaggggcctgcatgagcacctcaggtagtgggcaggggtgtctgctatgcctggtgttgttcttgtccattgctgtcaccaataaaggcatggaagaacag

SEQ ID NO: 665343 - DNA, 434 bp, Homo sapiens
  misc_feature (65)..(65): n is a, c, g, or t
  misc_feature (426)..(426): n is a, c, g, or t
aaaagctggtcttggccggcctcgaggctcggcccttatggcggtccgcggccgcataataatantccccccccccccggtagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcgattctgcagcagattgaattaggatcctaataagaccgacccatggtcacttggttcgcataancaatccac

SEQ ID NO: 665344 - DNA, 194 bp, Homo sapiens
gctgatggacttcaagctatcctccagcctcagggctcgagtagcttgtgtgagcaaccacacctggttaattttttttttttagggatggggttttaccatgctgcccaggctggtcttgaactcctgagctcaacgttatttgtttgccttggcctcccaaagtgctgggattacagattgtgagtaggcag

SEQ ID NO: 665345 - DNA, 213 bp, Homo sapiens
tggtggtagttggggaggggatgctcctgggctctccctgtgtgcctggggtggggttgagcctcagtagtgagtcagagtctgaggagtccctgaggaggaggagctggagactgctgccgtcggactcattatcttcatcctcatcgtcatcctgcgtcgtcgtcgtgctattcacagcagtattacttctcctatctctcccagtcctag

SEQ ID NO: 665346 - DNA, 1844 bp, Homo sapiens
  misc_feature (65)..(65): n is a, c, g, or t
aaaagctggtcttggccggcctcgaggctcggcccttatggcggtccgcggccgcataataatantccccccccccccggtagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttgggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagtttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcatttttttctttgaataaatgtcactttttgaggcaaaagaaggaaccgtgaacattttagacacccttttctttggggtaggctcttgccccaggcgccggctcttctcccaaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattttgaataaaatgacttggaaactgaaaaaaaaaa

SEQ ID NO: 665347 - DNA, 129 bp, Homo sapiens
  misc_feature (35)..(35): n is a, c, g, or t
ggcacaatgacctgtcgaatccaccgtcagacgcntagggtctgaccgggtggcctgtgcctatcaccttttatgacaccttcccccccctgtattcccacccctggactggtggcccctgccttgggg

SEQ ID NO: 665348 - DNA, 1782 bp, Homo sapiens
  misc_feature (65)..(65): n is a, c, g, or t
aaaagctggtcttggccggcctcgaggctcggcccttatggcggtccgcggccgcataataatantccccccccccccggtagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttgggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagtttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctgggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcatttttttctttgaataaatgtcactttttgaggcaaaagaaggaaccgtgaacattttagacacccttttctttggggtaggctcttgccccaggcgccggctcttctcccaaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattttgaataaaatgacttggaaactgaaaaaaaaaa

SEQ ID NO: 665349 - DNA, 1492 bp, Homo sapiens
  misc_feature (65)..(65): n is a, c, g, or t
  misc_feature (1433)..(1433): n is a, c, g, or t
  misc_feature (1445)..(1445): n is a, c, g, or t
  misc_feature (1447)..(1448): n is a, c, g, or t
  misc_feature (1458)..(1458): n is a, c, g, or t
  misc_feature (1461)..(1463): n is a, c, g, or t
aaaagctggtcttggccggcctcgaggctcggcccttatggcggtccgcggccgcataataatantccccccccccccggtagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttgggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagtttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttcttggangaaatgtcagtntnntgaggcaaanagnnngccccgtgacattgtgagccccctatgta

SEQ ID NO: 665350 - DNA, 1853 bp, Homo sapiens
  misc_feature (160)..(160): n is a, c, g, or t
gggatcagtgtcgtgggacgccaaggaggtcccgtataccagaagacaaggtggcccgcgagtggcgagtggacggccgcgagagagccgtcactcgcaggagtacactaggaagtgagattgtatagaaacgcttggagagtagagcgatgaaccatcnatcgggcagtctcactttctcactgctggctgtcttgacgcgcgtaatggtatctggatgaaacgcccgtctgcgcagtccagctggcgagccatatcaaccatggtatcaaagggtatactgatgatgatatagtctctaatgctcgcagaatctggtgtgtactgtgagcaaacacaggtcaactgttcgccatgatcgaccttgctgcagtctagcatctgagagttcagatctaaaagccacccaggccttgggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagtttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcatttttttctttgaataaatgtcactttttgaggcaaaagaaggaaccgtgaacattttagacacccttttctttggggtaggctcttgccccaggcgccggctcttctcccaaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattttgaataaaatgacttggaaactgaaaaaaaaaa

SEQ ID NO: 665351 - DNA, 233 bp, Homo sapiens
  misc_feature (105)..(105): n is a, c, g, or t
  misc_feature (189)..(189): n is a, c, g, or t
ccacgcgtcgggagatctctggatcatgacatccttttcctggcctgccgccgcggctgcgccgggccgatacgactccagcgacccttggggggtcgccccagncctggtagccagcatctcctctgggatggcggtccaaatgtcaggccggcccggcgtctgcaccaggtccccatcgtacgcagncccgctgccttcccgtcctcccgccaaggggtgcgaacaggcag

SEQ ID NO: 665352 - DNA, 241 bp, Homo sapiens
atggtgatctagagatcccccaacgatggtcctcagcttggtcagctccaacacattgtgctttcctcaagttgggcatacagcagcaatgcctcatgaatacttggtatttcctcacttggaataccctttttttttttttttttttggggaagggtgtctcgttgtgttgggcccaggctaaagtgcaagggtgcaaccccggcccatggaaatcctcgggcttcagcctccctagata

SEQ ID NO: 665353 - DNA, 136 bp, Homo sapiens
ggccgcggcgttcccgctcctgctgctgctgctgctgctcgcctggtgcgcgggcgcctgccgaaggtgctccaatattacctcaaggattacagcctgaacaacagctacagttgtggaatgagataaaatgata

SEQ ID NO: 665354 - DNA, 1687 bp, Homo sapiens
  misc_feature (1127)..(1127): n is a, c, g, or t
ttatcgtgggtgatgatatacttgtggcgttgtattagaatgattgttgggtggggccccacacagtggttgtccggccgtcttgtttgtcctcttggtttggtggagatggttttccctcccgccgccgagagtcgcttgatttggtggagggaggcttgctttctccggcgggtttgtgtgtggtggtggggggtcgcccctcacccctgggttgggtggtgtggggatgacgagcttcataatatgtgtgggcgccactgtgtcctcctctgatgattccttctagagttggatagtggttgtttcccctcggtagttgtgttgtccccccgcagaaagtgtttgttacgtcgtgggttgggtgttacatgcagggaagatcctttttgtcgctctgtctccacccagttatcaacgagtgtgcatccactcgttggtgtgtccgccaggggacgacctcctcgtcgtgaagagggggtagtgttctaacaccaccagtggtggcggcaggtgaatgaaggatcgcctgctgtggggggagtaacataggtgtctcctctcgctgtggatatgatctgcgctgtagtataatggtggtggcccaacagcatgaaatgggatatatgtggagatgttctggggggagatatttgtgtgtgtcgcagcgtgtatgattggtcttcttcatcgtcagtatattattagaaggagagatgctcatcttccggggagatatataatttgcgccccccttcggtgccgcttattaaaatatcttcggggaggtgagtaggccaccccccccagcatgttttttcgtcgctcgtgtgctgtccatcattgaaaggggtgtgtgagaaaaatcgtctgtcgctcagacaactctcgcgcagagtggtgtttagtctctctcttagagtagagagatgcctctcccctcgcgctgtattggggctatatttctcagcacgcggtttctctcgcgtgtctgtgggttctaccatagggggagccacgcttgagactctgctctctcacatatcctctgcacatagctcacagcgggggggtttctcgcggacacacgcgtagtacgctgtgtgtctctctcttgtttctacagnccctctctctcctgagagacacacaggtgtgagagtgtggagatatgtgtgtgtggtctgtctgtagagtatgtgttgtgataggggttattaccgtgagggctcgcgctctgtgtgtggctctcacgcaagattctacacacatgtgtccacgcagtgtgtagagaatgtgtatggtgtgttcttatgggagaaatgtttgttgtataatgttttgtgtgttgttataacgaagaataaataataaacatatcacataagttgtttacaccacgggccacagtatattagccacgctgtgaaacacatttttaactcgcacgagaaattggtggtgtttggtgtcacgaaacaccacatgtggaatatatgttgttcacccccccgagattatatgggagaaaaaaataccagattctgtctttgtgggttgctctactatggcgatcccaccaggtactgtgactgaatcggccccttttgtttagaaaaatattttaaaaggttagtaaaaaaaagaaaaaatactcgagcatataactcgggctgagaagagtact

SEQ ID NO: 665355 - DNA, 398 bp, Homo sapiens
gactcattgctgttgacacagagatgtggtgttcaaatttcccttcaaggaaggatttattgccccagctgcagtgggtattttgatggaacagctttcagcttttaatccttccatggaacacatcactatggaaagccgtctcaccaaggtcatgcccttctaggagaggctcacatctaatgatggatggatggatagaggcagggacataaaagaccagccactctgactcaaactgggatgatccttttgagccatttctgctccagaactccctgtggctgagtctgtcaaacctatatcacagttcaacttcctctctacccagtccctctttctcccttccttcccacaggtgttgattgcaagagcactcctgaacattaaactttgtc

SEQ ID NO: 665356 - DNA, 182 bp, Homo sapiens
cagtcttgagcctcgcttggccgggcccgtttctcttccgaccgtgctacgttttcttttgcctgacgacgaccctcccactggacggcacggggacctttcttgtgactctttctgggtcggggtttgtgctagctgctacctggacggccgtacggggcttcgtgtggggtgctcctcta

SEQ ID NO: 665357 - DNA, 879 bp, Homo sapiens
tggcagggcttctgcaagccctctgctcccaccctggcccatttcagcagacgaggaaacaagatggcccgaagaagagttccgcccgggacggaacgtggcatagctcgcagaacagaacccagatctccgtgagtatccctctcctcttgctagccacgttgcgacgtcctcagcgggcatggaggcatgctggttgaccgcggtggccgatcggggatgctagtccagaccccaagcagtgtggggacgcccaatggaatagtttgctgactcagaggaagtcacgttagttgggggaactgtcacgagctatgcttcagtgaccagtgaatcgtggcaagaacgctgggcttactagttatagtagcccgtgtgcagtcgctgatgtactatgtttccaggacagacgagggtgagtccagggatggcgttggcaagatgggcttgcgaggtgacattccgacgatgggctaggaggtgagtgcccatgcacgtgtccagcgtgtgtggtccttaagccccttgtaggtaccggggacgtggtgaccggggtcgagatgaaaggctctcccttgcccttgggatccccgtctactccctcgatgcctagtgggagcctccctcttctgcttgagcctgtcgaggacaggttcgggaccctgttctccgtacctggcgtgtgtcaagaaatgaggcacgtgttgcaagccttcctccaacgtgacgtggcaggtcactgcctgctggggccgttaatccagctcttggacagggtgccaccctcctgttcttgcaggacgggcgggagttgtcaacttgtccgtgccacaggtggtggtgctgtgtggggggcccccggtctgggcctcccacctg

SEQ ID NO: 665358 - DNA, 91 bp, Homo sapiens
gccaaagatgtctacaaagaacatttccaagatgatgtctttaatgaaaagggatggaactacattcttgagaagtatgatgggcatcttc

SEQ ID NO: 665359 - DNA, 178 bp, Homo sapiens
tcggtaccccaaaatccaaacagggcccaagttaaaattaccccaaaattaccatgtgctggcacataccattattccactggtggctggaaaactgggttgcaggaatgtctgtcacttaaaagggccaccaccccaatggccatatggtagaaatgagggaaggatggactagaag

SEQ ID NO: 665360 - DNA, 707 bp, Homo sapiens
  misc_feature (462)..(462): n is a, c, g, or t
agaatcatgattaaattgagcgagcgctaactaatcacgcgaagagggccgcaggcgggccgtcttccgcaagcgtgcttccaggcctccactccccacctattcggcggtaccctgttacttctgctcctgcgcgctgcttcccgtcgacctcacagagcagtagcgaacactcacggagtcgataggggcgcgcaaagggggtagtgagcgggcgttgaccagtgcgcgctgcgcgacgctcttggagatgatctcttagagcatgactagagatccacgatacccggggtacgcagggacaattggagcctccggagctcacgggatgccggtcgaccgccggtcgcgggagtcccgccctgcctagcccgcacagtctcgttcacgcccgaccaggccagccgactctcgcgtggcctctgtcgtgtcccagatctagaccgaaactacttgtctggncttgctgctgtacaaactgagttatgctgacagacgaccttctcacgcgtttcttcagtgatgcctgcagcacttgtggcgaatagccaggttatctgtgaagtgtggcgccagtaatctacgaagaacgtacatgatggaatgatccgagcaaatcgtgctctagttaccgttatattgccatggacaccagaatttccaggtgttgtggtgcgaccaattggtgaatttcgtagttccataga

SEQ ID NO: 665361 - DNA, 671 bp, Homo sapiens
cgaaaattaaattgtacctggggtaagccttgaaggtgaatatattactctcccttgtttcaacaaaaaagcagtgcttgcttcccaaggcaggcttaataggagataatgctgacgccttgacctgtgaggtcaggaagtctacctaacctgcaagcctcaccctcgtcatgccaaaacaatcccaggttgtagacgtcagccctgctcttaacgcagtaatgaggcatgctctttgtcccggcgaccaagacaggcttccgtgtggcgagctcttcgcttagtgccaagcctttacgacagtgtggatcatagcaaggttatacagagaacgagggcgtgtatatggctcacaatcctttggcatccagtaacagtatgtgttcatcatatagtaagcacttcacctgacctggtggaactaaaggaattccctgtggggactgtaaccaggtcctttctaggcttgggtaggcaaatgtctgagctactgcaggtcactcatgtcaccacagtggcgcttgcttgccttggcccatgtatcgaagacagcattggcctctccgtgggcataagaagagataaggctgatttgaaccccagggttatgccctgagcagcaattgtgtcgcccaattatgaaaagggcatatatgctgagtatgtaatca

SEQ ID NO: 665362 - DNA, 174 bp, Homo sapiens
cggaggcctgaatgccccatgcgcaccccacagctcgcgctcctgcaagtgttctttctggtgttccccgatggcgtccggctcagcctcttcctcccatcaggcagtgcatcgtctttggagctgcagcagggacggatggcggaacctccagtcccttagaggcgactgaac

SEQ ID NO: 665363 - DNA, 1343 bp, Homo sapiens
tacttatatccacaccgctagccctcaccgatgaatctcataacccacgggtcccccacggctctgccaactgtagtgctcgactggttccttcatcacgcttcaggccaacgttcgaacgtcacctactgacgactggacgaactgtggcgcgatgtgaacgagaccgaaaacatggcctactgaactaccgcagcatgagacggctcacgtattaatgtcacatcaggcaagcaatacccatttagccacacaattcattcagcgcatgtggcatgcatgcacagcaacattagcctgcccatcaccccgagagatagcatgatccgtgattcagaatccagcaaatcgagtagtagtcacatcgacagtccacgtccagccgctggatagtagcaagctggcagctcggcaggacttcagatccgtcatcaagtctatccaggtccactatcagcctcgaacccatgggcgccaacatatactgggcgcatccaagacgcagcgcacactggctacacatgcagctaccaagcacaccctcatcagcagcctatgccagcgggcaaggccaccgccttagcaactctccaaagcacagcaagagaactttaaacccctacactcaggagccacaagccccttaagtcctctcaccagacggcgccccaccgctaccagccgagctcaccgcgccctaccctgcatagcctactcgttctacaaactaacctgcgtcaacaacactgcactgcacctactcggggagatcgcaccaccaacctggcatccagcggcaacactcaactcactcagacccatccctcggcgccacccctcacacacaaaccccatatccacgtgctgccccacaataccacaatagctcaccaaacacgcacgaacacgcccactacaccaccccgcaatccacccatcggtgcaaacctggccagcgcacaactcacacgacaacacccaccgcaacaacccaaaccaggcaggcagcaacggacacccaaacgacagacaactcacctcctacagcaggggaggcaacccaagcagactcgataagccggaacaccaacaacgacaatatggccctgcgcatgccaaccagaggcggccaaacccacaattaaaaagcaagcaccagcatcaccaacaaacgcccatgccaccccagggataccataatcaaacgtcaagccaccgacggcgcgcaccacgcgcgacaataccaagtgcaaaaacctgagagaaccacctcggtagacaacagcacaacactaaacactaccgagcagtggcgccccatcgacgcaagcgcaacccaccac

SEQ ID NO: 665364 - DNA, 177 bp, Homo sapiens
cagagtccaaacagtgctcagagtccaaacagtgccctcttgtctcagcctcccaagtaactgggaccacaggcctgccacctactaatttagcttgcctggctaaatttttttttctttttttgatacggaatctggctctgtcgcccaggctggagtgcagtggcgcgatctcgg

SEQ ID NO: 665365 - DNA, 225 bp, Homo sapiens
tgatcactcgtacatgctctgcggagagtgaatgtcatccatttcaccactgacaggtggctctgggtttactcggaccatgcccattccatgaaacacatgtgcccttgcgctctgcggaagtaaccatggtggacagccacacatggtaacctgccctcggtatatggaacatgccatagcatgcaggggtgctgcgaaggagccacagttcatttgatagtc

SEQ ID NO: 665366 - DNA, 815 bp, Homo sapiens
  misc_feature (295)..(295): n is a, c, g, or t
  misc_feature (312)..(312): n is a, c, g, or t
gccttcccaagagcccctgtggtccgggcgcgacaatggcggcggcggcgaccgccgtgcgctcctgatgcagcgagcttatggagcttccctccgtggccggggccggagcggctctttgactcgctccggcttcctgggtgactgcttcctactgctcgtgctgctgcatctagcgggcgccaggtcgggcttctgccgtcctcggtcctgcgcctctttcttcgcggatccactgttcttcctggtcagctgcgcgtctgcctagacagtgtccttcgcatgattcgtatgngcaggaccatagtagtngtcggtgctaggagtgctcgatggacccggactatgtgaaggcatcatccggactcacgggatacacacgtggtcagaggtccatcattgtccataccatagtgaacacgcgtttgcgagccagcaatcgatagtcaactttgccttagccagcctgttagacagcgcccttctagctcaagtaagttccccgcacagctctatgatgctgtcgtgggctcgtcgcgcggcttccatgagaagagtgacatggtgcgggggtgatgttggtggaagtcaccgtcagacgacgattgcgtgtgacttacctactgaaagggtcttcctcgccctatttgcctcttagtctgctatttcccgtggatcgaaagatggccaaccaatagcgccggtgaacgggagactaccgtagcgccttccagtttcccgggcccatgtaatactattccaaagagtgagtggtacaaatactacttttacccctggcaagagttcagatgacc

SEQ ID NO: 665367 - DNA, 781 bp, Homo sapiens
cacgcgtctgcaggctggaggctccggatgcccgagtaagcttcccacaggggagtttgaccatgggcaggacacctaccagccacccacccagtggacagcgagcgggcaggatgtgtgacgtgagccccaccagccagtgcctgcagctcctggagccttctgacaagtgggatggcaggacctggaggacctgcagatcctcatcaaggtcaccatgggaatgtgtaccacatgaccagcatctcagctgctggaccctggctcaagttccgtgggcgacttggataccatactccaacaacctgctcattaggtgccatcaacattgaaaaccggcaaggccaactccgtgcgcagtgccgtcactcaggagttctgggcccgtaccctgacactgccgctacataccacggataacattgtgactacaggtgaggttgggcgatcgggagaacgatgaactagcgggagaaggggcctcgattgcccggggaggccattgcagcctctgagaggcccatcgccagcccctttgggggggacctggggccgctcagtccactccgaacgaggctatttggccagtgaatccccccgaagaaacaactgaaggagaaagggcccttgcctgagctcttgacccttcgattgacccgggtggcctacctaaaagaattcgccactggttgggacaaggcgtggacctagatcaaggggaccttgaaggactttcaggcgcctgggcaaggcaccgtgaagtgcatcattgatagaccca

SEQ ID NO: 665368 - DNA, 489 bp, Homo sapiens
  misc_feature (469)..(469): n is a, c, g, or t
gtaaaaaaaattcttggagccctcagtctctccaagttgggctaattcaccagcaagtgaagctgagtccaatctgaggctacagcccatctagctatgttaccaatttctttcttattcccatttccccttctgtcagcttttttatcctttatttaaaaattcctgcccctatgatcattattttaaatcagtgctagacgctaagcagagctgcattgcctaaggctagagatggggagagggaatggagtaccagggggcaaagcagaccgtgcagggtgaggggactgttttgtatcttgacgatagcagtgattacaccttgtatacaaatgccaaaattcatcaaactgtacacttaaaattgatgatgtttattttatgtaagctataccttaataaaaagaaaaagtgttcaaaagatcatgttttcacacaaagtaggcatgtaataaattaataaaanaataatcattaccacagtaa

SEQ ID NO: 665369 - DNA, 353 bp, Homo sapiens
  misc_feature (42)..(42): n is a, c, g, or t
gtctgagcaagcttgaaaagtactttcttttctgggaacaanttctttggtgaacttcagtgcactattagcgaggtgggggcttctggtgtttttggggaaccaccagaggccccttcttttcaggaacaacctcctatgggcacctccgggcactttcagtgggtgggtacgttcaggttttttgggcaacgacagcgggtgctttcttttcggggacaggtttcttaggtggtacggtcacttgtgggaggcgccgctggttcttggctcttccacaatttcagcgggaggtcttctagggcaccttcctcaggctcctcgaacacttcggggggaggccttcccagttt

SEQ ID NO: 665370 - DNA, 368 bp, Homo sapiens
ttgcacgtcatcctgtatgcctgtgaggtgccgccgtaatctggggctttgtcaacacggaccagatcgccaaggatgtgaagcagttctatgaccaggccctacagcaggccgtggtgaatgatgacgccaacaccgccaaggctgtggtgaagacctcccacgagacgcttgactgctgtggctccagcacacttgactgctttgaccacctcagtgctcacgaacaattggtgtccctcgggcagcaaaatcatcagcaccctcttcaaggaggcatgccaccagaagatcgacgacctcttctccgggaagctgtaacctcatcggcattgatgccatcgtggtcgctgtgatcatgatcttcg

SEQ ID NO: 665371 - DNA, 433 bp, Homo sapiens
caaacaaagatcaaaattttctggaattaacaacacgagtagaaaagaggttgttaaaagaatgctttcacacttgtgacagtttatacaatgaaatcaccgttatcccattctttatcaggtatttgaccctgcccagatgggtaaagttagaaacatcctacatgttcacatttgtatattaaatataaagtttctatgaaaaatagctaagaagagtgcggtggctcatgcctgtaatctcagcactttgggaagccaaggagggtgggctgcttgagcttagggggttgagaccagactggcaaacatggcaaaaccccatctctacaaaaaaatacaaaaaattagctgggtgtggtgtgtgtacctgtaatcccaactactcgggaggctgaggcaggagaatcgcatgaacccagaaatattaaag

SEQ ID NO: 665372 - DNA, 947 bp, Homo sapiens
tgggggggggcccccttttaaaagggggtttggggccaaaaggcggccaagggggggggacacgggggaaagcccccccttccccccaaaaaagggggttcccccccccttttcccccgggggggggggctcccgccaaaaagaacccgccagaggggaggcgacccgacgtgacccccacgagtggttaacaaggtgctcgcgcgtggaagagacctcacagccacgtcgtcgatgccccacaccaccaccggggtgtggcccgcaagcgaggaggatgaacaccgcccaggacaggagcgtgcatccccccacagcacacacagcaggaaacagccggagacgcacaacacccgcgcgaccgcacgacgcgctcccctcagcagagggaggggcccacagtgaggggacaggccgacaatgcgcgcgacggcacgagagagggtcgcagcagccgccgaatagaaaggaaacgggggcgggcgctcccccgcgagcagagaaggccatctttcttcgcggccgcggacagaaaaagccccctcgagagggacgccccctcatcagaagaggtgtgtgtcgctcgtcaggagacaaccaccacaaacaccctgtagaaaaagagagccccccgacatcacgaggagaccacgcgcgcgagaagagagtatgtcacccccccaagaagaaatcgtgcccccccgcgtagtgacaaccaccacggatcgtagcgaagaggcgggtgtaacaaatacatcacagcgccgcacaccctctgatagcacaccagaggacaaagaatggcgccgcaccacgaggctaccgcaccccgactgactgagaggcacacccattcaaggaacgagggcacaaataaaacaggggggcgccaacaaagcaccaccccacaatcccatcacgaagagccacccaggaaaacacacagg

SEQ ID NO: 665373 - DNA, 153 bp, Homo sapiens
atgctaagttaaataaaaattcagaagtgtgccaggaaaatgcgtttgatggtaaacggaatcacatttatggtttgtgatttcggaattttttagtatacattttattgctaccttttgtttcccttgtgacaaatactacgaacgtcaaag

SEQ ID NO: 665374 - DNA, 269 bp, Homo sapiens
ttttttaaaatttaaataagggatcccttttccaaatgcagtaatccaaatgtggtctagtgtaatgaaataaaatgtgatctagtgtaatggaagaccttttagaacctgggggtattaactttgggtatatagggtaaatatcccccctggactgttaaaggcccacaattttagtatggcttgttggcaaaaagtgctaccccgtttcaattaaacaatgtatgtttgttttaactgaactaaaataaatacctgctttatcctga

SEQ ID NO: 665375 - DNA, 212 bp, Homo sapiens
tggtgcctgaagctgaggagaagtttttggaggatgttaaaaagtcgtaccactcagaagccttcactgtcaacttaaaggacaccgaagaggccaagaaacagatcaacgattacgtggagaagggtactaaagggaaaatagtggatctggtcaaggagctcaacagagacacagatttcgctctggcgaatcacacatgctcagcagac

SEQ ID NO: 665376 - DNA, 112 bp, Homo sapiens
ctatcatgaaaggcggcctgcgttggacaaggaaatatcttcacataaaaactagagagaagcattgtcagaaacttcttggtgatgattgcattcaactcacggagctgag

SEQ ID NO: 665377 - DNA, 393 bp, Homo sapiens
  misc_feature (3)..(3): n is a, c, g, or t
  misc_feature (9)..(9): n is a, c, g, or t
  misc_feature (41)..(41): n is a, c, g, or t
  misc_feature (129)..(129): n is a, c, g, or t
  misc_feature (201)..(201): n is a, c, g, or t
  misc_feature (270)..(270): n is a, c, g, or t
  misc_feature (297)..(297): n is a, c, g, or t
  misc_feature (307)..(307): n is a, c, g, or t
  misc_feature (328)..(328): n is a, c, g, or t
  misc_feature (351)..(351): n is a, c, g, or t
  misc_feature (388)..(388): n is a, c, g, or t
ggncagggncaggctccctgatgggcctttactccccgttncccgtaagccacagagagggtcctgccgagggtcaaaacctattggccatgatagccaagatgccctgtcccttttcatttaggtccncacggtgtgcagaggctacatgatgtgtgatgacacccctcattgatgttaatgaatggtgctatacttganttttctaaggtgtcattagcaattctcctgcctcagcctcctgcataactgggactacagggaagcacnattttccaccaaaactctcaagaaggncttgttgcanctggaaaagcaattaaatgtnaatcgtgatccaggagaaagtancaactcacataactcccaaattaaaagttttccattngataa

SEQ ID NO: 665378 - DNA, 742 bp, Homo sapiens
gacattctgttagaatagccccaagtaatgagtaacgggagccgagtgcttgtgatagtagagccacattcttgtctctaacacacccgttttgtttggtcccatccctgtatctctcgttgtgagatcgttgggtgtatgctccccatggaattctgggtgaaactagtatcaactgatgtcctttgactttcacagggggcggcatatagatatcattgtaacatactaggtgaatggggttttaccccatcctagttttagtccttttcaatgctttatacaagtttgacctgttaagaatatgtggatacctccacgtatgtgctctggacaccctttatgccaagcctaaacagaggattctgtaactatggaatacgcatcgctgagagcttatctgaggtacccatgaagtcctgagcatacgtaccagtgaattccgcaagatgtaagatggcactagtaaatgtaggcctggtttttactacaagaattcccgagcatgcatggtcctccctgcaactgaacatttgcaacatgctactgatattagggcttttttttttttgggacaatgcctctgtcccaattctgagtaacagcctctggttcttgccatctaccagagttctctagcaaatctgagcatctaacagggtgaaaaacttcctgaaatggcttccgtgattgcctgactttactgggatcaaattcaagttgcacgctggcactcagtgta

SEQ ID NO: 665379 - DNA, 185 bp, Homo sapiens
cataacactaggacagaactttacaataaaccgcttacattcaaatgcttcagttattatgtatacaagtcttaaagtgcatctactatgtcaggaatacatttcagtaggttggtggattcaggagcttggatgggagaaggagagggagaagggaactggtccagaatggtgtagaaattgaa

SEQ ID NO: 665380 - DNA, 164 bp, Homo sapiens
  misc_feature (148)..(148): n is a, c, g, or t
tgcagccaagcatgagaggcctcagaagaatctaaagctgtcgacaccttgttcctggactttcagccttccagaactgcaggaaaatttagtttctattgtgtaagtcactcatgatttgtgtgtatctttgtttcattggtatccnttagtcaaacgtatat

SEQ ID NO: 665381 - DNA, 445 bp, Homo sapiens
  misc_feature (3)..(3): n is a, c, g, or t
  misc_feature (47)..(47): n is a, c, g, or t
  misc_feature (118)..(118): n is a, c, g, or t
  misc_feature (140)..(140): n is a, c, g, or t
agnatcaacccttcacactataacttggttgtatagcctttctcagngctgtcagtcccacatacgatcatttctttacaaatgatttaatatgtatctgtgtcaggacataagtcantgggacagtagctttccgctanatattgcgtgaactctgttaaaactgattatcactcatcatggctttatttttaacctataataaccctttcatatactggtttttacagcattgcaaatctgtaaaataacttttattggaaaatgtcatgagtcatttttcattatttgtactaaacaatgttttatgtactccttttgtgttttatcttttgtttttccatctgtactcccctcatcctcctaatgttgagaaaatcaaatttcctgggagtgtccttgttaagtgatcaaaagtaaatgttctctttgccattttagatgg

SEQ ID NO: 665382 - DNA, 100 bp, Homo sapiens
  misc_feature (18)..(18): n is a, c, g, or t
  misc_feature (75)..(75): n is a, c, g, or t
ttacattgtatgtatatnccatattttgttgatgtactcattagttgactgtttttctaaatttttgaattatgnaaatatccattcaaaaattaaactt

SEQ ID NO: 665383 - DNA, 441 bp, Homo sapiens
  misc_feature (298)..(298): n is a, c, g, or t
ggagagggggctcatctcattctaaagctaaaaggcttccaaataccttattctatgtcccggtaattcatatagtatattttactttcttccccaaatactacagaatggaaaagagaacatttaaaaatacaaggacacttaggaaagtaaagaaagctaattttatatggaacaatcatcagattaaaaattacttatggaggcgggacaggggggctcaggccggtaatcccagcacttggggaggccgaggcgaggcggacggcttgagcccgggagtgcgaggccagccggngcaacaaagtgagacctcttctctacaaaagacaaatcgagaagtgaggcgggaggatggttggagcccaggaggtcacgagggcaataagctgtcatcgtgccatggcactcccaacggaacagagggagggagaccccgtc

SEQ ID NO: 665384 - DNA, 128 bp, Homo sapiens
gcacctacaaagagtgagtgtatatttgatattcacatgcaacgttaaaattaggacgtaatctcttaatgactcctgttgaaatgttaaggaaaataaaattatttcagggcaaattaaaagaattc

SEQ ID NO: 665385 - DNA, 144 bp, Homo sapiens
cgcaggcatccccagtggtgcaagcagtggcccaaccgtgggcacaggcaacagcaggcaagcctgtgcaatgtcgtggttctcattccatgcaacacatcagcctgcacagggcacaacagtgtggtcaggccatgcacagca

SEQ ID NO: 665386 - DNA, 168 bp, Homo sapiens
aggggaagcttttaaaggacacgaagtccctgttacgcggtgttggaccaaggttggtaagtccacaaagctgatcgcagagttggcgatggttttctggtggagacggccgtggtaggtaagcatctgcagctcatctggaatactacagtcttgaggacgtgcttt

SEQ ID NO: 665387 - DNA, 206 bp, Homo sapiens
tgaagtagatgtagagttttattagtttttgttgttaatgcaaacaggttaccaggttaaaataatgggttacaaaatagtattgtaatccttatggtaacctcaaacctataaaacatacactggatacataaaaaataaaaagcaaaaacctaaatcatatcaccagagcaaactaccttccctaaggaggtgaaggagggggg

SEQ ID NO: 665388 - DNA, 1223 bp, Homo sapiens
  misc_feature (172)..(173): n is a, c, g, or t
  misc_feature (180)..(180): n is a, c, g, or t
  misc_feature (182)..(182): n is a, c, g, or t
  misc_feature (185)..(185): n is a, c, g, or t
  misc_feature (231)..(231): n is a, c, g, or t
  misc_feature (233)..(233): n is a, c, g, or t
  misc_feature (235)..(235): n is a, c, g, or t
  misc_feature (237)..(238): n is a, c, g, or t
  misc_feature (241)..(243): n is a, c, g, or t
  misc_feature (245)..(246): n is a, c, g, or t
  misc_feature (248)..(248): n is a, c, g, or t
  misc_feature (251)..(251): n is a, c, g, or t
  misc_feature (266)..(267): n is a, c, g, or t
  misc_feature (271)..(271): n is a, c, g, or t
  misc_feature (300)..(300): n is a, c, g, or t
ggagagagagagagaggtggcagccaggtcggcccgcaggccagaggctgtggctcggatcccaccgctgcggaggggtgccaccacgctgggtgtgacaacgccagctgtgtcctggggagatgctcccacggaggtggtggcctgctcggggagcctgaaggcctccccnnaccagcnangangggtctggctcccaaggcgggcttcctcccgaggcccagtggggcngncncnnccnnngnncncanccatgcggaagtccnngccntggagcagaggagcagccgcggcctcggnccctccgcatgctgtgaacccggcgcgggtcagggctgcgtggtggatcgcttcagagagggcaggacggagcaccagtaccccagcgagccgggctgaggcatgtcatgtcacccaggggaccaagtccaagtcgcgtagaacggcgccgggggcaggacaagggacgaaggccagcgcgacgcgtctgtggctcgtgactactgcgtactgctaggacagcgggtatcgacacggctcttggacgtcacatgctacgtagagcaagggccgggggaagcccctggggctgggctccaccggagcttggtacaccgaaagcgtggggatgatgaccacaccatcgcgagaccccccacacaccggatcccagtcgtccccgaggcatgataagagaggcggactgccacgatcaaaggcgctgttgggggagaccccgccaaagaccaccccttgattgggttggcactgcaacaggggacccggcgcgccgataggatgaggcttaggtgagagatccacgagagcatcgtggagagtgcccgtacaggttgacacagcgtagataatcacagggacctcctgggggaacgggggcaggggaccccctggggcgaggacctggtgcgccgggttccccacgaaggcgggacccccaacgggggacccgggggcacacaagagggttcgacaggcaagaagaggggtggcgccgggggagttaccccgccatatggtggcccaacaacgagaagagcagcgaccaagggcgatgggcacaaacaagaacaggcagtgacaatggagagcattcgtacggcacagttggagagccccgagcgccaagacaggtggacaccatcggagaaggcgacggcagggagacaacagagagaggaatagcaacacgaagcaaaaacagg

SEQ ID NO: 665389 - DNA, 971 bp, Homo sapiens
  misc_feature (172)..(173): n is a, c, g, or t
  misc_feature (180)..(180): n is a, c, g, or t
  misc_feature (182)..(182): n is a, c, g, or t
  misc_feature (185)..(185): n is a, c, g, or t
  misc_feature (231)..(231): n is a, c, g, or t
  misc_feature (233)..(233): n is a, c, g, or t
  misc_feature (235)..(235): n is a, c, g, or t
  misc_feature (237)..(238): n is a, c, g, or t
  misc_feature (241)..(243): n is a, c, g, or t
  misc_feature (245)..(246): n is a, c, g, or t
  misc_feature (248)..(248): n is a, c, g, or t
  misc_feature (251)..(251): n is a, c, g, or t
  misc_feature (266)..(267): n is a, c, g, or t
  misc_feature (271)..(271): n is a, c, g, or t
  misc_feature (300)..(300): n is a, c, g, or t
ggagagagagagagaggtggcagccaggtcggcccgcaggccagaggctgtggctcggatcccaccgctgcggaggggtgccaccacgctgggtgtgacaacgccagctgtgtcctggggagatgctcccacggaggtggtggcctgctcggggagcctgaaggcctccccnnaccagcnangangggtctggctcccaaggcgggcttcctcccgaggcccagtggggcngncncnnccnnngnncncanccatgcggaagtccnngccntggagcagaggagcagccgcggcctcggnccctccgcatgctgtgaacccggcgcgggtcaggggcttgctgctgtccttcgaggggagtgaggagcccatgacccatgcatgcctgggcttgaccactcgtgtcacccagtggtccactgtcccagccgtgaaggccctgggcacagcaaaggtagaaagcagcacacctgtcattgccgtgacaacgctgtctctttgagcggtacagaaggccctggctgcaacagcaggcagcatagggcccgggaagccccttgtggctggctccccgtggcttgtaccccaatgctgggtgtgccaccctccagccccacacacggtccagctcccgcctgtaggagcggcgcagccaaggcttgtgggggcccccaaggccccctgtttggtggagggcaggggccgtggcctagttggctggtggggtcgcgggctctggggctttcggtgaagctgtctacgggctctgtgaccgggcatggatgccttgcggccttgtggccggtccagagcacgcccacgtggccgtgccaatgtcggggcgaaggcttgcggggttaccgtcatgggcacaagagggcgctccgggctgtcacagcgcgtccatgacctgtcagcagtgagcccggccgaggtgccctcgtggctcggggactagaagggggcatacg

SEQ ID NO: 665390 - DNA, 862 bp, Homo sapiens
accccctcctcccggtctcccccgctttatattcgcccccggcacgtttttgtcccccctctttctctcactcgcagacgctgggtgggaccacgacgtttttctcgacgacgtggaccaagcctcgtttactcacgagatgaggtgtgtactaattctctcgcgcacgacgggagtatgtcggtcgcgacacgctcttgaggggggccgcgcgcgcacttattgatgcgcgcgagcgcctcgtgggggtgttggagcacggacaggagcgctcggcgtcgaccccctccacacgcttgtggtgaggagcggtcttcctctatacttgggagcgccccaccgccagcgtggtgttgaggaccacgctcttctctctctcggtagaggcgctcggtcgagctctctctctttctcgcgcccactcgctcgcggcccacgcggatggcggccgcgcgcactcttatcttggcggcgcttcaatacccccgcctcttctgtgagccgcggcgctctcactcgattgaaacctctctgtgctgattttttcccgtctaacaccgttctttctccacataactggtctactctgcttatttctccacggagataccaacatcaacctgcggggagagtctggcaggaaaatatcctcctctgagataccccggccaccattaatgtcgctcaagcaccaacgaggggcaccccaccactatccgtcgcgccccaatttctgcctgtgggggaacgcaaaaaaaaaggtagcgcggaacatcccccccctcccccccccccatggggggggggaaaacacaccccccttgggggaaaccccccccaaacccccctttccccgggaata

SEQ ID NO: 665391 - DNA, 133 bp, Homo sapiens
cttaagctcatgaatacagacttagtggccttcacaaaaaaccaaaaggaccctggtgtccttgaccgcatgatgaagaaactggacacaacaagtgatggtcagctagatttctcagaatttcttaatctga

SEQ ID NO: 665392 - DNA, 317 bp, Homo sapiens
acttttatgaatttatttatagtaaagataaaagtccgaatgttttccacacatacgtggtaatttggggggcttgccactccctcactcctgggactgacacactggagcccacgctgttcaccctgcagccccatccttgcgtgaaaaaatggcgccacctggggctgtgcaacgtgtcagcctgcttattccctttttcagctcaggacagagaaacacaattcattcataagggttccattctgttttaggcagagatttataaatcagcattttttttcaaagagtacaaagttaaaccattctgcttaaaa

SEQ ID NO: 665393 - DNA, 485 bp, Homo sapiens
gtgatactggatcctcatctctcaactgtataccaaacatcaactcaagatggattaaagacttacatctaagacctgaaactgtaaaaattctagaagctcacattagacaaacccttctagacatgtggcgtaggcaaggatatcaggaccaagaacccaaaagcaaatgcaataaaaacaaagataaatagctgggacttaatcaaactgaagagcttttgtacagcacaaggatcagtcagcagagtaaacagacaacccacagagtgggagaaaatcttcacaatctatacatctggcaaaggactactatccagaatctacaatgaactcaaacaaatcagtaagaaaacaacaatcccatcaaaaagtggcctaatggacatgacaagacaattctcataagaagatatacacctggccaatgaacacatgagaaaatgctcaacatcactaaatgatcaggagaacgcgtaaaatcg

SEQ ID NO: 665394 - DNA, 894 bp, Homo sapiens
gtgttccaacccgaggtctaatacttctaaagcttcatctcctcgaggtacaaaattttccaaacgccgcccacttgtctttcaccagacaatggttagtaacaccacttgtatagggggcctatatctatcttctcttccctcccgaagaattatttcttgtgtggtatcaccacacacatcccatagatccttgtggcgcggttctaaaaaaaaatggtcgcttcctccgcctataggtgcgaattgctcccccttcctggtggcacacaattaatccactcccttctcgagcacaattttgcttgataaccggatagatttctcggcgagaatcccccccgtgcggccccaacatatgaggagaagccccccctgaataaggtccggcggcgcccacgctcaattcaaaagggggggtagggtcaacccacaaaattattaatagggcacgccccccttcggagaggggggggtacatcccaccccgccagtctggccgtcaaccaaataaaaggaccggttgcaccacccaagcgggtggggcacacacaagaagggcccgcgccgcactaaaaaccttcgctgggcgcgccccaagaaggtggttacctcccccacaaacatgtcgggcccccgctgctccccaataacctcctcggcgaggacccgtgcacctattccaaatatgagtgccccaccaacaacgtgtcttcccacggcctataacaaatccgcgagagaatgttatttctcacaaacaccactggcggggttttgagcagttctcaatgagacttgcagagaccacctatgaaacaaattcaggtagtctgttttaaagcaacccctcgattgtccccctagcccccagcccatccttttaaacactca

SEQ ID NO: 665395 - DNA, 312 bp, Homo sapiens
  misc_feature (1)..(2): n is a, c, g, or t
  misc_feature (14)..(14): n is a, c, g, or t
  misc_feature (38)..(38): n is a, c, g, or t
  misc_feature (43)..(43): n is a, c, g, or t
  misc_feature (53)..(53): n is a, c, g, or t
  misc_feature (180)..(180): n is a, c, g, or t
  misc_feature (300)..(300): n is a, c, g, or t
nnctgtaatcccanccacctgagaggctgaggcagaanaatantggaatccangagatggatgttgcagtgagctgagattgcccactacctccaacctgggtgacaaagcaagattctgtgtcaaaacaaaacaaaacaaaacaaaaaaggagggactcagagagccagggaccagggnaaggacatgaagcagcgttcggaggacagagagagagaagaatggggaggggaaaggagcggcacatggggttgagcagaggaagaaaatcagaaaagatggcttagaagaagtcagcantctgcgaagtct

SEQ ID NO: 665396 - DNA, 722 bp, Homo sapiens
cactgaggctcacgccagtattcccagcactttgataggctaaagcggtcatcttacctgagagcaggagtgctagaacggcctggccagcatggtgaaacctcagactgtaccaacaatactgaaattaagtgcacatgctggcaagagactggcataccagcttgttgacagactgacgcagtagaatcatttgaaccagacaggtgacggttgcagtgagtcatgatcgagcttcagcactcctgtctgcgtgacagatccagactccatctgacataggatgacttcaatgttacagagtcgagcgagtacaagctataagtctaaggctcatgcgcatcgagcgccgatggcataacagaagctccagacataggagactttcgacagatagcagacttatctacagtcatctatcagtagctcagttatatgcaagtgctaggcatcatgcagacttgaccaccaaagatatgtctgctgaaggctacaataacctgtaatcgtcacgatgaacacagtgacgtcagggctacacgtgcgatatgtaggacatgcatttggacttgcactatgaaacagacctctaaatactactgcattacttgctaacttaaccttgccaggtacctgagtctagcccagatgttttaacatgctaacaagactaaccaccttggattccatcaggctcatttgcccagtggccctcccgggac

SEQ ID NO: 665397 - DNA, 523 bp, Homo sapiens
  misc_feature (86)..(86): n is a, c, g, or t
  misc_feature (100)..(100): n is a, c, g, or t
  misc_feature (513)..(513): n is a, c, g, or t
ctcaggaagaccccatctctacaaaaaacaaaaacaaacaaacaaacaaacaaaaaattagctgggcgtggtggcgcatgcctgtngtcccaggtactcnggaggctgaggtaggagaatcacctgagcctgggcaatagaacaagactctgtctccctaaaacaagtttccttaaaagctattatttgccagaattctgtccttctttcccttttcacttcatatgctttccctgcactatcttatttatgcccatagctgcttctaccaccctcacactggtgacccacctcaccactattttttcttgcatggaaattgaaagtatataattgcatacttttattgggggtacaaactgatattaagatttctgaatataatgttaattaaattgaactggttaaaatttttgtggtgagaacatttggaatttattctcagcaatgttgaaatgtgtaatactctattaactgtattcaccatgctgtgcaatagaactaaaaaaaagnccataaaaaa

SEQ ID NO: 665398 - DNA, 101 bp, Homo sapiens
  misc_feature (16)..(16): n is a, c, g, or t
  misc_feature (51)..(51): n is a, c, g, or t
  misc_feature (96)..(96): n is a, c, g, or t
ctggcatgaaatagantgcagttcctccatcgcactgggtaaggcctccantatttgacagcacacagaaaggttttcatcatcaagagagttctnctggt

SEQ ID NO: 665399 - DNA, 202 bp, Homo sapiens
cttgacgcgtcgggatgatcacagtcttcaggggtgatcccggctgtctgtcttggtgctctcgagcttccggaccatctacatgccctcagattcgagcgggccattggactcactgttgtaaccagctcctagcaagactgagcaatccgcacaaatgtgggtttttttttttttttttttttttttttttttttctttt

SEQ ID NO: 665400 - DNA, 165 bp, Homo sapiens
tttttccccaaattttgggggggggggggttttttttccccccccccccccgggggttttttttttggggggaaaggggggtgtccccctttttcccaaatttttttgcccgccggggggggggggggttggttttaagtcaaaaaacccttttcccttgtttta

SEQ ID NO: 665401 - DNA, 773 bp, Homo sapiens
ttcaaggtcgtttgtttgtccaaatttgtgggcaaaactgctaacgctggggcaccacacctgtaggggcaacggctatgagtagagtggagtttggagccaggaagcttcgggccctgtcaagacccagaaggttttggaatggaattcatagggagctgtgaggacttggcacccacgcagggtagtccacgagttgctgccattcagcgccaggtaagccagtccccgtggttttaaggtactcacgcgcgatggcgttggtacagcggtcagtgcatatgagcatttgtcaaaccatagggcgcccgccggtagtgaatcctgtcgggcatcgccaaacaccgcagcagtcgatgcgttcccaagtaatgaaacgcccaagcttggtcttctcaaagttgatgatgtccccgtgaaggaagatcttttcagccagagtatgacccagagaggagcgagacactcccgagggacacacgacgtccccattcgtcagagcgatctggctcgcaggcaccagatcctaggaaggtctgttcctgtcctcccctgtgcagggtatcactctagggtgaccctggaattccgaattcctggttctcccttgtaaaatagtgttgtcgtgtctcttttttttaaaaaaaaaaaaggccgggcactgtggctcacgcctgtaatcccagcactttgcgatacccaggcgggtggataacctgaggtagggagttcgagaccagcctgacccacatggagaaaccccatctctacta

SEQ ID NO: 665402 - DNA, 153 bp, Homo sapiens
tcgacctgctgactgagtaggattacatgtgcttaccaccacgcctgactgcttcacgaatgtgtgcacatgctttgttatgcgcgctagagagacagaacgcacgtgagatgtggtttccctcttgttgcccagacaggagggcactgacgt

SEQ ID NO: 665403 - DNA, 401 bp, Homo sapiens
atatacatacacatgaggacttactacatgcgtggaactatgtcaaacatattacatatctcttttagtcttcacagaagactttacgaggacgttattaatatcatccctacttaacgggtaagaaaactgaggcacagaaaggtcaagtaacttgcccaaggttattcagtcactgagtggtcccatcctagctgctgaggtttgattctggctctgccccgataatttgtgccaccagttcatactgtacagttgacttgtgagtgtttgcaaaattcatctttcaaatcagaataaaatagaactgtcataaagaacaaataagctagtgcatgggaagcactagaaattctccaagtcataagaaacacccgacaaattgtcagcagcagggtacc

SEQ ID NO: 665404 - DNA, 959 bp, Homo sapiens
cctctagcggtgactcggcatgaggctggctgcggctgcttcgcggagccgccttggccggcccggtgcccggggctgcgcgcctgcggcttcagccgccagcttcagctcgtgactcgggctccagcccggcgtccgagctgcggcgtatccgggccaggtggacttctacgcgcagcattctcgccgtccccgatctccatgaagcagttcctggacttcggatcagtgaactgcttgtgaacaagacctcatttatgtatctgcggcaagagttgcctgtcagactggcaaatatcatgacagaactaagtctccttccagataatcttctcaggacaccatccgttccaattggtacaaagctggtctatccagagtcttcaggagcttcttgattctacggaccaaaagtgctgaggctgctacacgctactctatgacctttaccagatactgtgatacggatcagaaaccgacaccactgcatgtcattcccaccatggcccagggtgtgatcgactaccaggagagctcctggggtgcgatcctgtcaccagcccacaatgtcccacgtacttctcctgcgatcgattctacatgagtcgcatatcaatctacgaatgttactccatcccgacactccctccatggctcgcgtgcgcaccacagcgccccaaggaagcttccatacctccatcgcacacacccctttgtcacggcataactcccaaactgacatcgtccttgcacgctatacacccactgcctcacgcacaactgtccacccgcctctgccgggacatcgcaattcatcattacactcctcccgcaacatcgacctcgcctccagcataaagcgaacaatccccccggaacgagcccactaccacagtaggctcccgtccccgaacgcaccttcaagaaacatgcggcttcacacctctacgcaacgtcac

SEQ ID NO: 665405 - DNA, 976 bp, Homo sapiens
  misc_feature (31)..(31): n is a, c, g, or t
  misc_feature (336)..(336): n is a, c, g, or t
  misc_feature (476)..(476): n is a, c, g, or t
  misc_feature (616)..(616): n is a, c, g, or t
  misc_feature (753)..(753): n is a, c, g, or t
  misc_feature (773)..(773): n is a, c, g, or t
agcgggacgtcccgggcctcgtgccctggtncaacagtctacccgcctccttgtgaacagaagatgcgactgccagctgccgagggcgttgcggtcctgactgttgcggccgatgtccccagtgactagcgtggtgatcgctcccggagccctgtcctgattccctgatccatgccagggccagacagtcttgaaggaagcctcatcctggccttcccttactctgacgtaagtcacaggatttagaaggcagaagtcatgcgagaggagtggttgcagtgcgagtccttcctcaccttcctgtgatcctggcgtgtgccccgaactgaccgcgcnctatgctggtacaggagcaaaccgttggaagaccaagatataaagggtactgatagatctatgtgaccttacctttcatcgcccagaacactggcaacagcatgagcacagtacgtctacgggaccagacaactcgtctntgcggacgaactaacggtttggcgtcgaacgtgcgtttgacaaaacttgacctccttggatagcccatacttcttgtagcccgaaacatcacgggacacagaaacgcacgtggcgacaactctgaccacggccatcccgntatacagaccgcggcgacttggtgtgtataccgtgcttgcgccagctaactggcttcggactactacgactttctctgtcctggcaacccaacgcagatctactgagccttgggcctcgctgttgggcccgtctcgnacacggggtgggcctttgcntggcctaactcagcacttgaggcttatatgaccaccaggcgcaaaagtccacaaacttgtacacaggacatacatttccgcgcctgggcgtttacaaagggctagcgcgaccttcccagcatgccacacgacatgttgaaccgaatggcacttgaacttctggacggttctatcctaccaagacaggtgaactgacgacagac

SEQ ID NO: 665406 - DNA, 1416 bp, Homo sapiens
  misc_feature (150)..(150): n is a, c, g, or t
  misc_feature (223)..(223): n is a, c, g, or t
  misc_feature (259)..(259): n is a, c, g, or t
  misc_feature (670)..(670): n is a, c, g, or t
  misc_feature (1061)..(1061): n is a, c, g, or t
ggcgcggaccgagagataccagccgtgtccctcgcggaatcatgacgtgacgcacgcggtcatgccatcggtggctgcgacacaggctacgatagaagcctctcgtcggtcgagtgcatcttgggcagctgactgtcgatatccaccatntcgtagcttgattgcgtcgtatccttggcacggtcacctgctagttagtcaaaaacttggtgtcgtcatcatntgatatgccatctcactctatatgcgtaccatggtngtccacgggaatacgtgctcagctccacggtggcaagaagcgtaaagactccttggtcgctccggtatctagcgaagttgaaggaacccatcctgtgatatgcagcatccgcgacgccaatttgtagttgcgtgagatccctttggatggggccccgacctaagttccacggggaccctaagagtttaaccgacacttgcacctaggaaacttatccgaaattcgcatcaattacgcggtcgcgattacaatcatggagcgaagatagccgactacactttggttccctggggctgtttcctcctatagtgatccatttgatagggacatgtgccgctcacttactggctccgagaaagtcctttcccgtaataccaccatgggggcaaaacagtgtgcgcgttagacagncgccaaagcgtttgggcctaccccgcaagagacatcggtgagtgggggtttggtaaacaattacggtaagccaaccattggcttatttggcagagatgtactttcccttagttggggcccattcatagaccatggttaggagctcctagggcacattacatttaaaaacttttagcgaaaacccaattattttatgcacccatgttacccaagacgcccaaatataccctattaaacacgcacaggaggaaagcgacttaactttccaaccacagggaagcccaagctcctaatcatttgagaacgacacctgttgctcgtggcggagcaagccgttgtcggggacagcacaaagaggcggttgtccatatgttcgagcaaagagtggaancgcccgattccaattcctgtgggggatagggaggatcaccagacgcagatggttaaggaaccaccgttccaatcccccaaaggccaatcttcctcgtcttggaaccttcccccattaggaggagtttaagaaagcgattccacctctacctaattagggggggagggcgtttcttactccacccgcgcggaataggctgcccaagagttccccgaaccgcaaaccgataatattgaggaccctaatgtacgcgcgcgtacaagtgttccacacagaatgttacgcctattagccggcctttccagacaagtttggtacaacgccccaacagagtgtctgacggcacgcacgacat

SEQ ID NO: 665407 - DNA, 190 bp, Homo sapiens
tactgtggtgtaccgtgaccataaggacactaatcccattcataagggctccactttcatgatctcatcatttttaattatccatatctcaaagagctcacctcctaatactctcacttgggacataggattttaaaatagaaattttgggggatacaaacactcattccataattgtatttttctgtgt

SEQ ID NO: 665408 - DNA, 420 bp, Homo sapiens
  misc_feature (11)..(11): n is a, c, g, or t
  misc_feature (64)..(64): n is a, c, g, or t
  misc_feature (165)..(165): n is a, c, g, or t
  misc_feature (169)..(169): n is a, c, g, or t
  misc_feature (171)..(171): n is a, c, g, or t
  misc_feature (173)..(174): n is a, c, g, or t
  misc_feature (204)..(204): n is a, c, g, or t
  misc_feature (222)..(222): n is a, c, g, or t
  misc_feature (274)..(274): n is a, c, g, or t
  misc_feature (364)..(364): n is a, c, g, or t
cctggcgaaanccccatctctactaaaaatacaaaatcccaggcgtggtggcaaaaacctgtantcccagctactcaggaggttgaggtaggagaattgcttgaacctgggaggtggaggttgcagtgagccaagattgcgccattgcactccaacctgggcaanacangncnntccgtctcaaggaaaaaataaaaataaaanaagggacgggcccgtganatccccacccttggaggctgtcttcttcagctctgccctgccctagctccanaccctctcccaggacccatcacgcctgtgcagtggcccccacagaaagactgagctcaaaggtgggaccacgtctgctaacttggagccnccatgccaaagcacagtgcctgcatgtatttatccaataaatgtgaaattctgtcc

SEQ ID NO: 665409 - DNA, 626 bp, Homo sapiens
  misc_feature (135)..(135): n is a, c, g, or t
  misc_feature (304)..(304): n is a, c, g, or t
  misc_feature (318)..(318): n is a, c, g, or t
caaagacaaatttttccaaacctggccactcttgtcggcattgaagatcctgcagtgagcaaaagtctctgcctccacagaatttactatctagtgggaggtagcaattgaacaaggaaccaagcagaagggatnctgcaaagtgataagggctgcaaagagaaagtggagggtgttagtgagtgtaaggcaagggcagggtaggagggtctcactgagaaggcaacctttgatctctccctcagggcatgcttgctcacactgagaatttgatcagagacataaaggagctgaaggagcaccnccatggatctgagnggaagagagttccaggcagagagaacagcaagctcagagaccctgaaacaaggctgctccttgagggctccagaaacagccagactggtgtgaatggagtggggtaagcgcagaagggtgaggtcacacggtggggaaaagagatgtgatcataagggcctttgcggtgtgtgtgagctttagcccgagtgagaggggaatcctctgatggatttgagcagagatctgacaagagctgactcacttttaaaaaggatcactctggtggtagcactaccagtgctggatataaaaagacccgaagccac

SEQ ID NO: 665410 - DNA, 101 bp, Homo sapiens
  misc_feature (15)..(15): n is a, c, g, or t
ctctagacatcgtantgaatggctaatgctgtaatcccagcttttgggaggtgaaaccctgtctctgctaaaaaataaaaaaaattagctggacatggtgg

SEQ ID NO: 665411 - DNA, 141 bp, Homo sapiens
ctggcctgcttgtgcaaggcaagtgcggcggcgcttcaagatgcgctgcctgaccacgcctagtgctgctgcgggccctggcccatggctgcatcgtgcaggaacctcctggtggccggagcctccacagcgagtgcagtg

SEQ ID NO: 665412 - DNA, 1187 bp, Homo sapiens
tttggggcatatgaaaatttattactacagggttttcaccattaatatttatgactctgggctcttctcctttcttggcctttggtattaggggccaaaagaagaaacattgggctacttggacaacctttaaagcgggacctccaggaattatcaccaacagcatgaccttggcagaccaaattccgagcaaccagaaacttcatcatttctcctcaataagagttcaagccaacccggtcagtggggttacaaggggcgtggtgatttccttgggccatctctgggatcgagggtggacccttacacactttccataagtgggcagaaatgtgggcgtggtgtggggcttacaactcctatatttttctccgagcagcgatccctttgtggctgtaagaagagcaccctccaagagaggggtgggcccttataggggcgtggtgccccaaagtgagcttttctataatagcgggttatactcagtgccaacttttcggggctcctcggtcgggggaacatagcgggagcctttcctatagccagtttaccgaaagttcccaggaaaaattggcccattccgggtgggggccacaaaacaacgtgtgattaaccattaacaacaaaccacttaaggggagcgaaccgtgatctcctataatacataggatatccgtataaatcaatttttattgggccaaaaattaaacctacctggggaactcccgtgtgcttccacccccattttaacacccaaaagacaacgacaatttaattcttataaaaatctaaggacctgggggctatccccctcttaattagagggcggggggcgcagggggacttaatagagcagttaaacggtcctaaaagaattttaaacaagttgcgccctatagcccacattcttttttacacacgcagagggcaacaccacataaaccccccttaaattcccccaataacacggggtaattattccgaaaaaccatctagggctttcaacattttaaacccaaatataggccctgggggcgaaagcgcataaaacggcgaaacaattactgccgggggcgcgctcataaatcaatgggccctattgttggtaggagggcacccctttagaatatatttatcacaacttaaaatatgcccccgatcaaataatatatatccagcacagtaca

SEQ ID NO: 665413 - DNA, 991 bp, Homo sapiens
gatggcacatgcagcgcaagtagcgtctacaagacgctacgttcacccatatccatatcaagagcttatcacgcttatcatggatcacgccctcataatcgattttcctatatctgcattcctagctcctgtgatgccctgtatatcgctaatcgactcacatacaagaacgtaagctcaagactgaacaatctcaggactgctcagagaaatggaaaacgtcagaactatcctgcccgacatcatgctaggtcctcatcgccctcccatccctacgcatactttacataacagacgaggtcaacgatccctcccttaccatcaaatcaattggccaccaatggtactgaacctacgagtacaccgactacggcggactaatcttcaactcctacatacttcccccattattcctagaaccaggcgagctgcgaatccttcacgtagacaatcgagtagtactcccgattgaagcccccatatcgtataataattacatcacaacgacgtctagaccctcatgagccagtccccacataaggctcaaaaacaagatgcaaattcacgtacgtctaaaacccaaaccactttcaccgactaacacgaccgaaagagtatactcacgagtcaatagctctagacatctgtggagcaaaacacagtaacatgcccaatcgtcactaaaatcagctaccactaaaacctctttcgaaactaagcacacgtctttaccctatagcacacccttttacaccctcaatcagaccacaaaaaaccgacagcgacaccaccaccacaaacacatcatggagagaccacgctaacacccaaaaacgaccatacaagaccatgatagggcacgaacgaccacaatgagaagaaatgcaacagtatctaccagctacctcacagcaaacacggccagccacagacgcgaggttcaaacacaatcaacaccgcggccacgagagtagcacacatcccgcgccag

SEQ ID NO: 665414 - DNA, 378 bp, Homo sapiens
ccttgcgcaagttactcaattttttagcttcatcctctatgcagaataagcccttccctaaactgctatatttatgattttgtgatgacccatataaacctgggattaccctggtgggttcctattttacttttatatccaccttcataatttcgggttcggggcctccctccagggtgccttgttttataatttgtcttgctccatgacgggttcttttcccttcttgtgattttaaaaaggataaactatgtgttttaattggatcaattgctttgttttttcaaaaacagaaattagactatactcctccttctttcctttttgtagggggaaatggggtcatttgaagtcccttaacattagatttgaaattta

SEQ ID NO: 665415 - DNA, 405 bp, Homo sapiens
ctgagaggtggggagctgagatttggtcaaagggcgcagggtttcagttagacaggaggagtaagtttcagagatctattccacagcatggtgactatagttaataataatgtgtatttccaaattgctggccgggcacagtgtctcatgcctatagctctttgggaggctgaggcatacgaattgcttaagcctagaagttagaaactaggctgggcaaaatggcaaaaccctgtctctaccaataaatacaaaaattagccaggcatggcagcgcatacctgtagtcccagctactcgggaggctaaggtgggagaatggtttgaacctgggaggcagaggttgcagtaagccaagatcacatccctgcactccagcctgggtgatagatccagaccctgtca

SEQ ID NO: 665416 - DNA, 865 bp, Homo sapiens
  misc_feature (296)..(296): n is a, c, g, or t
  misc_feature (615)..(615): n is a, c, g, or t
gccctggtgtgatcccgtcctgcgcgttgtctctggagtagcgtctttaatctccgtccgccttctctcctacctaagtgtgtgccgccacccgatgaagatcgatggacatggacatgagccccctgaggcccccagaactatcttttcggttggtgaactaaaggccgacaaagattatcacttagggtggatcactgatgaaaatgagcaccagttatcttaaagaacggtcagttaaggggctgtgccacatggatgagttgcacctttgtttgacagcagaggcaatgaantacgaaggcagtccaattaaagtaccactggcaacctttgaaaacttgtctgtacagccaacgtttccctcttgggggctttgtgaaataacacccacccagtgtctaaagggtcgacagtgtggttcaggggccagtgcattatttagtggacagcaccttagtaagcttgtggaggaaagatgcagaggtcagaaagactggacaggagcgaggaggattgttgaaactctaaagtatattctggaaaggcggtctgccccttgaggttggttagcaagggttcccaccaggaaaaacacgtgacgactttgctggntgatgaagattgattcgcccgattgtatgattgaacagagggatgctgatgcccgaatgctgactgaatgcactgcattcgatgaatgacgcgaagtttgaagaaaaaacggggcagcgtgaagaaatctaattacgagaatatccgaggcaaaaattgccaaagtcaaatccggatgggaacgaccaaacctctatacaccccagttcaaaggagagaatcttctaaaaaggggaaaatcctaaaacca

SEQ ID NO: 665417 - DNA, 141 bp, Homo sapiens
ccccgccgctgtcttatttattttgactgaaagtgagagggaactttgtggcctttttcctttgtctgtaggccgccttaagctatctaaatttggaacatctaagcagctgaagggaaccagggggtttcgcaaaatcac

SEQ ID NO: 665418 - DNA, 695 bp, Homo sapiens
gggcatattatgcttggggcactgcgtgagagccatttattgattaacgagggggacctaaagcacgagcagtattgtcaagagagcggcatcatatgaccgaatataaagcacccatttacacgatgtgtaaaagtgcttaaacaactggatcagggtgcgcatgttgagaggagaaagttaccggacagtacgtacgctcttatcccctgcacaatatataatgaggcaccactaagggagagcgggcatattcttaaataacacaggttattcctggaagatggaataaacagggataattccttctcacggagattctggtatttttcacaacactgctctggcttgtgttataaaaaagcactcgctattttttacaaagagttctttgcagcgagagtgggcgcttaacttttcaaattaaaaaggacatggatgtgcacaatggttttgacacttgttttaacggttccctaaggcgggtttaggtaggcacgcaataagccggtttgtgctctgtggaaaccccgaaggtgccttaagcctcccttaaaacaagcaattgctttctaaaaaacttccacaataaaaaaatggctgggatataggagacaacctccccctatgggggaacttaggccccggcgccccatggggaaacaacccactaatttccctgggcccggttttgg

SEQ ID NO: 665419 - DNA, 95 bp, Homo sapiens
  misc_feature (75)..(75): n is a, c, g, or t
gccggacagcgaggccaagatttcaactgcgggacggtcaggggagacctccaaaaacagggaaggacagccagnatgacactgaagcatgctac

SEQ ID NO: 665420 - DNA, 203 bp, Homo sapiens
ccggggtttttttttttggggcccaaaaaaaaaagggggggggattacctttttcacccccaatgggggggcgcccggatgggggttggggggggtcccctggtttccccccttgttgggggggtagtgggggggaaaaagttttttgtgtttttttttcccccccgccttttttttttggctcttttttttaaaaaaattta

SEQ ID NO: 665421 - DNA, 469 bp, Homo sapiens
ggtgttagttccttgagggcagggccatgtctttttctttcctatctcccattagctgggcccttttcacacagtggaagctaggaaacatttattgaatgaatgaatgaatgaatcagtgacccagcttccaagaaacatcctctgattgggaagataggaagataaaccaataattagagtgcatggctcacgcctgtaatcccaatactttgggaggctgaggcaggggaccattggggccgggagtttgaggccagcctgggcaacacagcaagaccccatctctacaaaaaataaaaaaaaattaactggacatagtggtacacccaggtactcgggaagctgaggtgggaggatcacttgagcccgggaggttgaggctgcagggatacatgatcacaccactgcactccagcctaggcaacagagtgagatcttgtcttagaaacaaacaaacaacgattaa

SEQ ID NO: 665422 - DNA, 1099 bp, Homo sapiens
  misc_feature (559)..(559): n is a, c, g, or t
  misc_feature (808)..(808): n is a, c, g, or t
  misc_feature (1094)..(1094): n is a, c, g, or t
  misc_feature (1096)..(1096): n is a, c, g, or t
  misc_feature (1099)..(1099): n is a, c, g, or t
tttgtttttttttttaaggtgaaaaagccagcggacttaatggctcggggggcagggggctcaggagctctggggggggcgggtccgcttcctcttcaccatctcacagggcttcgtggcgtgcgcaggatgtggcgctgtggcccgtggggatgtggctgccatgtgcgcaggctcgggggggtacgtgggtcctgggggactcagtgtgtctgatgctgctgagcggtggggcgagcattctggtgggatgggtgggtccgcacatagagagggggcaggcttccgcgggccggagatctccggtataaggaccaccaggacaccttggccgtcaggtggccggctccaggcccaaagtctgggggggaatcagtccggttgtagcgggaaggaatggcggggccttcaagttattggggctcagggctggaaggtctgggtaattcctctggatcagggaaactgtggacgcagttccggaggaccatccatggcaagatgcgcagacagggggggggtcccttcgcaggggggaccggaccttcagggcctcggntccagggccagggggccctccaggaagttctcggggggggaaacctgggaagatgaacgggcggaagcagagtctgggggagctcatcggactctgaacgcggccaaggtgccgggcgaaccgaggggggttggggtccccctaatggccaatcgagatcgcccgggaaaactaaatcccaaatttgtgggtggattgcccaaactggtcacacgggagcagagcgggggtcacccgggggggagacancactggggtgagcacacactcgcggggcccgctgggtgggcctggggcaccacaagaaagagcgctctggagaacacacacagcctgtggggaaaagagggccacacttggggaagagacgacagacacccggtgtggaaagaacaagaacaggcgctaaaggagactgcaacaagagccaacaaggagggaacgttaacacgcagagagagaaaaaaacaagaaaaagacgactagatacaaaatgagcgtcgcgcccgcgccgctctccgcgagtgagaggggnanacn

SEQ ID NO: 665423 - DNA, 189 bp, Homo sapiens
ttgggggtttgacccttttttttttaatctacttttggtaaaaagcctttaataaaaaaaaaaaaaaaaaaagagaggtgtgaggggcaaaaagcaaacctatttcccctgcctcatagggttttgggaagtcatcccccccagtttgttggttttgtttcccactgttaataaagcatttaaacagta

SEQ ID NO: 665424 - DNA, 164 bp, Homo sapiens
cacgaggtgtcacgcacgtgcgtggcctggctttgcgagttgctggattaccaaatgactctgaagggaaactacatgtcttactcaaatatttcttctttcctctggcaattattaattgaaatgagtatttttcggggccagaagagtgtaatggcgttgag

SEQ ID NO: 665425 - DNA, 1019 bp, Homo sapiens
  misc_feature (633)..(633): n is a, c, g, or t
  misc_feature (761)..(761): n is a, c, g, or t
ttttgttaaccaacaactatttacttaatgtgttagtttgtttattttcttatattttcttgtctcccgacgcccccatcgtaaatctggtggttgccttttgtagtctatggtccacacatgctcttgtttttctctccccacggttcgttatcggaactccgagtggtcgttacaaaattctttatgtccggtgcccacaggtggcccttatagagcgtaatttaaagaagatccgagtactttcacacctacacaaatggggtgcccacactcctgtgtcaatccccatgaaatgttccttggggttaatacgcctctttatatgtctttttgcgggcacccccttctctatgtgtgtattaatacttttgtatggagtatctgttctccctctctctctttgttatgtttttttttttgtttaagggcgtgctgctacgctttctatagtatcaatcctggatcttcaaggctcaggtgatacagggctaacgacccccctgggcttggccccgttcgcaaagcccccctaaccctttcccccctaggggaatgacccaaaatgcctctcatgacatctgcaagttgaggggaccaaaaaaggggggaatgcggtggggcaacgaaggngcattcaattgcaattgtgcaaaccaactgaaaaaatcacacaatgcacaataaacgtattaacgcgcgacacgacttactaatacatatatgtgtgcattagcatcaagttctatccatcccgcaanagcctacactagctaatcacgcatgcccctcgtgtggagcttgtggagaggactgaggccattctccttagagagaattggggtggctattaggatggacaagggacttcctgtaacaacgcatctcatagtcttggaatgactacttaaaaagaccacaatgtgcaatcgaagtcctcggccacatctgtcaactttgggggatgctcgctccaaccgacatgctgtaaacttgcaccgttcccgttttaatcgtcc

SEQ ID NO: 665426 - DNA, 154 bp, Homo sapiens
agtcagggcgagctgaaaaaatgacccagcaaaggccagactgacagatcccattcccaccacagagacttcaattgcacccacacccccaggtaagcatctacagcctggaacagcaccctgcacccccaggtgtgcacgtgacagcctggaa

SEQ ID NO: 665427 - DNA, 485 bp, Homo sapiens
agcgacgcagttgataatgagccgatgaagaattcagtgaagcgtgcatgataggaagtgagaagcagccctagaactgctgctttacctgaaaaagaccagtattgcttatccagctatacgatatcttctgtatggcgcgaagggacacaggacccgaccctaagtctttgccatgtcattcatttctgtgcaaaaccaggactggctgatagtacatattccagatgctcatctatgggtgaaaccattgtcgggatctatctgcagtccagctacaacaaacagcgcttggatcaacctttagaggcttcaacctggctgaagaatttcaaaactaccaatgagcgcttcctgaaccagataaaagttcaagagcagtatgtctggaatacgagagacagcacttgagaaagggagtcctctgggagaaagtggttgaaccgggctaacacgggtgagggaacgcccacaatgcagtgtga

SEQ ID NO: 665428 - DNA, 498 bp, Homo sapiens
atgtgtcaccaggaaggggactactgtcaaaaatatgcatgtctctgtagtaaaaacctcattcccacaaaaagggctgccatctggtgctcgcggtcaagtgcgacctctgggtcccttttatgcccactttgggattattggaaaattaaaagctatctatggtttcaaatgtatatcttggagtagactttttatggatagctctaaagattacaacattaatgcctaatttttcatggtctacttagagtagatatataacctctttaagtggaacatataaatcttaaactatgtaggtccttggcacgaccctttggtcctgtaactgtaattatgtataacacataccttcactgaaaaccccatcaaagtgtaattctttttggctttcaacagtcaagcatattttcaagaacttaacagaataaaaataatacatttatctcgattttacctcgtcatttgctcttccctcatttctgaagttccaca

SEQ ID NO: 665429 - DNA, 260 bp, Homo sapiens
tcatctgctactggcatctcgtggactggaggcagcccttctgtaccagaacatgtcaaaagcttttactgtaaagctagagaacaaactagtatgctggatatgggcatgtagctaacaggttagaggcatgggattatcctgtggactttttttttttatatgggtttgggggtccgaaatgtttaagggtggccctcctaagccggtggaaagtgtctcggccacaacattgggtgatgtggggcctcaaagaatgt

SEQ ID NO: 665430 - DNA, 428 bp, Homo sapiens
accatgtactggagttttgcagaggccatgtgtgatgtataatagcacaacagattgagtgcggaagcagataggagaattcagctaccttatattaagtcagccattaaataggtttgcaaaaatgggtcaggcgcagtcgttacgcctgtaatcctaacactttgggatgccgaggtgggcagatcactttgaggtcaggcgttcgagaacagcctggccagcatggcaaagacctgtctctactaaaaatacaaaaattagccggacatggtggcatgcccctgttatcccagctacttgggaggctgaggcaggagaattgcttgaacccaggaggcaaaggttgcattgagctgagtgagccaagattgcctcactgtactccagcctgggcaacagagtgagactccatctccaaaaaaaaa

SEQ ID NO: 665431 - DNA, 267 bp, Homo sapiens
ttcttttatttatttaacatttattactttactatcatgtactctaatatggcaacaagattgaatctatcacttggttgtaagggaggagaccacccctcatattgtcttatgcccaatttctgcttccaaagaaagaagaagttaaaactaaaggcagatatggaatccacaggcagatagcccagcactgtgccctgtgcctggtggttaaaaatcaacccctgacctaactgcttgtgtttatctatagattgcacacattgt

SEQ ID NO: 665432 - DNA, 424 bp, Homo sapiens
ctccttttcacatcatatatctctgccagaatgatatcattaccctcagagtcagaagactagaaaataaatctcttagtagataacttcggttccttattctggatggtttaattggattaattctaattaattaaaccttttacggtcaattataccattaattaagaattcaccaatcggctctggtatttaaatgtgacaaacatcctaatttactaacttatgcaaatttggtgctatagtttttatcttttttaaagtttccaacttgctatcaaaatcatagttttccttattttttgaccaaaccaccatccagaaatttcaaacaggttctacttttttccattcaacttaagctaccatacttttttcttctgctattagtgttctgttaagttatgctcttgtaataaaatca

SEQ ID NO: 665433 - DNA, 84 bp, Homo sapiens
acctctctgtacttctgtgccagcagtttagggcagttagccggttggatgtacttcggcgccgggacccggctctcagtgctg

SEQ ID NO: 665434 - DNA, 167 bp, Homo sapiens
acatggaaatacacataagatgtaagattagtataataaagagtcaattaagggccattatggatgggtgcttaaagcatcaagtgaagggctctagaaggttgcttagaaagtagcaggttccacagaggaagaagagccagatgttaagtccccagagcagaaaa

SEQ ID NO: 665435 - DNA, 117 bp, Homo sapiens
aaatcccccatttcatccccaagcaacaagtgatgaacacacacacacacacacacacacacacacacacacatagtcccgtagtgactaacaggatctcccgtccagggagatgtg

SEQ ID NO: 665436 - DNA, 137 bp, Homo sapiens
agactggcatcagtcatcagatgtgttagaacatagaatagctatgatggactgatgcggatgtgtgagaaaaagaggactccagttgtgattgatattaggagacagatgctgtgatcgagatgtgggaagaatgt

SEQ ID NO: 665437 - DNA, 614 bp, Homo sapiens
ggtcaccacagtagtgtccctctggctcagtcggcccaggccctctcagtcctccccaagccccacaattcgtgccgcggtctgagacgcggccccggacggcggcggtagcagctgctgcatcgatctccaccgctccagccgatggaagacctggaccagtctcctctgggtctctgtcctcggacgagcccatcccggcgcgctaggccgtcgttcaagtaccactttcgtgaggcgagcccgaggacgagggatggaagaccgatggatggaagggaagaggatgatgagggatgaagacaatcgtaggatctggagctggtgcgatgagttcccggattgcccgtgtgggtgatcccggtaggcccccatgatgtcgtactgaggcgatttgctggggggcccgttgccgctcggggcccagagggctgtcgcagttcgccgtgtacaagtgcctctttctggtgcagggtcttgggtgatcgcgcgggaggataattcgtcactgatccggcacgtgtttccgccggtcgggatcgcccaagtggctccgggggcaggctcttccttagggagtgctccgcgatcccgcgcgtaggtgggtgggaccg

SEQ ID NO: 665438 - DNA, 1323 bp, Homo sapiens
gccaccactacccggctaattttttttatttttaatagagatgaggtttcaccagtgatggccaggtctgatctcgagctcctaacctcaagtgatcctcccacctcagtcctcccaaaggtgttggaataataggcatgagccactgcatcccaggactttaagttctttgtaaagttgcatgcattattatttttaagagacaggaatctggactacgattgcccaggcgtggtcttgtgaactccgtgggcctagaggtgatccgtccgtggccttatcctccatagaatagcgtgggactacagcacctagtttggagatttccgtggtcgtgtattccccaagtgggggacatctcattgttggcctttctggtttgtttcttttttttgtggggagcgaggggagcttcgcgcgccttggtgctgcccgcgggtgtgtggagtcccggggtgccagacaaacctatagaggggccaccacgctgggaatacgctccgcggcactcgcgcgtggattaatcaaccggctaactaattctctctagcgcgctctcagagaccctctcacacgaaagtaagcgtgtgggaaaaacaagagagggggcgccgcaggcgccaagaccacgcggggggggataaatcttcggggggcgaagtagtggagagcgaagagaagacagcggggggaatatacccacctgttggtgtaccggcgcggggacgggggggttcaccacactccgcgcgggaaccggcggggaaaagtgagccgcggattggggggggcccccacaaaaagggtgggggggggggagcaaacacgcgcgggacctatggcgccccagcttggcgccccgcggggaaccctaggatgtcgaagcgtcatgaaaagggcggatggaaccgcgagaaacattcggggggagatccccacggaaaaccctatgggggcaccccctcggggggaggaaacacggcgcaggaggcacccacgacagacgcaaagaagggctactagtgagcggcgagggcgacaagcttcggcggccatttaacacggggggagagcaagccacacgggggtgatatacacactaaggaggaggaaccttcgtgaaaaacgaggggcgggcgccagaaaaaaaagggggtggtggcgggtcccacccaaaggccacagcaccaaagagggtgatactacgagaagacggctaccccaaagagggggcaccagtagtattccgcaccactggtgacaccaaggggagacacacctttagtgtggaccacacccacgaaaagaggggcggccgccaac

SEQ ID NO: 665439 - DNA, 622 bp, Homo sapiens
gctcttgaccaggcattacggttatgaacatgaaactggctgcctacgctccccgcatgaaggagataaaagtaagaggagggaatgagatctgagaaagtcatgatcatgactgtgccactgtgtcgcatcatagagatctcagacattggacctcttctaaaggatggtataaaatgactctcaaccactttggaaatacatatgtgtatataagaggttattgatcaacttctgaggcagacattagtctcgctttttttcatttttgttgtgtcttataaactgactgtatatctttgcttggatactgtgattccaaaataaatctcatccaagcaagttagagtccagcctaatcaaatgtcataattgttgtacctatagcaagttctaaataatagatttattatgtacattatagtatatgtaagtagctactgaagtaaagatcatgaagaaagaacttgataggtgtacatgcgagaccatgtaaaatatgtaaattctagtaactgaaatcctttcaacagattttatatagcaactgtctctgcagtagtacactaaaactgggcacatggaaagggccaatgggagtggcccaccctgtaatctcaga

SEQ ID NO: 665440 - DNA, 968 bp, Homo sapiens
  misc_feature (49)..(49): n is a, c, g, or t
  misc_feature (58)..(58): n is a, c, g, or t
  misc_feature (62)..(62): n is a, c, g, or t
  misc_feature (68)..(68): n is a, c, g, or t
  misc_feature (81)..(81): n is a, c, g, or t
  misc_feature (94)..(94): n is a, c, g, or t
gcacgagtgggtgctgctaacgcgggccccggaacgcaccatctgttgncatcccggncggncgaggncattgcagatttnggaagatggcaangttcatgacacccgtgatccaggacaacccctcaggctggggtccctgtgcggttcccgagcagtttgcgggatatgcctcttaccagccgttcagcgaaggtagatcgctgtaggaataggttgcagcactggacgaggagccgagcatagccaagataagaggtacacaaagtaagtactcctctcagatttggtggtggaagtcgaaatatgcttatttccatgaggaggatgatagtagcttccagctggtggcagtacggggcgcacgcagaaggagggctaccaagggaatcgaatgagagtttgcccagcaggagatcatccggagagacatggatcgtcggagcatgttgcagttcaatcctgcatgaatcctgtcctacccagtgtcaagacaaggatggagagatgaagcgcattcagacgtgctagaaaccgttccagaaaccaaatttggggttaggcagaactgggatcagaactcaactgagaggcccgtggactcttcacgttgaagtccgaggggagtgggaagtgaccgaggcgtgggcctggcctcagatggttgcgctggctactgtggacctatgtcctcctcgtggcgtgtgagggcggcgggcccacgttgagtccggtgctgtgcacgggtcgatccgaggtgtggatttgccgaggaagatgtaaaggtttttcatgtgtctacacccctgggaactgtttgcgtcactggggaactcgggatgtgtgcctgatgcatctgcaggttgatgtacctcaggtccggatgggtcaggtgcccccgtgtaggagactgttgtcgcagggaacatacccaaggttttcgctctggtctgatcggggggacacgg

SEQ ID NO: 665441 - DNA, 102 bp, Homo sapiens
gcggccgcctactactactattgctcgaattcaagcttctaacgatgtacggggacatgaaaacagagaccaaaacacacagaaaaaaagttgtactgcacc

SEQ ID NO: 665442 - DNA, 259 bp, Homo sapiens
tggaagaatgcatgagcaatggatacaaattaccttgctcttggatttgctgagcattatccctattctgatgtcagagattatgtttattatggaatagagctttccatttgttcttactctctagggagacaatcttccataacagctttgggggggtcttctaaatctttcaaattgtgaagtcactttattcatactagatttgaataatatgatgggcaaaatatattctctcagagtcttggacactgctgat

SEQ ID NO: 665443 - DNA, 87 bp, Homo sapiens
ctccccgcctaccgttccttcctctttatctctcccacttgtcttgctcaatatgacttggtaattacaatgttgattgaagtctgg

SEQ ID NO: 665444 - DNA, 932 bp, Homo sapiens
  misc_feature (270)..(270): n is a, c, g, or t
  misc_feature (297)..(297): n is a, c, g, or t
ggctgcttgctgttgccacagtagctataaattaaccaataacgccacaccagacactataatccacacccaataatagtgtaacagtgtatagccagtcactaataaatgttatttccataagccaatgagaatttgtgacaaacctctttggatcatcccacttctggacccttttttgcctttaagaaactgcttgttgcaaagctccaaagggagttcatatccaaggatacttgggtctgtttcttccaggcagctgtcctcatntggctcaagtaaactctttgaattacntttgtgcttcagccccttccacttagattaacaacatggatttgtgtcaccatgtacggcaattaaaatgttcacacttttccccccaagggcactgatgtgttttcctgagcacttggaatagctacgtagtgtttactgtctagattatggtttctcaaccttggtgctacttacctttaggaccagaggattctttgctgtgggaggctgccctagcaatgctaggtgtttcgtttgacctctaaattacacacctccaccagtcttgacatccccacaataacactagacattgacaaatgtctcctggggaaaactctccaccagttgacagggaaagttctggaaatattggaatggtcaattgagattttatgttatccaaaacaagtatttttcttgtgttttcaaacatctacttccatctacttatctattgattttgtacttttatttgtaacttaattccatcaaggagagagagttcattttctgttatgctaaatttttgaagaatgtatggatttttttatgacatgatatatggatgatatgtagatattacatgtttgtatcatcaaatctcaggcgataataaaataaatacttataatatgatatgtcactgtata

SEQ ID NO: 665445 - DNA, 150 bp, Homo sapiens
aaactgaggggacgtccacatttgacggtgggagagaacagagtgaaactgactccacgtccacatttgattgtgggagagaacagaggaaatctgactccacgtccacatttgatggcgggagagaacatatggaatctgtctccactt

SEQ ID NO: 665446 - DNA, 497 bp, Homo sapiens
gtcattcatttgcttacatatatgagaatacgtttttagaagccaccaggacacatcttgaaaactttgctgctaaaaatttcttccatcagataccctaaatcatcattctcaagttcagattctgcagatcactaggccatgggcacaatgcagccaatttcttctctaaggcataacaaaagtaacctttgctccaattcccaataaattctcagttctatctgtgaatctcctcagcctggacttcactgtccatatcactatcagtattttggtcacaacaatttaaccagtctctaggaacttctaaacttttcctcagcttcctatcttcttctgagccttccacactcttccaacttctggcctgttaccaattccaaaactgattccatattttcaggtgtctttatagcaatgcccccactttttggtatcaattttcagtataaggctgttctcgcattgctataaagaaatacctgagaaggggt

SEQ ID NO: 665447 - DNA, 321 bp, Homo sapiens
ggctacctgctggatgccgagaactgctactgcgtgcagctgtcccagatccagtgtgctgattggcagctgtggaggagcagctggcccagcttcgctgcgagatggagcagcaagacacaggaatacaaaatcctgctggatgtgaagatgctgggtggagcagtgagattgccacctacctgcctgcctgctggagggagaggatgcccacctgactcagtacaagaaagaaccggtgcacaccctgtcaggtgcgtaccattgtggacgcgtgtccaggatggcacggtcatctcctccctgcgagcagtgtccacc

SEQ ID NO: 665448 - DNA, 651 bp, Homo sapiens
ctagctacatcaataaatctgaaagacttgggttgggggaaaaagcattgataagagaatatgtgaaatgaccgcctacatgtaaaatttaaaactacacaacatgtatgtttgtagctatatacatatgtgtagaagtataaaattgggaatgttaccaacttcaggacaatgactctttctgaggagagaaaaggaaggggtccattcagattggtccactgccgggctccataatcgccagtgtaaccttgggtaagtcacttaatctttccatgcctcggttacctcatgtattaaacaggaatgataatagtacctatttcatagagttgttgaggattaaataagagaattcatgtaaagtacctggtacatagtaagcactgaataaatgttagttatgtttttcatcattttgattttcttcctttcctcttttctctgcctgtttaaactctattctccctttaaagcttaaaggtcatctcctgtgtgaaatatcctttcatcatctagccagaggattattaccttcctctgaatttctgaaccactttgtttctggagtcaacaggcatttattaagaacctgccatagtgtcgtgtgctgtgctaagacaaaaattatacattcaaaagagcttttga

SEQ ID NO: 665449 - DNA, 108 bp, Homo sapiens
  misc_feature (68)..(68): n is a, c, g, or t
actttaatcgtgacaaacgaacctttaataggcggactgcaccatcggcgatgtcctgcatccaacantcgagagtcgtaaacccttattgttagagtattggactct

SEQ ID NO: 665450 - DNA, 159 bp, Homo sapiens
gtgaggctgggggtgtgagaggggctgggatggttggctttgtgatctggggtctgtaacacttgtggggttgggcccgcatgcccctcccaagggagagggagggtggggtccccctgtgctcatcagtgtttaatcgaggggataccgagactcgaa

SEQ ID NO: 665451 - DNA, 416 bp, Homo sapiens
tgcctgtgcccctgggcaggtcaggcgtactgagcagagggctcaaaagatgtctgggacgatataatcagtgtaggcaccatcgatgagtacaaccacattgttgtgatgcaaacccctggtgaccgtgaaccggcggttcctcaccaccatagtggcatctggctttgtggggtcggagcctgagtggatgtcagacacttcatatccgatggggtggaagtattgtgtcaacagcccgtgcgtccgggatgacatcagatgactgtccagcacatagtagcccaggaagtcctggtggaccgagctccccttcgacacttggtgcaaatcaacctcaaaggtgccaccgtcgtccacagacaccaccaggttcctcttcttctggtgccgaatcctgcagcccgggggatcca

SEQ ID NO: 665452 - DNA, 809 bp, Homo sapiens
  misc_feature (1)..(1): n is a, c, g, or t
  misc_feature (298)..(298): n is a, c, g, or t
ntgttcccccccctgttctcgggtgaaaaagaagctcgggagaagattggggcccccccctaattttctctcgaaaaagttcctctggtgggagatgcctgcgcccactcatcgtgtgcgagtagataggagtttctccctcggggcacaaagccgccactactgtgggtgtgttttggagagagagctctttttctcacagaagatcagtacccccacacctctctggtggtgtccctctttggctctgtgttcgtgggaatatatcggagagaggcacaggacgcacagtgttgcncggtgggggggggtgtctatattcacacaacgcaaccgtgggagcacacagaaaaaggcgtggctgggggagagacgtcgggcacacagggtgcaccaccacagtgcttgcccacacgagagtggcgctcacagagagaggcgctaaaaaatgaaaatattttatatccacccatagatatccctcgccacccccacactgtctttaatcacgtgggtgggagagaaacggtctcacgagaactcgtttgtgtatgccacgggtggccactcttaaagtttatgtatgtattaagagctgggtaaatgagtaaccacactgcacttcgtgaaacctcttcatcgaaaggagaaaggaggaaatgttttgtgggccaccccttgggttttttttttgcgtgtggccattttaagattatttgttttttaaaacaggacttttttagtgggaaccacttggccccaaatttgtccccaggattttggggcccccattaaaaaatttaatgaga

SEQ ID NO: 665453 - DNA, 160 bp, Homo sapiens
gagacagggactcgctcttgtcacccgctactgttatttctcccttcccaataaatatttcattttcacttaaaatatgtcagtgtacattggttccctgatctgctctcagatggccaagggcttatgtttgagtaggtcacaggttcatctttctgta

SEQ ID NO: 665454 - DNA, 1077 bp, Homo sapiens
  misc_feature (11)..(11): n is a, c, g, or t
  misc_feature (279)..(279): n is a, c, g, or t
  misc_feature (531)..(531): n is a, c, g, or t
  misc_feature (678)..(678): n is a, c, g, or t
  misc_feature (686)..(686): n is a, c, g, or t
  misc_feature (760)..(760): n is a, c, g, or t
  misc_feature (838)..(838): n is a, c, g, or t
  misc_feature (930)..(930): n is a, c, g, or t
gcgatccccgngctgcaggaattcggcacgaggagcacattacttctctgtaaaaccctcttaggggataatagaagttgaaacgagatcatggaggcaaagccctcagcgccctgcctgacaaggtgataacagtccactcgagtacacagacacagttcacagtatcagtttgatgagccagagtaacaaaatctaacctttgcttaatttacctggtacaggtgacaacgtgcccaaaaacacatcccccttgctgtggcccaatcttgtcagctntttccttcacctctctacacatcccaaatcatttgagaaatacacgagagttcctgctctcccatcttaaggagccagtcagagctccacccagaaatgagtaggagccccccactccaggggaaccaccgtgtgatggcacttgtggtacttgccctggcccaaggaatctctcccttcccacctcagcttgtcaccgtgtctgaaatgtcaccattaaacattcagtaccttgcctctggaagacattgngtgtttgccactctcctgatcgattgcagctatgcctaagaggggataacttataaaaatgtggaaaccatctgtccattaagtgtgggaaaaaaaccatataaaatctttttatttcttcatcccagattctttaaaacttgaatntcctactngtttctagataagacatgatgacatcatttcgagataagtttctaaaaagccgaatcagagctagtcttcgcangggagaggtcgccgcccgggttcgtgcacgatggcactagcaatctttcccctaactgattgatgccatgaagcctanaggcacgacggccaagaacattgtgacagtgccaaccttaaacactccactgctatatgttcaaaaggtggtactttgacaactaatctagntaacatcttgatggagtaggttgaatggaatattaaaccgaggcacctctttggccaaggacgaaaagaatctatgtgcaacgacttcatggagggttctctaccttatttaacccgccaaattcttggttctggttataaataaaa

SEQ ID NO: 665455 - DNA, 184 bp, Homo sapiens
atctaaggatcccccaagcagattaatacagactcatgctgtagctgagcaaacacgtcatgtttcaggaaggtactgaacccccaggacaggagcatactccaggaaccaggatacaggaaggttccagggacaatacatgagtacattgccatgacgaccatgttaaccatggaaggggctt

SEQ ID NO: 665456 - DNA, 309 bp, Homo sapiens
ggagaagcaaaccaaagagataacactagtaagacatgaccgtgaccaaagccagaataccaaaaattacctacatacggcaagggagaggcggacaaacattcgcaaggtagcgcgacagcactcgagagcacgtgtacatcttaccctagcggctagaggacaaaggaccaggaacctagatacaccatacattgagaaagtgaggaccgcacgtaccgaataggcactagacaggagctagaagtgaccttaaataccaaaacctaggataaattgtgcgtagaaagtactaccatgactaggtag

SEQ ID NO: 665457 - DNA, 104 bp, Homo sapiens
  misc_feature (104)..(104): n is a, c, g, or t
ggggaagcagcactggtggtgcctcagccatggcctggaccgttctcctcctcggcctcctttgtaactgctacaggcatctgttgcacctcctaatgttctgn

SEQ ID NO: 665458 - DNA, 338 bp, Homo sapiens
  misc_feature (307)..(307): n is a, c, g, or t
gtgatccacccacctcagcctcccaaaatgctgggattacaggtgcccggcaccacacctggctaattattgtatttttagtagagatgtggtttcactatgttgccctggctggtctcgaactcctgatctcaagtgatccacctgcctcggcctcccaaagtgctgagattacacgtgtgagccactgcagctgccctctagattttttttttttgttgaccattgcttatttggtttgactttcattttcttccccattgtggtagtcattttctgaatgcctgttagtttgtccatcttctcnccgctgtagtgccctagagtcagatgaactc

SEQ ID NO: 665459 - DNA, 150 bp, Homo sapiens
ctgaaccgccacctcatggttcctagtcggattcgttaaccacggagccatgacgggaactgcctaagctcttcctttcttatacacagcaagacgctcagatttcagcaatgaagataaacgcttttaacagtaattggatataagtac

SEQ ID NO: 665460 - DNA, 136 bp, Homo sapiens
ggacccatactacttgatacattatgtcaaaatttaagccatgttaaagaaacataaatacttttagataccatccatcaatacttgaaagaaataactgcttagccctagctcctgagctaggaggatttggtct

SEQ ID NO: 665461 - DNA, 394 bp, Homo sapiens
tcgaccgggagatcacctgaggccaggaggttgaggctgcagtgagtcgagatcatgtcactgcactctagcctgggcaacacagcgagaccctgtcctaaaaaaaaaatcagcatttttggtagagtcgtttggtcttgaaaataactattggccgggtgtggtggctcacgcctgtacaccttgggaggccaaggcgggcggatcacctgaggtcaggagttcaagaccagcctgacaaacatggggaaaccctgaccccgtctctactgaaaatacaaaattagccgggcgtagtggcgcatgctgtaatgccagctactccggagctgaggcaggagaatcgcttgaacctgggaggcggagcggaggttgtggtgagctgagattgcgc

SEQ ID NO: 665462 - DNA, 912 bp, Homo sapiens
  misc_feature (11)..(11): n is a, c, g, or t
  misc_feature (65)..(66): n is a, c, g, or t
  misc_feature (68)..(68): n is a, c, g, or t
  misc_feature (74)..(74): n is a, c, g, or t
  misc_feature (98)..(98): n is a, c, g, or t
  misc_feature (100)..(103): n is a, c, g, or t
  misc_feature (124)..(124): n is a, c, g, or t
  misc_feature (239)..(239): n is a, c, g, or t
  misc_feature (253)..(253): n is a, c, g, or t
  misc_feature (286)..(286): n is a, c, g, or t
  misc_feature (300)..(300): n is a, c, g, or t
  misc_feature (317)..(317): n is a, c, g, or t
  misc_feature (319)..(319): n is a, c, g, or t
  misc_feature (335)..(335): n is a, c, g, or t
  misc_feature (341)..(341): n is a, c, g, or t
  misc_feature (343)..(343): n is a, c, g, or t
  misc_feature (348)..(348): n is a, c, g, or t
  misc_feature (350)..(352): n is a, c, g, or t
  misc_feature (355)..(355): n is a, c, g, or t
  misc_feature (359)..(359): n is a, c, g, or t
  misc_feature (369)..(369): n is a, c, g, or t
  misc_feature (371)..(371): n is a, c, g, or t
  misc_feature (377)..(377): n is a, c, g, or t
  misc_feature (383)..(383): n is a, c, g, or t
  misc_feature (397)..(397): n is a, c, g, or t
  misc_feature (424)..(424): n is a, c, g, or t
  misc_feature (451)..(451): n is a, c, g, or t
  misc_feature (459)..(460): n is a, c, g, or t
  misc_feature (469)..(469): n is a, c, g, or t
  misc_feature (473)..(473): n is a, c, g, or t
  misc_feature (499)..(499): n is a, c, g, or t
  misc_feature (510)..(510): n is a, c, g, or t
ctatccccttngtctttcatgtggtccaaagcccctccaggatagcacagtgctttggctctccnncnttagtngcttagggtgtcaatctatctccngnnnntgccctggcccagtccttttnctgcccctaccccaccctattgcacatcaaatcatgtaaacatggctatggggatggcccagaacagcagtgaggcagattgatgtgtaaacagatttgggatcaggggctaganccagttacccagcnctaccccatgctgaggccacagttaagtatggnaaagcaggaggttntggtcccaaactctggntnagattatgcaatagtncagatngntctgntnnnctntgcnacccaccctntnagattncaggtnctgaggtccaagtngccttgggcttccctccaggcctaggnagcagatggcagtgttcagtttttttnttcccacnnccagctggnggtnactggtgctgggtcttcctagatgcntgggggaaacnggagatgggcagcggcagtttgttcagccccagggttcgagagaagataggtagttctgagcttaggaccaggagatagatacagttcccaattatctgcgtcatggcagtgtcgtgccatctgggccgcagtcccggaagagtggagagctatagaagcccacaactgaggacaccattaggtaaaagatgagtacaacctgaatgacggcaccaaaggagcccagcttggagaaggagacctggcctaaaggaggtaccctgcatgcctcggggcatggcagcctcatcgatgagcagctccaggatgtggatggccacaatgagcacagacaggcccgtcagcaccagcaagcacagcatagccagggggtagcccaggtttcgttgccaggctgaaag

SEQ ID NO: 665463 - DNA, 473 bp, Homo sapiens
  misc_feature (36)..(36): n is a, c, g, or t
  misc_feature (48)..(48): n is a, c, g, or t
tggaacaggggtgggggggggctcgggaagaagtgngaccggtgtctnggcggtgcgggcgtgaagataggtactggttttggattaggaattggtttctcacttaccttctttaaaagaagaatgggggcattagccttcggttctggcatgggattaggaatgggggggtccaactggcaggatgatttccaggcgtccatatcttctacacggaaaatatggcaaaggggaggagcaggggcttcacctgggaacatcccagggggagggcaagggaaatcatggttattcctcaggaatactggaggggcctggaggaaggtggcattcttctggaacaagggtatcaggaagggtttaaactccaggacctgggtatgcatttgaaaccaaggctggttcttggtttggattttctctctggaaggtggaaggggcgggggcttaaataaattaaacaaaaatggggg

SEQ ID NO: 665464 - DNA, 105 bp, Homo sapiens
ttgaggattcctcgtaacgagcgcctaacagccattcgtaacaccctcctaacagcgcctccgtaacacctgccccagtctccagcagcggcgtctggttacgga

SEQ ID NO: 665465 - DNA, 516 bp, Homo sapiens
ctcgcgaacgtgttatcccttgctgatcctagtcgctgctgcctaggttccatttcctttcctcctcagctcaagttacaggccgcatattttgtcagttaatgccagtacaatctgtgttagtcctaaggactttagggattgtgatgagacctgcgatggagaagacactgagaagtcagtgatctgcaatcatttgctcttgtttccacatcacctctgggatattacagctgtttgtttccaaatggctaatcatcaactaaaagcacttgtttcaagttttgttctgcactcccacgactgaagttgtagattgagccgaataaccatgggaagtgaccaagcaaagacactcgattggagtcagttgaatatttgtaccctcagtggagcccttctggtcttttcttccacttctgcagaatttcctctagcaaatacttctttctccttgcttgcctccaccatgatatttgaataagagatggccagaggataacacgttcgcgaggg

SEQ ID NO: 665466 - DNA, 932 bp, Homo sapiens
ttgctgccggcatggaataatcgatctcaggggattcaatagttgatgctaggcgagaaggctgtataccctaaaaggtgtacgaccgcccgggtctgacaagcatcccggcgtgcttagatcaacccgtgcctatatagaaagaatctccatcgttcgcacatttagctcagtgacgctgacttgctgaagagagtagataagaataccatgggcatcggataccctcgctggactttgggtgcatcccagtggactcaattgcgggcaaccatggatgttgtgtaggaaggtccgtggtccgaaggggacaatgagtgtatccagctcttcctacgaaaatattgtatgtggtgtatagacaacggggaactgaatctatttgtgaactaagcgtctatccgtgttttctggccttgtcgatattggcaaggtctatgatacatccattgcaaagataacctgtcatagggtgggacctaggatgaatagaaacgttaacattgtcgtcctagttgcgtatgttggtaatttctaacgatttgcccctttatagatgtacttggtggtctttaggtcacaaggtttactgaggataaggcattggacttgatcgaatttatgggacatcattagtttttaaattactccgtaatattttattataatcttaaaggtcacatgttcgccactttgtaattggtggagttatgctaaggataaaattcttaagtcctggcttttagagtcaccttcgtataattggggaatcgagggtacttgaaggagaattttacatcgttattttgacccgtcctattctggacttaggggaagggtgaaagtggggttaatattggtgcgggcataactttttttcctttaattggtaatgcttgagtgttaaggactgctagggtattatactgtgg

SEQ ID NO: 665467 - DNA, 959 bp, Homo sapiens
tgaacatttaatgatgccgtggctttcctagcatatcaggttatacttatgtttattaagacctttcttagtggttcctttacagtcggaattatattggtgttgatctttcttagtggttgcttaagaagttggagttactcatttataactaatccacgttggcttcagatgacactataccacttggcaggtagggtggtatataataacaaactaatcctaatccttgcctctcgttcctgtatcattgcctgtcattcattttgctaaggtataagcagacataagcatacataatgtgaatatatggtggctattattatttgaacaaactacatcttaggtcatttaagaatcaagaaaaataaaagtttttatttaccttcacttactccttcttgatgcttctccttggttggtgttgatccaaattctgacctatattcttttccttccctccagagaaacttcttttaatgcttctttcaaggcatgtctactggcaactaattctcttaatttgggttgtcagagagtcttttacttctacttatatttctttgcagggataatgtcatgtagttatataattctagttgctgaattttctctctgtactttattaattatttattatattggacaccgagtcttgctctgttgcctagggtggtaccgcaggatgtgatcccagtccatgaacctcggctcctagtgcaacgaattattgtactcaagcgggagtagcggaatacagacactcgccgcaacccagacatgtggtaagggaaccggctcacagttgcagggggtgaattgacaggccatacccccaatacaagtgggacaccggacggacagggaaacaaaggacatgggagcacaagaaaaagccaaagacaccaagaaacacacgaaaagaaaagaaaaaagagaaacaaaacaacagaccaaga

SEQ ID NO: 665468 - DNA, 540 bp, Homo sapiens
gacttggagtgctcttgccagattatgggctgagtcctgctagggagggtggccccccttccccaggaggagcccaccctgagacctggttggggggcagcttagaccctaccttagactccagcaggctgtcttgggagcatgtaattatgttttttttgagacagggtctcctgttgcccaggctggagtgcagtggcaccatcacagctactgcagcctccaccccacaggctcaggcgatcctcccatctcagcttcctgagtagctgagaccacaggtgcacaccaccatacccagctaattttaagattttttatagaggcggagtctcactatgttgcccaggctggtctcgaactcccgtcctcaagcgatcctcttgccttgggctcccaaagtgccgctgggtttgcaaggctgtgaactaccatgcccggcagagcatttaatattctccaaatgtctttcctcgtgtgctacctgggctcactgctttctggggctctcgtgttgctggtgtctccaccccaccccac

SEQ ID NO: 665469 - DNA, 129 bp, Homo sapiens
gttgggaaaaaaaactaaagggcccccccccccttttgaatttttaattttttaattaagggtcaaagtggggccaccttttttttaccccaaccccctattttttttaataaatgtgggacctgttta

SEQ ID NO: 665470 - DNA, 379 bp, Homo sapiens
  misc_feature (355)..(355): n is a, c, g, or t
ggtacccgagcaacatgggccgctgttcgcaccaaacgcgtgtaagaaggggggccgggtcgtcatagagaaagtactagatgcagcctgtgtgcacatagacgatatccgactacggaatgaatgcgtgccagtaggcgcccatgggatgatctgccaattatcccgcaagtaatagaagctccaggcaatcaggaatgatcaagcgagagctctaatgtcaacccgcatcattgagtgacatcgagatagttccatcgaagaggggctccgatggtagatgatggtagtcttccctattctagagcgtagtctaggccaggaagtgagtagaaggatatagggaatgtagaanaattataatcgttccgctgattgt

SEQ ID NO: 665471 - DNA, 881 bp, Homo sapiens
  misc_feature (57)..(57): n is a, c, g, or t
  misc_feature (66)..(66): n is a, c, g, or t
  misc_feature (178)..(178): n is a, c, g, or t
  misc_feature (407)..(407): n is a, c, g, or t
  misc_feature (411)..(411): n is a, c, g, or t
  misc_feature (424)..(424): n is a, c, g, or t
  misc_feature (428)..(428): n is a, c, g, or t
  misc_feature (458)..(458): n is a, c, g, or t
acagatctggcctgatgaagctgaccattgccatggcagctgttgaccaatgaatgncaaggtctngattttattgcaattgctattgccacaagtagcattgccgtttctggatctcaaacttcaaaactaaagagaaatcatcagtatttctaccagcaacatcttcatgtttttntccttcactttcatcagcagaaagccaaaaacgagaacttcgtgaagaacgtggtttcttaatttgcctatttgaatcaagatcttgcctgggcccgttggtttggtatatctgaagccatatacctttatgcgaggagaaacggaaactgagttttttgaattctgatatttttgttggaaagacaggcttccctaccagagctgttaaatatataaattgccattcnaaanataatgcattccnatgnagttgacacatttcactgcatacttattcnaatttgaatgaaaatttctacctataatttattaaatgagtcatctgaaatatttagagaaaatctggttttaccattacttgaagtttgttcatcctgctctccctctctcatcctttctctcttcctttccttctttccttgtctcctttattgttatttttcctgtattcttgtgttttttgttcgtttgtttgtatctcatgtgttgagggctgagttaataatgtgcctcaattcatggcacatttccatcttgaaccaaacaggaccctctcttgggttatatattttcttatgtacctactttcatttttatccccaatctgcttgccatttatctacactaaagagcaccattttaatatgtgttgttttcataaagtattatatgatatattattaatcatacgctgaggcgca

SEQ ID NO: 665472 - DNA, 929 bp, Homo sapiens
atagagatgctggtctcgaattcctgggctcaaacaatctccccatcttggcctcccaaagtgctgggattacaggcatgagtcactgaaccccacgtgctaaatttgtgtgtgtgtgtgtgtgtgtgtgtgtgtgtgtgtgtgtgtgtgatgagagagttgtcgctctgtctcacgcaggctggagtgcaaagggtcgtgtctctcagcatcagctgacaatctccacctctcgccgggttcaaacgattctcctgtctcagcatctcacacaatataggtgagaaatacaggcacaagacgattctcctgtcatcagatctcgcgcaatgtatgctgggagaaataacagggcacgcggcacaaacacgcacagagtaatgtgtgattaattgatcgagagtagaagaacgagggtcatcaagctgatgttgagggccaaggaatgggtcgtaggatcgtcgtaagacgcgtcgattgaatcgcggcatcatccgcttgctgatcttcccaagaggtgctacagagaattacagggcgtgagaccaacagaacgaggaggacttacgctgctaaaatttataaaggagggacttttaagggggagctggggggcgctcccaaaggggttgtagcatgtcccaataaccgaggtgctgatcctacaacatcagacgctcttgggtacttgtggcgcggggggttagactcgtgagttacgctgttgcgccagtttgtggaaaaatattgcacccatggacattgaggaaatcaacagacctagaaagcgaggggttcactgaaatgtgagtactccacaggatataccaattgtggcgaccaggatggcccaagggtgaataagatgggggaaccacccaatatataaatgccattcgtagaaacagagtgaccagcacgggggcacc

SEQ ID NO: 665473 - DNA, 815 bp, Homo sapiens
ctttgctgtctttcgggcagactccattcagcctacagctccctgctcacttttcacctgtccactcctcggtccaccacctgtaccatgcccgcctgtggtgcacgtgtccccacccttcctgcactctttgcttgaggatcttccgatggggaccagggaggcaggcgccatggttcccgcactctcctggttgagcaccatatcaccaacctggctggcataccttaaactctgccctctagttggcttgagggggtgagacaagtctagtgtcctgaaaattgcaactttagattgcagaccccttagaaggcaaacagcaacagttaaatgacaacccgaggcggctctgtggaccacatgcaggacaccagcagcccttcctagaagctaaagatcccgagccaattgaggcctgagcatgtgccgtgcccaggatggaggaccccacacctgttgtgcctggagacccccttatgttgcaggcgagacctttactgtagacttccaggaactggattggcggaactggatactgagccgagggtaccagtgaatactgcaggtgggaggttcgctccccaaacgtgttggaggccaagcattgttgccctttcattctggcgttcaggctcctaaaggcaaaaatccttggctgccgacctctgtgtgcctattgccagggccctttttctcttactggtataatggattggcaccggtgtcgatcgtgggagccttgctactaccaacagctggttggtggaacacatcatcccaccgctttttgggcgatcttctccccccaacgt

SEQ ID NO: 665474 - DNA, 117 bp, Homo sapiens
ttgagcagaagtaactagtaaatagcagctggattacagtagtatccccttaatggggtaggtatacgttccaagacccccagtggatggctggaaccacggatagcaccaaaccct

SEQ ID NO: 665475 - DNA, 395 bp, Homo sapiens
  misc_feature (18)..(18): n is a, c, g, or t
  misc_feature (94)..(94): n is a, c, g, or t
  misc_feature (200)..(201): n is a, c, g, or t
  misc_feature (224)..(225): n is a, c, g, or t
  misc_feature (229)..(230): n is a, c, g, or t
  misc_feature (267)..(268): n is a, c, g, or t
  misc_feature (298)..(299): n is a, c, g, or t
taaaaaaaaaaacctaanttgtcgagcactaaataaagatccagattttggtgggggaaggtgggtggggaaaaataattcccttccccccaanctcaaggcattgtgtgtttttaacccctcccaagaactctgcatttaggtacttgaggctgactactaaagtttaagtaaccttttccattgtaatattctgtaannactaccaattgaaattagaacannagannacttttctgaatccaatcctatttttattttatacannatttctcagctgtgatctttggagcaaaanncaacggcaggaaaaaatagtttgtaccagtttcatgaagtatgtctttgggtttttgtaaataattttaactcaaataaaattgctactttcaata

SEQ ID NO: 665476 - DNA, 164 bp, Homo sapiens
catgcagcttggtgatgcagcttgagataatcttcctggcgaaagatccttaacttcattacatctgcaaagccctttgcccatacaaggtaattttgacaggttcctgggattaggacatgggcatcttgggaggccactactggccttaccacaactgggca

SEQ ID NO: 665477 - DNA, 337 bp, Homo sapiens
  misc_feature (267)..(267): n is a, c, g, or t
tcggtgctctgatgatccctttttttttaggagaatgacgcttctgtcgcccgtggttgaaatgctgtgggcaatctcggttcactgcagctccacctcctgggttcatgccattctcctacctcagtttcccaagtcgctggaactacgggcgcccaccaccatgccgggctaattttttggaatatatagtggagaggggtttccaccattttgggccaggtgggtctccaactcttgagctcgaggttggtcggcccacgttgncctcccaaggtgtgggacataacgggcttagagcctcaatgcccagccagagattgtattttgaccactg

SEQ ID NO: 665478 - DNA, 894 bp, Homo sapiens
ccctcatcctgctgctctcgggagccctggcctgaccgagacctgggcctgctcccactccatgaggtatttctacaccgccgtgtcccggcccggccgggagagccccgttcatcgcagtgggctacgtggacgacacgcagttcgtgcggttctgacagcgactgccgcgagtccaatgagggggatgcctgccgggcgcctgtgggtgtgagcaggatggggcctggaagctatctgggaccgggagcacacaggggccaaaacaaggttaccccccccccccaaaacacatggctggttctccacaaggttggccaaaccaaagggggcccctgggaaaccgcgccgtcgaaactggcttttggcatgcgggccgcccatatgggcgcgcgtgcgaagaacgcccccctgctgtggacatcaggccagggcggcacttaacccattaacccacacaagcgcctaccaaatcgggacacactggcggcccgctggcaaacatgcgcgcgaggcgacccccccacactggtggcagcgggacggccgcatatttcccgcagattttttccccgtcaaaagcgggccgtcgataactatcactcagaccccacgccaccgagttttagacccacacccgctaagacgggtggaatccgtctgatgacgcgcgggacgcaccaacacttcttggggccgacgcctcttggaccaccttttttggcggggccggggggaccgccccctcactttggcgcggcgcacgacgcgtgcatcaaagacgaccgccgcccaccccaattgagcggcgacacgggccgtgagcataggggtccacaccatgctcccccacgccgggggtgaacaaaacccacctgggagcgagcgagggac

SEQ ID NO: 665479 - DNA, 480 bp, Homo sapiens
ttgtcaacgacaggaaactgttttgatcctgattagtggctccacgggcggttgctgtgacctcaggctctagtgttcttctagctcatgtgctcactgcgtcggtcgatctactattgagactaacctgaatacacatagtactgttctcagggcttgtagtatctatacatgtctggggcatgtctctataatgtggttcgacgtacgaacattgcagataagccacccaattactctctcctgaactccatatcatgtacgtcccttctctcgtcagcacaatccactcgtacttattgggcacaaatgctaatattacatctacctctgtactgccctgctgtgaaccaggaccttgggagtgctctgaggttagtaattacttccacacagacctctaatcaaggtgcttctacagcctaaatagctctcaaaacatcaggctcctttctatactcataatctttggtccagctc

SEQ ID NO: 665480 - DNA, 709 bp, Homo sapiens
tgtaacttataacactatgaaaagattgaccaacaatttcacgttggctgtgtgctttagattgttgtttaaggcatattctttcgcttgaattgctgtgttcatgagagttagggtgttttatgcttcttgaattaatttgataacatatttaatgaatatgtaccaggttaatgatagtaaaatctatgttgtgaacatagcgaagttgtgaaagcagtctattagagtaggtgaaagtaaagtatatatttgccggttatccatatcttttagaagtcctgacagaacaaccagtttatttgcacataggtagcttctgttttgaaggaaggtaaagttataaggaaactcaaatactataagatgtgtcaaggtatttctccagaattaattgcaaagctagtggtggagggatttaatcagtttctaaaattttcttctcaataagacatatgttgggataccttaggggaaagataccctcatttataattgggccctttatgcatttaatccaccatggataggaccatttaaacaatttcatataacgaaaacatcgtggctcatactgtacatctatttctgtgctttggaacctactgtggtcaatagtttcatcgaaagctgtcagcaatacgggacataaaacgtgctgtattatactttgtggcactctgcattaacccgctattttcccacaata

SEQ ID NO: 665481 - DNA, 443 bp, Homo sapiens
gggtgggcctggatttttctctcccccagagggcccgggccggggggggggggtgacccccccccctcgggggctcccccggggggggtcccgagggggggagcgaggggggcgccctctcccccccggggccccctttcgttggggaaaccggtttttagaaaacccaaggtttcggccgggggggtccccccccggggggggggttccccccccccaaaaagtttcccccgggggggggttttggggggggggggcccccccctttctttctggtttggggggccccccccccccccttggggcggggcaccttttttcccgggggggcccccccctttggggggcccccgggctttttttcccccccccccccccccccccctggggttttttttttttttgggggggggggggggttttataaaggggtttttttccca

SEQ ID NO: 665482 - DNA, 504 bp, Homo sapiens
taaacctagacctgaatccagaaggctaggctctataatcagtgatgccccagaatttggttttctcatttgtcaaatgatttaccatttctgaagtattaagcttttttctttttttaaatgcataaatgtatactgaaagaatatactccccagagtttttttttgttttgttttgttttgtttttgagacagagtctcactctgtcgcccaggctggagtgcattggtgtgatcttggctcactgtaagctccgcctcccgggttcatgccattctcctgcctccacctcctgagtagctgggactacaggccaccatgcctggctaattttttgtatttttattagagacggggtttcaccgtgttagccaggttgatcttgatctcctgacctcgtgatctgcctgccttggccttccaaagtgctgagattacaggcgtgagccactgcgcctggttgggaatgtagtttttttagatgagtaccttgctacttagaa

SEQ ID NO: 665483 - DNA, 156 bp, Homo sapiens
gaccgccaaccgccacaggcaacacgccagctaagagccagcgctcactggcacgcggaaacctccagggggaaagtgggccaactctgccgctgccctagtgttataactcctcggccccttagtgtagctccagagaggccctacttgaaatac

SEQ ID NO: 665484 - DNA, 373 bp, Homo sapiens
  misc_feature (34)..(34): n is a, c, g, or t
  misc_feature (86)..(86): n is a, c, g, or t
  misc_feature (150)..(150): n is a, c, g, or t
  misc_feature (276)..(276): n is a, c, g, or t
gacccactaacctgaagtgaaaaacaaagcttgnaggatgaaacacatgctgactaaaggaccttgataggctacatgagtggtancaggagtagtaccatggccttggactagcccattaccgtgtgcttcaagtgtgcccagcatagnccaactttggtggcctgaagtgttgatcatccctccccaattcagtcagccagcacagagagacaaacacttgtttgggaaaagtgagagaagaggatgagagactcctggtatccaggaaatgtnccagatcttattaagtcacccatgatatacctctgaagtatgaaatatggatcactactgacttgtggactccctagtgagatatagctgcagtaac

SEQ ID NO: 665485 - DNA, 691 bp, Homo sapiens
ggtgcaaagccatttgtttaaaaacatctttaacccatttgttcaaattttggaagtttcccatcaaaattttttcaagaatggaatttacaccatttgctggaaataaaatggcctccccagaatggtagtttcgagttcaaacaacaagagcccgtggtatatggggtttaaaaatgtaaactcctatgcaaacttcggccaatagccctcaattcctatgaccactaatgacacacctccgtaaagtggtatttaaggtgcaagttgtaaactaaaaagtctgtgtattccgcttggttaccaaatgtatatttgtagccctttccggccatagcattcaaggtgttgtttaaagtgaaaaacaaaagtgataatgggtcaaagtctccattgtggatagaaataaagaacagcaacgctttggaataggccaaataaacaacccaattcttaacgtttttaagtgaaaggatgaagaacctggggggtgggtccagagcaccttttaacaaagaaggcgtaacctaatgttgagtcttaccttaaatatttcacaatcatgttgacgtccaaggcccggaactattgaaaaaagccttttgaaaatatgggctttaaaatccacaagtcctttcctcttgccccggtttctccgtggatgacataaaaaaagggataagctggaaaa

SEQ ID NO: 665486 - DNA, 246 bp, Homo sapiens
tgcgccgcgccgggcagagccctgcaagggaccggatcggtgttggggctcctggagttctgggacggcaacctgccgattctgttcgacatcgctgaccggctctcgaacgcaggcgcggacctgctcgccagtcgcgtcctcgaatcggcaatccccctcgcccaactgcgagctcatgcaccggtgcagcctcgccaaatcttccaggcgggggcgaattaccacaagcacgtggtcgatctg

SEQ ID NO: 665487 - DNA, 97 bp, Homo sapiens
ttttttaaagttcagctttttattgaacatgttataaagaggtttagttacaaaaagaccaaagcccatgatatcagtcagacctactacgggattt

SEQ ID NO: 665488 - DNA, 310 bp, Homo sapiens
accatgtcttactacctgaaccactgtaaacacaattccacttcgtcactatgaatttaactgtaactaggtacctcatataagtggaataatatgatagtgatccttattgtgtctggtttatttcacttagcataattatttctagcttcatgttgcagcatgttatcagaattttcttcctttaaaaggctgaataatatttcattgtggatgtatatactaccttttgtttatccattcatccgtatgacagacattggattatttacatgtattagctattgtgaataatgctgctatgaacatt

SEQ ID NO: 665489 - DNA, 916 bp, Homo sapiens
  misc_feature (41)..(41): n is a, c, g, or t
  misc_feature (69)..(69): n is a, c, g, or t
  misc_feature (86)..(86): n is a, c, g, or t
  misc_feature (89)..(89): n is a, c, g, or t
  misc_feature (97)..(97): n is a, c, g, or t
  misc_feature (108)..(108): n is a, c, g, or t
  misc_feature (114)..(114): n is a, c, g, or t
  misc_feature (121)..(121): n is a, c, g, or t
  misc_feature (143)..(144): n is a, c, g, or t
  misc_feature (150)..(150): n is a, c, g, or t
  misc_feature (158)..(158): n is a, c, g, or t
  misc_feature (195)..(195): n is a, c, g, or t
  misc_feature (222)..(222): n is a, c, g, or t
  misc_feature (226)..(226): n is a, c, g, or t
  misc_feature (236)..(236): n is a, c, g, or t
  misc_feature (238)..(238): n is a, c, g, or t
  misc_feature (240)..(240): n is a, c, g, or t
  misc_feature (244)..(244): n is a, c, g, or t
  misc_feature (252)..(252): n is a, c, g, or t
  misc_feature (259)..(260): n is a, c, g, or t
  misc_feature (280)..(280): n is a, c, g, or t
  misc_feature (291)..(291): n is a, c, g, or t
  misc_feature (295)..(295): n is a, c, g, or t
  misc_feature (301)..(301): n is a, c, g, or t
  misc_feature (305)..(305): n is a, c, g, or t
  misc_feature (351)..(351): n is a, c, g, or t
  misc_feature (375)..(375): n is a, c, g, or t
  misc_feature (409)..(409): n is a, c, g, or t
  misc_feature (426)..(426): n is a, c, g, or t
  misc_feature (438)..(439): n is a, c, g, or t
  misc_feature (441)..(441): n is a, c, g, or t
  misc_feature (459)..(459): n is a, c, g, or t
  misc_feature (472)..(472): n is a, c, g, or t
  misc_feature (511)..(511): n is a, c, g, or t
  misc_feature (516)..(516): n is a, c, g, or t
  misc_feature (567)..(567): n is a, c, g, or t
  misc_feature (594)..(594): n is a, c, g, or t
  misc_feature (752)..(753): n is a, c, g, or t
  misc_feature (901)..(901): n is a, c, g, or t
tttttaccatgaatgtataaaaataaataatggaatgaatntattcttctgctgtaaacccgggtggcntatatcaaaatccactnggngaattttntttagaaagtnctctanagaaaangtctgaagaaaaacaggaaatnntttcanaggaaaanttttgaaaaaggacctgcatgctttaagtgcaagaangcttgaatggaaatgtcatatattacntctntcacattttnanantggntcctccgnaaaaaannttcttgtgaaacaccatgcngcatacaaatntccntgggangggncacctttcttctgctcccatgatatggtgttgctctcaagcaagtnacaatgccttgtgcttttccaatntgacttgcagcttgttctgcatgaagatcctttntacccaatatttctagngttaagtaaagnngngagctctgtgtgttttcngcataattttccngttccttgatattacgatatgctttgtcatccagttttnccccnttttcttcggggattttcataagccatcttttagtcagattatgtcttttnccagccttccatagttcaatggccacnggctgatgtggtggattgtcacagtatatatcttccacagtttttttccaaaactgcattcgcatcagtccaattgttttctcagggactgagtctttaacctgagccagttccacattaaaggccctcagtgcaaaaacagagcttcgggattctgnngggagcagcagggagcataaataaccttcataatcccgtttcctttcttcatcctgtgtagtagcagaaccccggtggtgggtgttaccctttcatcaccagtgactggtccaggacagtgcatatttccctgatctggccaattagncttgagaacaagtcc

SEQ ID NO: 665490 - DNA, 102 bp, Homo sapiens
tgggggaccccaaaaggccccctaaacaaaacaataaaaggggggaaaaaaactttttacttaaaagggacaggggaaaaccttaaaaaaaatatccaaatt

SEQ ID NO: 665491 - DNA, 1073 bp, Homo sapiens
aaaaaaaaaaaagaaaaaaaaaaaaaaatataaaaaaaaggagagagaaaaaaaaaaaagagaaaacaaaaattattggaaaaagggggacacataatattgggaactttttaaattagaaaggagaagattaaaaagtaggtaatggaaaaatgtgtaaaatgttggggattctatttgtaagaagcgagccatacattaagtggtgagcgttgtacattatttggcggacagtattgtcgcctatacctgaataattgtatgacggcattcatagaggaataaacctattaaccattcttgtaaacgggtgttatacactgtggtggtactacatataccgtgtgcatatatattgccatgcgccaacggttgtactagaatttcgatggcgcctaaccattgaatcatagttgaatcttagcagaaacaaaattactcatcatacacacgagagagagaagctatggctgagagtaacaaagcactgccataaggagtggacactgacgaatcagcactatcacgatgcgcactgatcggtagtactagatagtacatcaacacgctccatgcaaatctgatgattcgtaagcacccaacgctattcagatcgagtcaaccaacatcacgaccatgatcacagagaacatgaaaagatgactgaaacgagcataacacaacgacaggccgacacgcgaccaactacgacgaccaccgcataactaaattaagcagcaagaaacacaagcccacgagagaacacagatcagagagaaaaggtacaacacaagaacgacagcagcgtaacagcaagcagacagcacaacacaccacggcaagcaagactgagaacaaacaaggcaacagcagccaacggcacccgacacaagtaacacacaaatataagaatgcgacgtaatcaacgcaaacgcacaacgaaaggcagaccccagacacagcgcccaaccaagccaagcaacggaacaaagagacgatcgagaacagcgacacacacagaacggaacggacgcaaacaggcaacaagcaacgcgcagcacacaacccacacg

SEQ ID NO: 665492 - DNA, 634 bp, Homo sapiens
  misc_feature (128)..(128): n is a, c, g, or t
  misc_feature (143)..(143): n is a, c, g, or t
  misc_feature (157)..(157): n is a, c, g, or t
  misc_feature (161)..(161): n is a, c, g, or t
  misc_feature (165)..(165): n is a, c, g, or t
caacaacactgagcatcttgaccaaggtcacttggcccaaccacaggctaatcccaggccatgtgcacatcccaggattagcttgtggtttatcagttgtcaattttttttttttttaatacagggtntcactctgtcacccnggctggagtgcggnggcnatcngagctcactgcagcttcaatctccgggctcaagtgatcctcccacctcagccttccaagtagtggggactacccacatgcaccaccatgcacggctaatattgggtccttatcggggttctacggcttggtgtaacttatggtttaggttttctggagacagagtctcgctctttcgcccaggccggactgagtggcgcaatctgggctcactgcaagctcagcctcccgggttcacaccaatcctcctgcctcagcctcccgagtagctgggactacgggcacccgccacaaagccgtggctaatctcggtattccaggtcgagagggggttccatccgcgtcagccagggggtatccagacctcctgacctcgtgatctgccgctcagcctccaaagtgtgggatacagggtgagcaccgaccggccctgtggtatcaagtaacacggtttatcactgcaagtgcta

SEQ ID NO: 665493 - DNA, 175 bp, Homo sapiens
gtgcacataatagcagaataaaaccacatatatgtgtaacccgcagctttgtggacaactgtctccagctgcatgaagcgaacgtttggactccgccactgcttgcatggcgaaatattgggcatctgagttacaaaatagtgtagcttacgactgtgtacagctacatggaggg

SEQ ID NO: 665494 - DNA, 131 bp, Homo sapiens
tatcgaccgcaatgtctggttgatgtctgcaggccgcttgcacatgctcgaacagcaggcaccggcgtcagtcagttcgatgccgcggtaaatgcgatcaaacaggcggatcgccagttgctcttcaaggc

SEQ ID NO: 665495 - DNA, 397 bp, Homo sapiens
gctcgttactaaagtcgcaaacaacggttatacaggagaggagttgttagaatggcttccggtttatggtacgctggacggcgtactcaatgtaaaacgtgaactgaaagccttggaactggggaagctgaagcagtccatctatatgcttgaaaatgagctgagagagaaggacgtaaaaaacaagaaacttcttgtgccccgtttaatcaattattatttttggcttatagaccattatatgaatggtactgttgaaaagtcaaaaatcgatgaaattcttctaagaattaaactgctcgacgagaaaatcaatgaccgctatatacggtaatgacactgtgaggtgaatatgtcagatgtattagaaaagagtgtccgcgatatatttaatgag

SEQ ID NO: 665496 - DNA, 385 bp, Homo sapiens
aaagggacaggtaaaataaaaacagagtctaagttctgttgggtataggatcagaaattgtcaagaatcgggtagtgggctgggcacagtggctgacgcctgtagtcctagcactttgggaggccaaggtggatggatcacctgaggttaggagttcaagacctgcctgaccaatatagtgaaaccctgtctctactaaaaatacaaaaacaagagttagccaggtgtggtggcgggcgcctgtcgtcccagctacttgggaggcttaggcggcagaatggcatgaacctgggagttggagcttgcagtgagccaaggtcgcaccacggaactccagcttggcagcctgggcaacagagcgagactccgtctcaaaaaacaaaac

SEQ ID NO: 665497 - DNA, 157 bp, Homo sapiens
ccctgccacggattgtggctcaactgactccaccttcctcagtgaaaaacagtgtgagacctgaaccatgctgctgcagccctgcggggtccctcggctcctacagctacctggagtccccactggggcagcacctactccgtgatcagcggatgag

SEQ ID NO: 665498 - DNA, 944 bp, Homo sapiens
ggacttcaggacaagattgaagatgctgactctggaatgaggactccccttgtggctagggagtactgattgtgaccagtagagttgtgccagctctattacgagagtgcacacaagggtaatagacgatgtggagataggatgcattccggatgccttgtgagggctcagtcacactctcagccactcctcgtctatgcttcttagctgtggcataaataaatgtggagagtcacaagtcgcccctattattgattgtggaatcattgaccacaagggcttgtgggctcctcgtgtagcgcacatggaatagtcttgcaaccgtccatgagactcttacccactattcctcttgacgcgggatgagttggccaggaggtgtcgcgcaaagtgcgtccagcgctgagttacggtgggtatcgctaggagcgtgttggctacggtattcctatacattaagtctcagcgtgcgcgaaaaagcgcgaaaaggaccagcgcactcgccatgtgaatgcactagctattgcggtaccattaccttgaccctagttcgttcgtcacaaaggaatgggtagagatgagagagttcccccgagtaaaacatccgcgtctacgatgatcatggctaccatcatgataatagcaaggacaacaatatccgtggattcctctgatccactagaagcccctgttaatgggtcctaccaagtatatgaactaaattgctgatgataaggtagtgtttcccactagataaggtcaaggcgtccagtcccaggggactcgtttgtcgtccatatcacactttcgaacatagagcacggatatccccttgtggagggtacctcggaggggatacaatgaattccgttgcatatgacatgccgattttggggcacgcctggggtggacaaaaattactcaaagagtgacaatggagtcag

SEQ ID NO: 665499 - DNA, 1139 bp, Homo sapiens
  misc_feature (33)..(33): n is a, c, g, or t
agcgggctgagacagaaggccgcctaccggggnggccggctagccgcggactcgggcgaacccaccctcgcgatctgtcaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaatgcactgaaaaaaaaaactcttcacaaccaatcacacaacaacacctaccacaccacatcaacaacacacaactcccaacacaaaaacaacaaatcacaa

SEQ ID NO: 665500 - DNA, 182 bp, Homo sapiens
  misc_feature (46)..(47): n is a, c, g, or t
tctagaggattccaaatctctcattgcgcctggtatactttaccannccacctgtgtcggtttcgggtacggtcttacgcggaggctatttcctgggaccccttcaccgcccggtcaatccaataagaccgaacgatacacggcatccgtcaccatccgctggccggggaatattcaccccg

SEQ ID NO: 665501 - DNA, 218 bp, Homo sapiens
tctttgcttagccagttttcacaaaaatgagttagttcatcagcttctctcagtgatgtccaattaaggttttctggttttaagagtcattgtgaacttacagatttaaaggtatttaatgagattcagctgtttgcagtcatctttactgatgcacaaatgtcccatcattggccattagaagcctctttaaattgacccctaagttcagagccagg

SEQ ID NO: 665502 - DNA, 1681 bp, Homo sapiens
agcggagtttttgagggagacctaaaactgtatcatcctagcccgtatctctcccttttaactgttctttatgtgtacattctgtgcccaaaagaaaacaacctttcattaattgggcaattgtccaggctcttagcttggcatccagctctcagagctgtgaaatcaaccgcaccagatctacgctttgaaatgaggcaacatctaactggaaactcgctcaaagtaaggaagtggatgaaaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccaccgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaatgcactgaaaaaaaaaactcttcacaaccaatcacacaacaacacctaccacaccacatcaacaacacacaactcccaacacaaaaacaacaaatcacaa

SEQ ID NO: 665503 - DNA, 1381 bp, Homo sapiens
agcgcggcggaatcatctatctcgcccccgtcgcaggcagggatacagttcctgcaaggggtcccggggggcgcgggaggcgcaggacgctaggctctgccgtcagcccgcaacagcgctcagtccagggagggaggcccgggtggggggcagccgtaagcccccgctcagcgtgcagccaccggggacttgcgcggccgtggcaccgctggagggggcggcctggggctggggctgcccggcggcgccgcgaccgccttccttcgctgcgtcccgcccgccccacgcctcgctcaccgccgccgcttctccctgccccgcagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaatgcactgaaaaaaaaaactcttcacaaccaatcacacaacaacacctaccacaccacatcaacaacacacaactcccaacacaaaaacaacaaatcacaa

SEQ ID NO: 665504 - DNA, 185 bp, Homo sapiens
cctaggacttcacgaccagcctgggcatcacggcaagaccctgtctctacaaaaacacagtaattagccgagtgtggtggcgtgtgcctatagtcccaggtactggggggctgaggcagcaggactgcttgaaacctggagatccaggctgcagtgagccatgatcatgtcactgcactccagcc

SEQ ID NO: 665505 - DNA, 1238 bp, Homo sapiens
  misc_feature (33)..(33): n is a, c, g, or t
agcgggctgagacagaaggccgcctaccggggnggccggctagccgcggactcgggcgaacccaccctcgcgatctgtcaagtctgtccccaggggaggtccccctttcgggaggaagtttttaaggggatttctcaaaatcacccccgcgcttccttcactccttccttagagccggagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaatgcactgaaaaaaaaaactcttcacaaccaatcacacaacaacacctaccacaccacatcaacaacacacaactcccaacacaaaaacaacaaatcacaa

SEQ ID NO: 665506 - DNA, 1788 bp, Homo sapiens
agcggagtttttgagggagacctaaaactgtatcatcctagcccgtatctctcccttttaactgttctttatgtgtacattctgtgcccaaaagaaaacaacctttcattaattgggcaattgtccaggctcttagcttggcatccagctctcagagctgtgaaatcaaccgcaccagatctacgctttgaaatgaggcaacatctaactggaaactcgctcaaagtaaggaagtggatgaaaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccaccactgagaagggtctagcggagcacaggtcaccagctgggcaacattcagaaagttagtcttcctatgctcattttcctgggctgttacagaagaagactggaagagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaatgcactgaaaaaaaaaactcttcacaaccaatcacacaacaacacctaccacaccacatcaacaacacacaactcccaacacaaaaacaacaaatcacaa

SEQ ID NO: 665507 - DNA, 419 bp, Homo sapiens
  misc_feature (379)..(379): n is a, c, g, or t
gatctctcgtacccgtcagacgctgaactatgtggggttcaagacttcagtggtgaaaataactgtagatctgctgcaaatagcaagagaacgagacacagaagtggagcctgaagatgtgactgaactgctccaatctcataaaacttgttggtgaggagttgcttcttatggatgggcaaataaagtggtttcctgagatggaatctactcccagtggagatgaaatgacaacaaaggatttacttgataaagcagtagcagggcttgagaaaattgcttctaattttgaaggcagttctgctgtaggcaaaatgctatcaaatgtactgcatcctacagagaaatctttcaagaaagaagtcaactgatgcagcanactttatcactgtgttaataaactgccatagccacatagt

SEQ ID NO: 665508 - DNA, 1283 bp, Homo sapiens
agcggagtttttgagggagacctaaaactgtatcatcctagcccgtatctctcccttttaactgttctttatgtgtacattctgtgcccaaaagaaaacaacctttcattaattgggcaattgtccaggctcttagcttggcatccagctctcagagctgtgaaatcaaccgcaccagatctacgctttgaaatgaggcaacatctaactggaaactcgctcaaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaatgcactgaaaaaaaaaactcttcacaaccaatcacacaacaacacctaccacaccacatcaacaacacacaactcccaacacaaaaacaacaaatcacaa

SEQ ID NO: 665509 - DNA, 424 bp, Homo sapiens
tgaagactgggacgaccctgggtagaatctagtttttaattatttttaatgtaaaggatcaaattaatttaaatatggttttgaagtctacagaacttttagttctgtgctgtctatgtggaccctttggtaaaatgcaaattttgatatggacgttatccttggtctggtgagatgtttcatatttgtggccgttaatttaaaaattttgggttaatgctgcctgtgtctatgggggtctgtcttctttgatagccatctattcatttggatcatggggccctctttaatccttcccccaatcaaataagcttttgctattggtttggggttgggatttccgtttcggaaacttttgaaaaatgctaataattacccaagggttttgtcaaattttaaaataaatgtgtgtgtgtttctttta

SEQ ID NO: 665510 - DNA, 1282 bp, Homo sapiens
  misc_feature (33)..(33): n is a, c, g, or t
agcgggctgagacagaaggccgcctaccggggnggccggctagccgcggactcgggcgaacccaccctcgcgatctgtcaagtctgtccccaggggaggtccccctttcgggaggaagtttttaaggggatttctcaaaatcacccccgcgcttccttcactccttccttagagccggaggtcggtgagggcccgcggaatcatctatctcgcccccgtcgcagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaatgcactgaaaaaaaaaactcttcacaaccaatcacacaacaacacctaccacaccacatcaacaacacacaactcccaacacaaaaacaacaaatcacaa

SEQ ID NO: 665511 - DNA, 210 bp, Homo sapiens
gtagacggccactgagcacaagtgagaactctaggaatatttttaaatcactcccagcttcatgtctctttttcttctgaaaagctatatgcttttcatgctacaagccttttttatagaactatgaaaatcaccttcagatgcagccaaattttattgccccaaaacagaggataaattgggggtaaacacacacctgtattgcggtaa

SEQ ID NO: 665512 - DNA, 1834 bp, Homo sapiens
agcggagtttttgagggagacctaaaactgtatcatcctagcccgtatctctcccttttaactgttctttatgtgtacattctgtgcccaaaagaaaacaacctttcattaattgggcaattgtccaggctcttagcttggcatccagctctcagagctgtgaaatcaaccgcaccagatctacgctttgaaatgaggcaacatctaactggaaactcgctcaaagtaaggaagtggatgaaaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccaccactgagaagggtctagcggagcacaggtcaccagctgggcaacattcagaaagttagtcttcctatgctcattttcctgggctgttacagaagaagactggaagagaggtaatttccaaggttcttcccagctctgaagttgtgtgtcaaagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaatgcactgaaaaaaaaaactcttcacaaccaatcacacaacaacacctaccacaccacatcaacaacacacaactcccaacacaaaaacaacaaatcacaa

SEQ ID NO: 665513 - DNA, 1137 bp, Homo sapiens
  misc_feature (66)..(67): n is a, c, g, or t
  misc_feature (71)..(72): n is a, c, g, or t
  misc_feature (77)..(77): n is a, c, g, or t
  misc_feature (79)..(79): n is a, c, g, or t
atatatgtgatttcaccattaaaataaaacaaagaaaaactgtgttgttgacgactctcttaatcnnccanngctanancgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaatgcactgaaaaaaaaaactcttcacaaccaatcacacaacaacacctaccacaccacatcaacaacacacaactcccaacacaaaaacaacaaatcacaa

SEQ ID NO: 665514 - DNA, 416 bp, Homo sapiens
  misc_feature (6)..(6): n is a, c, g, or t
  misc_feature (331)..(331): n is a, c, g, or t
  misc_feature (337)..(337): n is a, c, g, or t
  misc_feature (414)..(414): n is a, c, g, or t
tcgatncatggctcactgtagcctccaactcctaggctcaagtaatcctctttccttggcttcccaaagtgctgggattacaggtgtgagtcactgtgcctggcccacattttcattcttggctcactgtagccttaatctttcaggctcaaatgattctcccatctcagcctcccaagtagctgggaccacaggcatgcatcaccacgactggctaatttttgtattttttttgtagaaccgggtttcaccatgtgcccaggctggtcttgaacttctgggctcaagttatctacctgcctcagcctacccaaagtgctgggattacagngagttnaggccaccatggcccagtcatggaactttcaagtcaaattattttaaaatgggagattacattcacaatgcttattntg

SEQ ID NO: 665515 - DNA, 841 bp, Homo sapiens
  misc_feature (396)..(396): n is a, c, g, or t
gactacgtgtctagatcgcgagcggacgacctggtggagaaggtgcggcgcgaggccggcgcagggagcgcgcgaagaagaggagcgcgagcgcgagcgggaacgcgagacagagcgcgaccgcgagaaggagcgcgagcttgaaggcacgcgtgaagttaggcctcacggacggcgccgtactccggcgtggaagtgccgcagtctcggggcccagttgtcgccatcgcgcctccagtgtgaacacgggcagctgcgtggggctacaggtgtccccctacctgggtcctgacactccagcctgtggcgcactctcagtgaatatgcccggtcatcactgtccatgtcgtcctgtgcaagtcgctaaccgaagtcccattgcgtactgtgcacccntgtgcgggcaagtgagacccgggggctcctggggttacaaatgtcccggtgtccatgtactagcgagtagatccagcatgcgccgggcagagggaacgggaagcccgtgaacgagatctccgtgatcgtctcaagcctggctttgaggtgaagcctagtgagctggaacccctacatggggtccctgggccgggcttgtgatccctttccccgacatgggggcctggctctgcagccttggaccacctggcctgcaccctttcccctttcatccgagcctggggccctggagcgagaacagtctagcgctggcagctgggccagccctgcggcctgaccatgtcctatgctgagcggctggcagctgagaggcagcacgcagacaagggtggcggccctgggcaatgaaccacttggccgtgtgcagatgctcaatgtgactccc

SEQ ID NO: 665516 - DNA, 1615 bp, Homo sapiens
agcggagtttttgagggagacctaaaactgtatcatcctagcccgtatctctcccttttaactgttctttatgtgtacattctgtgcccaaaagaaaacaacctttcattaattgggcaattgtccaggctcttagcttggcatccagctctcagagctgtgaaatcaaccgcaccagatctacgctttgaaatgaggcaacatctaactggaaactcgctcaaagtaaggaagtggatgaaaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccaccgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaacgtgaaaaacacggccctcttttcgggttgtggcgaggcgacatcaaccacgaaa

SEQ ID NO: 665517 - DNA, 103 bp, Homo sapiens
cgacagtatacgaatcgagccggtaccagatgatgcagaaacccagagtaaaggggaacagagacccggagagacaactcagaaggaagcatgacagacggag

SEQ ID NO: 665518 - DNA, 773 bp, Homo sapiens
  misc_feature (47)..(48): n is a, c, g, or t
  misc_feature (52)..(52): n is a, c, g, or t
  misc_feature (66)..(66): n is a, c, g, or t
  misc_feature (69)..(69): n is a, c, g, or t
  misc_feature (73)..(73): n is a, c, g, or t
  misc_feature (84)..(84): n is a, c, g, or t
  misc_feature (106)..(106): n is a, c, g, or t
  misc_feature (108)..(108): n is a, c, g, or t
  misc_feature (117)..(118): n is a, c, g, or t
  misc_feature (148)..(148): n is a, c, g, or t
  misc_feature (154)..(156): n is a, c, g, or t
  misc_feature (181)..(181): n is a, c, g, or t
  misc_feature (184)..(184): n is a, c, g, or t
  misc_feature (189)..(189): n is a, c, g, or t
  misc_feature (198)..(198): n is a, c, g, or t
  misc_feature (215)..(215): n is a, c, g, or t
  misc_feature (250)..(250): n is a, c, g, or t
  misc_feature (255)..(255): n is a, c, g, or t
  misc_feature (259)..(259): n is a, c, g, or t
  misc_feature (266)..(267): n is a, c, g, or t
  misc_feature (286)..(286): n is a, c, g, or t
  misc_feature (290)..(290): n is a, c, g, or t
  misc_feature (299)..(299): n is a, c, g, or t
  misc_feature (326)..(326): n is a, c, g, or t
  misc_feature (388)..(388): n is a, c, g, or t
  misc_feature (607)..(607): n is a, c, g, or t
  misc_feature (613)..(613): n is a, c, g, or t
  misc_feature (617)..(617): n is a, c, g, or t
  misc_feature (624)..(624): n is a, c, g, or t
  misc_feature (626)..(627): n is a, c, g, or t
  misc_feature (629)..(629): n is a, c, g, or t
tggaccgctgggccgggcgtcatgggcggcctcttctggcgctccgnnctgngggggctgcgctgnggnccgngggccccgggnccgagcctgctagtgcgccacngnctcgggagnngccctcctggacccggtgagcggaccctgngtggcnnntgaagcccgatggcgtgcaacggtnggntcgtnggggacgtnatccagcgctttgagangcggtgcttcacgctggtggggatgaagatgctgnaggcnccanagagcgnncttgccgagcactaccagngacntgcggaggnaagcccttctaccctgccctcatccgntacatgagctcatggacctgtggtggccatggtctgggaagggtacaatgtcgtccgcgccntcgagggccatgatgtggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgagctcaagctgnccttancacncaccccncnngnaccaagtacctccgtcaggaagaacccaaggccacatccaaagcatgctgttcccaaacacttacttccctgttcaccgtctgtgccaacccagcccagaggagtctgagccaccaaccttcagtgccgtattactgtacccca

SEQ ID NO: 665519 - DNA, 380 bp, Homo sapiens
  misc_feature (31)..(31): n is a, c, g, or t
  misc_feature (38)..(38): n is a, c, g, or t
  misc_feature (42)..(42): n is a, c, g, or t
  misc_feature (98)..(98): n is a, c, g, or t
  misc_feature (101)..(101): n is a, c, g, or t
  misc_feature (231)..(231): n is a, c, g, or t
  misc_feature (257)..(257): n is a, c, g, or t
  misc_feature (309)..(309): n is a, c, g, or t
  misc_feature (334)..(334): n is a, c, g, or t
  misc_feature (343)..(343): n is a, c, g, or t
gtcgtctagagatccccggtggagacggggnttcacantggncaggcgggtctcgaactcctgacctcaggtgagcgtccggcctggcctcccaaagngcngggatggcaggcgtgagccactacacccagccaatcagtggcttttaaactacttaaataaaaagagccaacccaaaatctggtgcatgctggggaaacgggcagtggaatatgagaagtttttattggnggtgcacacaggtgactcgggctgtngtgtatgggttctggcctcgatctgtagcaagcaatcggtggtttctggccngcctttggggaagaaatgaaaaaanaagcagcangagtctccatacatcatgatggtgatggcacggggcc

SEQ ID NO: 665520 - DNA, 898 bp, Homo sapiens
  misc_feature (47)..(48): n is a, c, g, or t
  misc_feature (52)..(52): n is a, c, g, or t
  misc_feature (66)..(66): n is a, c, g, or t
  misc_feature (69)..(69): n is a, c, g, or t
  misc_feature (73)..(73): n is a, c, g, or t
  misc_feature (84)..(84): n is a, c, g, or t
  misc_feature (106)..(106): n is a, c, g, or t
  misc_feature (108)..(108): n is a, c, g, or t
  misc_feature (117)..(118): n is a, c, g, or t
  misc_feature (148)..(148): n is a, c, g, or t
  misc_feature (154)..(156): n is a, c, g, or t
  misc_feature (181)..(181): n is a, c, g, or t
  misc_feature (184)..(184): n is a, c, g, or t
  misc_feature (189)..(189): n is a, c, g, or t
  misc_feature (198)..(198): n is a, c, g, or t
  misc_feature (215)..(215): n is a, c, g, or t
  misc_feature (250)..(250): n is a, c, g, or t
  misc_feature (255)..(255): n is a, c, g, or t
  misc_feature (259)..(259): n is a, c, g, or t
  misc_feature (266)..(267): n is a, c, g, or t
  misc_feature (286)..(286): n is a, c, g, or t
  misc_feature (290)..(290): n is a, c, g, or t
  misc_feature (299)..(299): n is a, c, g, or t
  misc_feature (326)..(326): n is a, c, g, or t
  misc_feature (388)..(388): n is a, c, g, or t
  misc_feature (732)..(732): n is a, c, g, or t
  misc_feature (738)..(738): n is a, c, g, or t
  misc_feature (742)..(742): n is a, c, g, or t
  misc_feature (749)..(749): n is a, c, g, or t
  misc_feature (751)..(752): n is a, c, g, or t
  misc_feature (754)..(754): n is a, c, g, or t
tggaccgctgggccgggcgtcatgggcggcctcttctggcgctccgnnctgngggggctgcgctgnggnccgngggccccgggnccgagcctgctagtgcgccacngnctcgggagnngccctcctggacccggtgagcggaccctgngtggcnnntgaagcccgatggcgtgcaacggtnggntcgtnggggacgtnatccagcgctttgagangcggtgcttcacgctggtggggatgaagatgctgnaggcnccanagagcgnncttgccgagcactaccagngacntgcggaggnaagcccttctaccctgccctcatccgntacatgagctcatggacctgtggtggccatggtctgggaagggtacaatgtcgtccgcgccntcgagggccatgatgtggacacaccgactcggctgaggctgccccaggaaccataaggggtgacttcagcgtccacatcagctagtcacaggcattgctccccatagactagagggcaacagggagcagcagagtggtccactgggactccatcagggtgcacactgaagccttgagcctcacgattgctccatgtcactggcacacaggaatgtcatccacgccagcgactccgtggagggggcccagcgggagatccagctgtggttccagagcagtgagctggtgagctgggcagacgggggccagcacagcagcatccacccagcctgagctcaagctgnccttancacncaccccncnngnaccaagtacctccgtcaggaagaacccaaggccacatccaaagcatgctgttcccaaacacttacttccctgttcaccgtctgtgccaacccagcccagaggagtctgagccaccaaccttcagtgccgtattactgtacccca

SEQ ID NO: 665521 - DNA, 102 bp, Homo sapiens
gtactattagttcttctcaaatatcatggccaacatctggcttctaaaggaaaggctttgggtcttttcaatcacttgctgatacgggtgagactagcattg

SEQ ID NO: 665522 - DNA, 193 bp, Homo sapiens
gccgtggttcacgcacgttgtaacaaacatgtagtggctgggcgcggtggctcacgcctgtaatcccaacactttgggaggccgaggcgggtggatcacgaggtcaagagatcgagaccatcctggctaacaaggtgaaaccccatctctactaaaaatacaaaaattagccaggcacggtgcgttggcccaa

SEQ ID NO: 665523 - DNA, 298 bp, Homo sapiens
ttagatagggacaacagagggatatgctgtcgagatgtaatacttggcctagcttgacataagcgggggttgcagtgctggtggtctattccttggacactacgcacttaaataatacatgttagtgctatggaaactactaacactaggaatactactagaagctacgcagtgccagtattacatggaataatacatgctatggagacttctcaaaactcaggagctattgaaactgcgtaacacctaggtgcctcattgcaccttctaaaactatggggtcaccggagctcgaatt

SEQ ID NO: 665524 - DNA, 141 bp, Homo sapiens
caaccgaccggcctgtcttaatcattttaagtgtacagtcagaggcataagtacattacagtcttgtgaggcgcacaacatccatctccagaactcttttctctcacaaaactgaaacactgtccccattaaacactaatt

SEQ ID NO: 665525 - DNA, 1464 bp, Homo sapiens
ggttgtaccccctttcactttgtcaagttcgtatttattcccctttatgtttgcagagggggtagaggcagagtcacgggctggtcagagggtctgctcccatggaacagagagagaaggacggtgatagcagcatggctgctgtgtggcacagtgctgggcatactgtggagtgaggccgatacctcgggagtgacgtgggtgccaagtggcgtgccctgtacaccgccatcattatgcatgtgcgtactgtcccccacagtcatagagaatagggcccgcgaacatcacagaacgaccgccgcaagatgcagcagggtcaagccacgggagtggcgcgcggacatggtacgcgtaccccacgcagttaataggccccacaatgagcagcggagagtaagagcaagcaaggggtaaaatgtaactcaggcataagtaatggtaagtggcctgggcatttaacagtacagagtgacgaacacatacacatggtccgcattaagttcggaagagaaaaaacaagggagagcgaagagcaaaataaaacgacagtgagaaatacagagagcccaggacaacgccgaaccaaacaaagaagaggaaacacagggagacgaaggaaaaggacttcagaccaaatagaccagataatcccaggaagggcaacacaatagaggataaatccacacaggggtggagtagtacacagggtgaagtcaaagcaacaccggaaagacgacaaaaagcagagagaagaagaaaagacgaaaaaaccaccgacacgtaagatgaaagaagagagaatatcaaaaggaaacaatagggcacagataagagacgaaaggggagaccggcaacaaggcccaagacaaagagagtcagaaaaaacaaaaacagggaaaaatcgaaaaagccacagaacaaagacaagaaatacataaccagaagagaagagaacaagacaataaccatagacttatccttggagaagaggatggaccaaacacgagggtagcaccaagaagtacataggcacggacaaggtgaggataccacagaagggagcacagaatacagcaagaacagcaagaaatgaaaaatcaatagcaacaagaggaaaacaaaagacaaagactacgacagggcgacgaggagcgatagagagcaacggaagagggccgtacctgcgcagagtacaccaatgtcagactgcgagaaaacacggcagagagcagcagaacacagcgggacggacccaagcgtgacgcacaaagggagaggaaagcaccacagaagcagatggtaccacaagcaaaagactcacaacagcacaaagagaaggaggacgagggacaaggagagaggagaagaaagcaactagaagaaagaagacaagagcagagaaggacgacacaagcagaacagatagaggaacaaggaaatcacagcacgagacacaacggc

SEQ ID NO: 665526 - DNA, 184 bp, Homo sapiens
aaaaaaaaaaaaacccccaaaacataattacccgtgcctggtggcccatgcctgtagtcccagttactccaaagggtgaggcaaaaggattgcttgagcctgggagattgaagctacacccttccggggggtacaataagctgtttgggcccctgcactccagcctgggcaagaccctgtttca

SEQ ID NO: 665527 - DNA, 345 bp, Homo sapiens
tcatctgcggggacttggcgatctcacgaggcgtcgacgtccgctctgcgccctgggatgccttgctggacgaaaggctcatgctgggtaggctgaacgccacttactcgtctactaggtggatggacgcaggccgctctatagtcgcgtagataggatagcatgccagagtactagctcgatgcctcaggtctccatacaaatacatcccacaaccaagaccattcatgcctctgcacacacgaagcctatcctattttttttttcctttgcgaaagcagaagccaggtctctcttctcaaatggttcagcattcccaatcaaaaagtgatgcgtgttaaccta

SEQ ID NO: 665528 - DNA, 362 bp, Homo sapiens
ccggaatccatgaccccgagaggtgccacgaccaatgagcttgaaagaaagtggtccataaattgagttcccgacacgcacttgggaaagacactatggaaaggcttgcccactctatttatcctctccactgaatgttttcgttatgaaaagttaaaatgctgaagaagccccagtttgaaattgggaaagctcactggagcttcactggtgaaggcacgtagtttctggagaaagccacctggggaacgagaaccaggtgctaaaagttgaacgagctgatggatatgaaccccccgtcccagaatctgttttaagttcagacttccaatagtggccaatctaaaagtgctatttgtgga

SEQ ID NO: 665529 - DNA, 914 bp, Homo sapiens
ggttgttgacaccaacatggagacttggtaccgtgtcccgtacttagtgctcgaatgtcccaatctgaagctgaagaagccgccctgtttgcgcatgcctgtcggccatgaatgtgtagtgctctggtggtggtgtcttatttccctcatcaccgggagagatataagttgtatgatgttagtgtgtttgataccctccaagtgtcggttctatgactgattgaatatggccctcacggaggccagtagctttctttggcctacagagtaaatggacaatatattatggaaggacttgcatccagcttcctatttacaatgggaggttaggtttcataatcctggaccgatcgaatgcaccaaatatcccaaaatcaatagattccttcttctgttcatgtggattcgtctgtgtcctattgagttttttcatggtagagtattcatgagaatgaaatgcggggtatctgatgggttagagtgctttgagaagaaatcagggatactggatttgctcctgtcaatgagtttaaagggttgtaccaatcctctaatatgaaatgttgcgcaacagattggagacgcggggtaagggaattttttcgtcgaacaaacacggaggggtttggaagctgggcaagaatttcctggggttaagagggcaggtttttaccgaagatttttccgcggggaatgggtaatcacgcaggtgggggggaggcttaggtgagacaagaatttcacttagataagtatcatacggtgtgttgagccccatttgggcagagtcgtggtgctaaataaaaacccgagggacgagaaggatcagtgtgcttcagggagaaatattattttagtagggagtgaaaaaagcgacagcaggtgtggtatgtatcatttctagtatatatagg

SEQ ID NO: 665530 - DNA, 123 bp, Homo sapiens
atggggagtcgaaatgacgtgcagtgctttccccaaagagtccagaggcacttgtgccaaaaatagacgcagtgagtgagtgtgtgtgtgtgtgtgtgtgtgtgtgtcgcagcaggaggagga

SEQ ID NO: 665531 - DNA, 478 bp, Homo sapiens
  misc_feature (27)..(27): n is a, c, g, or t
  misc_feature (69)..(69): n is a, c, g, or t
  misc_feature (91)..(91): n is a, c, g, or t
  misc_feature (132)..(132): n is a, c, g, or t
  misc_feature (260)..(260): n is a, c, g, or t
  misc_feature (443)..(443): n is a, c, g, or t
agctcgcaccccggccccatgcacagntgctgctgatatatagaactttttagggtttcacagaccacnaatacaggcgttagcttagagnctggtcacagaagagaatgcgatgaacaccgccctgccagngtgaggacggaggggctgatgtgtttgtgcccccccaccacccccccatatacaaaggccatctctagggcagaaatctctcaacagctcaagcccatcctcgctgccccctccacgaaacgacacanctcaagcttggcgctgggaagttttcccgatgctgggttgattcctgatcacccaactggacagggccctctccaggacctcccaggttctccctggtaccttccctccctcaggaggaggcagcactgtctctgaagccaccaacgagtaatgctagaagaatcagaagaaggaagtttctnatgaaaaggcaccttcaagtctaaaggcctctttg

SEQ ID NO: 665532 - DNA, 836 bp, Homo sapiens
aagtctcagaaccagaagcaatgtgaactcttaagaggttcttccttgtaaaatgagaccgatgatttgggcgagccgtctttgctgccatcttcctcatcataagtgtggaacataggcattgctttgaatctggatagaaaggacacatctgcacctgccccctttattttaaatctttggggaaagatgagtaactttccccactactctgccttcctgttcagtaactcttacttttgcctgaagtaacagcatcttctacttctccatctagagatttcgtgtgtgtgccatcaaggttagcaaacttcatacgtagcctaacacttaaaaaatgcactcattatcttaaaacctaataaattccacgagtttcaattgtggttctcctctggttgcccttcctaaaaaatgagctgaacgatgacagctattttctctttacatgcttgggttatgactatcttaaacgttcttattctaacactaaactgttgaagcctcaaggtattacagaagcgctcgcaccaggcccattggtctcctgggtcccggacaacctgtccatataccacatttgctgacctgtgctccctgcactccactcacacgttgaaagctcaaactacgtcttgaaaggggaatcagccttcagcgatccgcacggaaccccacgagaaggccccgaacttgcacagcgtcctgtacaatacacgactactgcagagtgtccataacctctctgccatgaatacttccttgcgcaacctgcatttggctacacaacgtgtcagacacacgatccgccaacacttgccctctgtcaaacctcc

SEQ ID NO: 665533 - DNA, 587 bp, Homo sapiens
  misc_feature (446)..(446): n is a, c, g, or t
gggccaaaagggcgcttgagacagagccagcaggcgagcgggccgcccaggtccctggccccctgctgccagtatgaaggtcccaccaagcctctgctccaaccaggggaaccgtcatggttgggaacagccaaggtgaggaattctgtgggtcacaccccctgaaaaccactggcctccgccgggcgcggtggctcacgcttgttgtcccaacactttgggaggcccaggcgggtggatcacgaggtcaggagttcaagaccagcctggccaagatggtgaaaccccgtctctactaagaaaaatacaaataattagcagtggcagcacctgtcatccaggctgcttgggaggctgaggctgggagaatcacgtgaacccagcgggggcagaggttgcggtgagccgggattgcgccagtgcagctccagcctgggcgagcaganttgagactccttctcaaaaaaaaaaaaaaaatgggcacacgggaacacctggagacaaacacgggacaaagggaaccaggagacacaggagacaaagagacaaggagaacaccagacaaaccggagacaaaagcccaacca

SEQ ID NO: 665534 - DNA, 325 bp, Homo sapiens
  misc_feature (9)..(9): n is a, c, g, or t
  misc_feature (134)..(134): n is a, c, g, or t
  misc_feature (145)..(145): n is a, c, g, or t
  misc_feature (157)..(157): n is a, c, g, or t
  misc_feature (187)..(187): n is a, c, g, or t
  misc_feature (282)..(282): n is a, c, g, or t
  misc_feature (285)..(285): n is a, c, g, or t
ttggtcatnctcatgaacagattagaagaatggagctattacacaaaggaactaggcttgattctaagatgttacataaaatatatgctgcgaaatgtgacagcatgagtcgtacatcagattagtagattttncgttttctttnagactgtctatntgtgccaattctgatcttttcatttgctgnatcctgctgtctcccatctatgagaactgaagaccgcagccgtgaagaatgatgatgtgccaagatttcattttttctatgttctcatgtatctnttncgccctctttggtacctaacattttacggtaagtaacgcc

SEQ ID NO: 665535 - DNA, 314 bp, Homo sapiens
atccggtgccgttgcaggatctcgaacaccgattgacgaggcccggcggcgaatcgacgcatagccacggtcgtaagttgggtccccgaggcaaccagtgctcgctcgagggtgtccatgctcgtgctaccaccggtgcccatgatgagtcgtgatgtgagctttagaccaccgatgtgcagcggttcgtcggaagacgtcgccgcctttctatcacagctcactattgtttcctccacgttcgtcacgtctgtttcttccgtcatcatccgccttgtaccgccgtcacgactcgatgactcctcgcaccgggg

SEQ ID NO: 665536 - DNA, 348 bp, Homo sapiens
  misc_feature (348)..(348): n is a, c, g, or t
cgcagatctatcgactgaggcaccatgtgcacgccgcgtggggtgcgcctgagcgcggaagcccgcacacaggtggaggtgcttaggcggaatcttttccaggaggctgtggaattcctctacagaatcttgccacagttgactttccttcgggccccactggacattcccattccagacaccttcacccaaggatgatgagaaggaaacacgataagccggagaagaaagaagtccctaagtgtggatttcttcctgtgaatgagaaagtcctgtgcctgtttggcctgtgtaagccacaagtctggactcttagagtgcgttctgtggagtacatggattccaccn

SEQ ID NO: 665537 - DNA, 692 bp, Homo sapiens
  misc_feature (215)..(215): n is a, c, g, or t
gggccccgagcacccgtggattcgagcaaccttcaattcaggctttttggcgagggtccgtaccgatgccgctaacgctggccttgtaattatccctgggatcgaactattatgcaagggtgaggctatcctcgatcaaggtgctaggggtgattccgcaccttaagcgaatggagcatcaccatgaggggtgtgacatattgtcaccggtaccnccagcagtagatgccagggtcctaagttgataatgatgtcgatgaggggcgggggacactgagcttgatctttgtgagcagtgatcattgttctacggcgaaatacagtgtttgcatttgatcatggaaaagtgatgcggtttcaaaaggccgtttgttgagaataccgatatgtttaaaaatacaattgaacagattttattcttcgcttcccgtcagtgacctttagaaaaacagttgtgctatcgttctaaaatgaagtcgttccatcataatctatgatcttgtacagcacctatagagttaacctgttcttatggagttggaatacccagtacaatgttgaaaaaggatggaggctttcttcatatccactgtttctaaagccctatgtgtccgctgttgtgtgaagattgacatttaccatgattttccttagtcctgcaggacatagagagttatcaaagcctgccccat

SEQ ID NO: 665538 - DNA, 402 bp, Homo sapiens
aaagtatcacatcacctctggctgacaaaaacacacctgacttcatctatggggtatataatacaatgatctgagatattagaagtgtaactaggtcacgcctgtaatcctagcacttatgtggaagctgaggagggcggatcatgaggtcaagagatcgagaacatcctggccaatatggtgaaaccccatcactactaagaatacaaaatattagctgggtgtgatggtgcgtgcctatagtcacagctacttgggaagctgaggcaggagaatcacttgaacccaggaattggaggtgacagtgagtaatcattgtgccactgcattgcagtctgagagtgagtgaagcagaaagaaggaaaatcatatgatcatctcaatagattgcagaaaaagcat

SEQ ID NO: 665539 - DNA, 639 bp, Homo sapiens
acaccctgcgacctgtccagactgcaagatgaatagcatatgtcgtagagtcccacataagagcttctttctatcagccgtctccgaagttgcacgtgtcagccatggttatacatcgcgtccactgctcatctgacagcatcatttacaggttcacactgttccacttgagtcttcatactatgctcgcaatatggtccgatcagtaaatagttctctcagcattcatcggctgttgtgttggcctttgtgtgactcacagtatagatgcctgcatctatcttggtcacgtcccgagcaacttcaaagagcagtatctcctccacagaaagctcctaaacttcccactgcggaagcccgcgcaggcatgttacagagagggatcggcctcgaagcattcttcttacggtcctccgagactcctttaaactcctgtatcaattagcagtagtctcagcagaagagaactcacaggctcaacagttagagttggtagagtcaccaggctttggtagcgtctcgtgggaatgagctagtagcatgaaatcttatgtgcatcccacagaattcgtggtggaagcagtatttcctcctcctctttctcgtcgctctgggcaggtactgcgagaacggtatcag

SEQ ID NO: 665540 - DNA, 255 bp, Homo sapiens
tgaacatacaagatttatctcactattgtggatactgcacttggcatgaccaatgactgacttgatcaataacctaggtactatcgccaagtctgtgaccacagcgttcaaggaagctttgcaggctggtgcagatatctctatgattgggcagtacggtagagaataaaatactagcatatttggttgctgagaaagtaactgtgattcacaaacgtcacgatgatgagcagtaagcatgggagtcccccagca

SEQ ID NO: 665541 - DNA, 178 bp, Homo sapiens
ttaccccacacgcaacttgggcctgttgggggaacgggggagggagagcatcaggataaataactaatgcgtgcagggtttaatacctaggtgatgggttgataggtgcagcaaaccaccatggcacacatttacctatgtaacaaacctgcatgttctgcgcatgccaagttgcgtg

SEQ ID NO: 665542 - DNA, 933 bp, Homo sapiens
  misc_feature (181)..(181): n is a, c, g, or t
  misc_feature (232)..(232): n is a, c, g, or t
  misc_feature (933)..(933): n is a, c, g, or t
agaccgagcgaaactcgctgctgagttacgaggacgctgggacctggagattggagagagctgagctggcactatgaagtattgactacagcttaataagtagagctggttgctctcgggatatagaatagagacatggtagctggtagggaaagtcagtctggcacaagatcgtcgaggngactctggtgatgctcaaggttctcattgacctttatgtaggtaggaactngcagacataccgatgagagtatattctaccaggctgctggatagagagaagggtagaagggcagaaatagggagatgttagtattcttagtaatgtaactgtaggtgtagtctgatacatcaggatttggtttagctgactcgaggatcctgcagattcgaagagacttcggaagttgagtgtccttgtcactactttctggactacaagaggcatttgcttcctgcgatgacgaagaataaccatggccatatgtcactggggcttcggcagctggacatgtctcggaccccttcggactggtgtactgtgccagcagtttgccgatgtcggattcagtaaaatctcgagagatggacgtggttcgcttacaagtcaccggagtcagaacaactgtctgggtcccactgcggtacacggcgtctcaaatccgtcccgttgggaccatctggaaccgcggactggtaccgggcgctggagacgctgagcgaatgcgtacctcccgatagcggacgcctagtcacccgacggacacgcacatgcgtaggatcggctttttgacgaacagccgcatcctgctaatgctgcttcttcttctccctctctcctctcctctcccccacttccatcactcacccaacccgctcacacaacggcacccacaagggcacaaaccgcaacgcaacacgcaagcgcaccan

SEQ ID NO: 665543 - DNA, 136 bp, Homo sapiens
gtcgacgacagtctacagatctgtccaatctccataaatatgagattgacaagacagagtgcttcttctggaggaaaaagaagtagaattaaaacaaaaaaaaaaaggaggaggggggaggggggagtaggaagaa

SEQ ID NO: 665544 - DNA, 790 bp, Homo sapiens
tgcgctagcaccgttaatgatccagcctctgaggcgcattccaaccttccagcctgcgaactgaggagaaaaaaaattgctagattatcatagccccattacatacctatgaggcagagcaaaaaaattaaattttaaccatgagggaaatcgtgcacatccaggcatggtcagatgtggcaaccagatcggattgccaagttctgggaggtgatcagatgatgaacatggcagtcgaccccaccggacacctaccacggggacagaagaactgcagactggaccgcatcatctgatgtactacaatgaagccacaggtggcaaatatgtatcctcgatgaccatcctggtggatctagaacctgggaccatggactctgttcgctcaggtcctttaggaccagatctttagacacagaacaacattagtatttaggtccagtcatggggcaggtaacaacatgggccaaaaggccactacacagagggcgccgagcatggatgattctgtcctggatgtaggtacggaaggaggcagaagagcaagtgacttgcctgcagggcttccaagctgacccacatcacatgggacggagggcacaagagactctggacatgggcactcatcactatatccagcaagatccgagaaaagaaataaccctgattacgctcatgacataccttcaatgtggatgccatacacacaaaagttgtatgacacgggtagaaccctaacaatgcaacctctccaccatcaaggaaaacttgatgaactaatgatgacaca

SEQ ID NO: 665545 - DNA, 291 bp, Homo sapiens
cgaggtaggagagggggcatacctggaccctgcaagcatgcccaccactgccacaaactgccgcaccagtgtcttgtatgcagcgccttcctcgatgaagccaacatgagcagtaagctgcagcaagcgcggagttgtggaatgatgacaatggagggtcacctgtgtgtgccgggatcggcagattggctccaaagagcgcatgagatatgtggggaacctagggtgaaggcaccttttggcaagtgtggtaggagtgctatggaccattgccatgagtggaagtctcag

SEQ ID NO: 665546 - DNA, 1468 bp, Homo sapiens
  misc_feature (1468)..(1468): n is a, c, g, or t
gccagccatatcttggctggtacctctctaatattcctatgagtcccaagattgggatcataacttacctatcggctttgccctgctctggatatctgtcactgctggcctgatccgcatcactgatctcgtgccatgccttgatccttacttacaatgctcgccgtatctcttccaatgatcatatcgagccatgatagtattaaatggtagggcggtctcgggtacgagtgtcttgagcctgctgtttcaggctcattgcttatatttcattaggccgtaaagtcagtgttcagagtagcgggaatagcgtattgataatctagcctagttgagtagtcgtctcgtgttgaatagtccactactggacgaatccaagggcatatcatacttgactgttgagcgtaatccactctcattggcctcccaaggatcgtttcttgaagcatcatttcttattgcaagagaggaagcaataagcatatcaccaggggtgtaccttacttcaggtggctgaggatccttgtccgtcgttgtgccattgaatacgttccgtctagccttgagtttgttgcgtgttgcaatattctaagacacgtcgttgtgtccctcctacccatacaaacacttggagagggtgaaacaccccaacaactattccgagttgccccccatttcaccggacccatattacccccagcatgacaaactgtatccgaacagccagacctcaccatgttcatcgcgggttggtaatcacatgtgcacttgtgcgtagtcacaagtaggatgcagcaaagcgctttatgaggtcaagacacataaacaaatcattcaagcggatgaagtagttataaacttgacaccaatcatatcaaacacctagacagagccaatacaatgcgtgcggaaaacaaaacgccctcggcaaagaccacatggcacatggggggaggtcaacgtcacattgccaaatgaacaaagaaggaacagacagtacatgaagacccaagacagtccatcactacccgtagaattcaaggagcagagaacaagcaaactcacgacagggaacaaaatgacaccgcacaccacaacggccacccaaaaaggccccagaaacaacacacggcccaaaaaaacaaaaccacacgcacaccagcaacccacagcacatacccaacaggaaaaacgctaaaaggcaagaaaacgcaaaagaaaaacactaacccacacctcttgtcttctttatttatttttctctttaccacagccataaacacacacatcgcacacaaataatacaacactaacaccgcaaccagacaacatccaacacacaacgatcgtcactcaaacaagatgacaacaactaacacactacgtaaaaacattatacaaataaaactataaaaacaaaaaaaacagaagcagcaatgcacacccttcccacacactataagagatn

SEQ ID NO: 665547 - DNA, 132 bp, Homo sapiens
ctgaaccatctacgagagcagaggctgcgaaggagtcacggggcgcgcatgccagtgaagactacaaggtgcggattgatgagtacgaggactccaagcccatccaggggccacagaagaagccctttgagg

SEQ ID NO: 665548 - DNA, 1067 bp, Homo sapiens
ggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgcagctgcggaatggcctgcgcagcactcgagctgggacctcgaggacctggaagagaccactcggtactagtggaacgccaacccaggcaagttcaagctcccagccggggacctgcaggacagaaaggtgttcgtggagcggatgcgagaggcagtccagcgaaatgaagcgaccatactgcgtcagcccaaacagccgctaccatccttcgcgcagacggaactaacacgagagactagctcgcaaggcaagccagctgccccagaagctcacccaagcgacctgctggatgccagcgcagctctcgcgcccacatctcgcctacatcgcacggcagcagccaggccacacagcagctgcatcatggcatgacacaggcatccaacagctggaggactgggctgtctgggacgcatccaggttctgaagcacatgtccggccgcgttggagcacacagcctggacgaagccagggcatcatgctgcgatgccttcgcccaagcagatggaccacacccagtctcgcatggacggcggtctcagggaagttggccaaagtattccacaatgacgaactgaccgccgacagtggctgtgccatcgccgagccagctggggtgccaccctcgatctcactctaccatctctctctgaacccagccctccccgggcaggctggaccccataagccggggaagcaccaaagcactctgtgacctagcctgccccccaagagggaagaggggccccacgcacacacggccaacgatgaggtccccagggagagacacccgagccgtccccaaaccacgcgggcaccaggaacaccgcgcagaacacccagagggcgcagcgacagagcgtagacgaagcagagcacgagcatcgccctagccaaacaccggtcgacag

SEQ ID NO: 665549 - DNA, 335 bp, Homo sapiens
  misc_feature (42)..(42): n is a, c, g, or t
tgagcagcaggaagagaaattggaagatcaaaggaaagcatnaaaaatgatcacaggccaggcgtggtggctcacacctgtaatcccagcatttggggaggccaaggcaggtggatcacttgaggctaggagttcgagtccagcctggccaacatggtgagaccctgtctctaataaaaatacaaaaaattagccaggcgtggtgcatgcgcctgtagtcgcagctactcaggaggctgaggcaggagaatcgcttgaacccgggagatggaggctgcagtgagccaaaatcacgccactgcactccagcctgggtgacagagcaagactgtctt

SEQ ID NO: 665550 - DNA, 375 bp, Homo sapiens
ggccttagctgtttcctgaggtaaaaacaacgtctagcaaatccttgttgatcattaaaggggtttcgtgggaggaaaacccgtgcgtcatttcttaaaaaactgagagcttgattggtgaggtaaccagcccagcagtatggatgagttccaaatagagcctatccagatctgttgattctcagcactgtgaccaggttgcagtttatgagctatccagtaaatcaataatatcattttatacaaaatatcataatttattttcacatgatcttattacttcagatcacctttgaactatttatatccaaatagcctatttgattttgttattgaaatataattcatttactataaaatttatcattttaaagc

SEQ ID NO: 665551 - DNA, 660 bp, Homo sapiens
  misc_feature (276)..(276): n is a, c, g, or t
  misc_feature (449)..(449): n is a, c, g, or t
  misc_feature (487)..(487): n is a, c, g, or t
  misc_feature (584)..(584): n is a, c, g, or t
  misc_feature (602)..(602): n is a, c, g, or t
  misc_feature (641)..(641): n is a, c, g, or t
  misc_feature (656)..(656): n is a, c, g, or t
gtagagacggggttttgccatgttggccaggctggtctcgaactcctgacctcaatcaagtgattcacccgcctcagcctcccaaagtgctgggattacaggcgtgagccaccgcgtccagccatacatgtacattttcagggttcaagtgaacatacagtttcctttataagtatgtaaataaatttcatagcactacaaaaatacaagtcatctgagaagtttacagtggtcccagtactgtaggagagaattaaataaaataaaatagctgtngattatttaaagctaattagattaatcaagttacagtatcatccttcagattaaagtgctctgatataaccaatgccacagcaaacgaaatcctggaaagagattgcactgccaatgattttgtctcttaacctcaatgttaccaggactacattaaaaaaaatcctgatttnataactgctatcatcttcccccccaccacccttttagnctgtgatattcttcccctggaaagattcaagattagattaagattctatcatagcccggggaaaaaaattaggaaattcccggaaaccttctaattncagtctttaagttaggtnacaaccaaaatttacctgaaaaaactcagcctgggggcnttttagctagaaggnaacc

SEQ ID NO: 665552 - DNA, 261 bp, Homo sapiens
tcccagctacgcagcgactctcccagctactcacccacctctcccagctactcgcccacctctcccagctactcgcccacctcccccgagcgtactcacccactgtcccctagcctactcgcccgacgttcccctagctacgacgccaccgtctcccagtctactcggccgacgtctcccatgctactcgccaacttcacccacgctattcgcccacttctcccagtctactcacctacctgggcttagggtctacctgga

SEQ ID NO: 665553 - DNA, 144 bp, Homo sapiens
tctccaagatctcactgactacatcagtgcgcaaatgtctaatcgaacatgtttcagaagctgagaatacacatgaatttactattttggtgaccctaaaacagacccatttaaaatccaggagtaattctctcaaattcacca

SEQ ID NO: 665554 - DNA, 215 bp, Homo sapiens
  misc_feature (110)..(110): n is a, c, g, or t
aattcggcactagggcgaccgcagcttcagccagaagtccaacctcatcacccaccgcaagagccacatccgggtgatgaggttggacttctgctgaaggcatttgcgcnagtcggggcagacgtagggcttctcgccggtgtggatgcgccggtgccgcgccagtagggtttgtggcggaagtgcttgcgtcagtcgggacacacgaagggccg

SEQ ID NO: 665555 - DNA, 247 bp, Homo sapiens
ggttttttttagggattttagtcagggttttccccggggccgggccaaaaacgggggttggccgcttgcttccccgctcctcctggcccagccctttggtgtccccccctgcccccaaagaatgttaaccccgtggggtttgcccccgcccggccccaaagttgccagactcccgcccccctgtttcctcctgcctgggggggccctggggatggaagggggtgggattaaacctttccccctggga

SEQ ID NO: 665556 - DNA, 1109 bp, Homo sapiens
gagtgcccaagttgactcatccttactcactcattccctcaaaatatttattgagcaccaacaatgtcacaagcactgtgctaaacactgtggtgaagtagaacaattgctaatcatttcctgggttccacttactcttgatttaaaaaaaaaaaacaacaaaagagtttgtgtgtggccaggactaaacagctgcttcttaatttgtggaattttaaaactaatctatttgatttcaaacacaaaatcaagtacttgggaagtgaataaagtaagagatagcctgtctcactttccagaggtcagcagtcactaatactgtggtgagtgattttactcaaaggacatcacactattcaagcagctgggtttggacatgtaatgtcggggtcatcttttcatgtcaatacatagattaatctttatttcaaactgtctacctaaaatatcactacccacataacctatacatcggtgtggccagaactttatggaacactaaactgttaaagtgtcttatggctaacaaggtcacagtgaaccttgatatattcattaaatccttttcctcatgtatcttggcactcttgtgctagtatgtctaatagggtgaatacattcctaacatttcttgatccaagctaggtccaagttacattcattctcaatctggggtacactatccataagagttgtcaattaacaggttggacccacgtttacaataccacccatcagtgtatgtgacgccttaattgcaagtgtatgacagggactttgtctagcacaaaggttctatagaatacagggatatcaatgagaattgtcactgcgaaaattacactttatgtaacaagtacaaaacccggaaatctaacccaacaggaagacaatcccgatgaagagagcaagaggaacgagtgataagggcgacacgcggaaaaaatagagattcgtaaaaataacaagccatgcccacatcgatgtgggagaggacaaaactagaataggagcgaacgacaaagcagcgatgcgcggcagcatccgaaagatacggaactctcgaacatgccgcagcatgtggcaacctgccctccgcaactccccga

SEQ ID NO: 665557 - DNA, 3745 bp, Homo sapiens
cttgaaccaggcagaggttgcagtgagccaagattgcgccactgcaccccagcctgggcaatagagcgagactccacctcaaaaaaaaaaaaaaaatcagttctaactctattttcctcagtgtggcttctagaatattctccagctcacaaccagctaggctgcatttctgttgcacaactgcagtcaaaagcaggagccggcagacagagagtattttcagctttgccagttctggcatctgtcacaagtaacccactaccgcacgccaaccccatccacactgcaccgcccacctgacgtggctcacacgctgtccccaccaacaaacgcctggttcaaggcccctctcgaggcacccagcagcctatgcagcccaatgtggcgtcggggatgtgatgtcacagacagggatatgctgaggacgcgtcaggcaggcactggagcagctcacctgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 665558 - DNA, 4000 bp, Homo sapiens
cgaagccgagcctccgtggacctagattggccccattacattccaccctgggcgaaccagatgcgagactccgttctcctaacccttcacctgtaaccagataattcgaccagtaattacctggagaagtttcgacacgttcactcttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgacttggagaagacctcacaggagaaaaccaggatggccaggatggcaacttgccactaccaattgttcgctgtttaaactgtgaaccatggaaatgtgaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 665559 - DNA, 3643 bp, Homo sapiens
  misc_feature (379)..(379): n is a, c, g, or t
  misc_feature (396)..(396): n is a, c, g, or t
  misc_feature (399)..(399): n is a, c, g, or t
  misc_feature (415)..(415): n is a, c, g, or t
  misc_feature (426)..(426): n is a, c, g, or t
  misc_feature (441)..(442): n is a, c, g, or t
cgtgttctgcaggtggggctgcgttaggtgtggtgtgtttgtcgtgttgcttgtgtttcgatattgtgggtttggtgtgctgttgtgtgtgtggtgttgtgggaccgtagttcgcgtgtgtgccggcgcactggttgttattgtgtttcggggcaggtcctgtgggcggtccgacggtcttgtgccggtgtttgtcgtctggtcggtgtccgtcggtgttccgggcgtgtgatgtgggttacacggggccactgtcggcgtggaggtgtgtgatggtggtgtcagctagttgtgtaccttccgagacgcgtgttctcacgtccgcgccagagtcctcagggggccgttcgacctgcgtgggcgtcacaggagtgcgagnggccccagcttccaggncgnccgatggagcctcacncgtcaccttcnccatcacgctttcanncacgtggacttcgtctgcctggacggtgacagctgctgactggccgcatatgtgctggtgatccttccagtccttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcgggtaagatggcggccccgcggcgagggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 665560 - DNA, 119 bp, Homo sapiens
tggtcccgtagtcagtgatgagatatatatatcaatagatagatagataaaattgctcttatatagcccatttattcatcattggccctgttggcccatcctcagtgtggctgtgagat

SEQ ID NO: 665561 - DNA, 4401 bp, Homo sapiens
  misc_feature (379)..(379): n is a, c, g, or t
  misc_feature (396)..(396): n is a, c, g, or t
  misc_feature (399)..(399): n is a, c, g, or t
  misc_feature (415)..(415): n is a, c, g, or t
  misc_feature (426)..(426): n is a, c, g, or t
  misc_feature (441)..(442): n is a, c, g, or t
cgtgttctgcaggtggggctgcgttaggtgtggtgtgtttgtcgtgttgcttgtgtttcgatattgtgggtttggtgtgctgttgtgtgtgtggtgttgtgggaccgtagttcgcgtgtgtgccggcgcactggttgttattgtgtttcggggcaggtcctgtgggcggtccgacggtcttgtgccggtgtttgtcgtctggtcggtgtccgtcggtgttccgggcgtgtgatgtgggttacacggggccactgtcggcgtggaggtgtgtgatggtggtgtcagctagttgtgtaccttccgagacgcgtgttctcacgtccgcgccagagtcctcagggggccgttcgacctgcgtgggcgtcacaggagtgcgagnggccccagcttccaggncgnccgatggagcctcacncgtcaccttcnccatcacgctttcanncacgtggacttcgtctgcctggacggtgacagctgctgactggccgcatatgtgctggtgatccttccagtccttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcgggtaagatggcggccccgcggcgagggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctgaaaaaaaaagaaaaaaaaaagaaagacaaaaacacaacgaacgaaacacagaaagacaccacgaagacaagacaagcaaccagcggcaaacacacgtaggggggggggagcggcgccgccgcagagcgaggggcgcagacagcgaaagaggggggggggcgacgcgaccgcagagagagaaccaaccgagcggaaacaccgtgagctaccaacgagacaacgcgcgggacagaagaagcggcggcaggggtcaccgcccagagcaagaaacacccccggcgggaataaaaagacagcggtgaaaaaacaaaaacaccagagagcgggaagatcgacggaggagacaagacagaggcgcacgaataaagaaaacaaagcgaagccagcacagagaagagagagacaaagacaacacaacacacgacaccccccaccacgcagggggtagaacaaacgaccaaacgacaacaacacgacagcacacacaagccggcaaaaggagaaaaaggcgagggaaggaagaagccgaacagcacaaccaggggagagcgcacacgcacacgggaaaagcacagaagacaaacagacaggcggacggaggacggacgcagggcgcagcgcgaggggcaggcaggcagcgacagggcagggaaagcacgagacagagagacagagaggacggtgggggggggacggagaagtagaaggaaggaaacgagaaagcaccacaggggagaagagagagagggacaggcggc

SEQ ID NO: 665562 - DNA, 650 bp, Homo sapiens
ccgatggcgcaggcctgtattaggaaagattggacataatctagcagttacaggaatcgagatggagtgcttgggcaaggacatgaagagcaagatactgttggacatctgtagctggtcactgacgaagaagggattagcgaccattgccagcaagatagtagactctatagaactcgcacgagtagagataatgccagggcagactcagacacgagtcattagattgaatgagatcataatattatgttcttagaggcgtcaacgttgttcacgttctaataggagacaaaggctgaacaaagaagggcgtactattctagctacacatgaacatggtcatggtgtactatagcttcgcacgcatagacatcgtcggattactgatcggcgttcctgccatgaggactttagagtagcaggcagttactgttctgtagtgtaggcattagacatgaatcaaagtagagacattgcttctacaattagcctgaaagggtactatagtggcatgtacagagtcagatcgctaggatataggagtggagttaactaggcatgtatcttgaagactgcataactatgtacacacctaggtagagagggccggtgctgagttaggatactatacgacgctctttaacggccct

SEQ ID NO: 665563 - DNA, 3335 bp, Homo sapiens
  misc_feature (379)..(379): n is a, c, g, or t
  misc_feature (396)..(396): n is a, c, g, or t
  misc_feature (399)..(399): n is a, c, g, or t
  misc_feature (415)..(415): n is a, c, g, or t
  misc_feature (426)..(426): n is a, c, g, or t
  misc_feature (441)..(442): n is a, c, g, or t
  misc_feature (2942)..(2942): n is a, c, g, or t
  misc_feature (2960)..(2960): n is a, c, g, or t
  misc_feature (2988)..(2988): n is a, c, g, or t
  misc_feature (3077)..(3077): n is a, c, g, or t
  misc_feature (3112)..(3112): n is a, c, g, or t
  misc_feature (3119)..(3119): n is a, c, g, or t
  misc_feature (3123)..(3123): n is a, c, g, or t
cgtgttctgcaggtggggctgcgttaggtgtggtgtgtttgtcgtgttgcttgtgtttcgatattgtgggtttggtgtgctgttgtgtgtgtggtgttgtgggaccgtagttcgcgtgtgtgccggcgcactggttgttattgtgtttcggggcaggtcctgtgggcggtccgacggtcttgtgccggtgtttgtcgtctggtcggtgtccgtcggtgttccgggcgtgtgatgtgggttacacggggccactgtcggcgtggaggtgtgtgatggtggtgtcagctagttgtgtaccttccgagacgcgtgttctcacgtccgcgccagagtcctcagggggccgttcgacctgcgtgggcgtcacaggagtgcgagnggccccagcttccaggncgnccgatggagcctcacncgtcaccttcnccatcacgctttcanncacgtggacttcgtctgcctggacggtgacagctgctgactggccgcatatgtgctggtgatccttccagtccttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcgggtaagatggcggccccgcggcgaggtgagctcgggcggggtgggggcttccgggcttgcngcggcgggcgcggcgttnccctgtggtgacaatccggttccgcttncggtgcgctcacggggccgtgccaccgtctctacgtgagcgagacagctccgtcaccccatcgagaagcgcggcctggcctggcctggntggcgggcgtcctgcaccccgaagagctcccccgngcgcggncgcntggcccgggcagggtgggtgcggagcggtctgggggccccgtccccggcggtcttgtccgcgcgtgttttgtgaagacccgtggcggaatgggcgcggttcggtagctggactctggcaaagaaatcgggggccggtgctcagcgtctgctgaagattcgtcggaggggaggacaccacgtaatggcactaaggccttgtgtgggtcacaac

SEQ ID NO: 665564 - DNA, 3757 bp, Homo sapiens
  misc_feature (379)..(379): n is a, c, g, or t
  misc_feature (396)..(396): n is a, c, g, or t
  misc_feature (399)..(399): n is a, c, g, or t
  misc_feature (415)..(415): n is a, c, g, or t
  misc_feature (426)..(426): n is a, c, g, or t
  misc_feature (441)..(442): n is a, c, g, or t
cgtgttctgcaggtggggctgcgttaggtgtggtgtgtttgtcgtgttgcttgtgtttcgatattgtgggtttggtgtgctgttgtgtgtgtggtgttgtgggaccgtagttcgcgtgtgtgccggcgcactggttgttattgtgtttcggggcaggtcctgtgggcggtccgacggtcttgtgccggtgtttgtcgtctggtcggtgtccgtcggtgttccgggcgtgtgatgtgggttacacggggccactgtcggcgtggaggtgtgtgatggtggtgtcagctagttgtgtaccttccgagacgcgtgttctcacgtccgcgccagagtcctcagggggccgttcgacctgcgtgggcgtcacaggagtgcgagnggccccagcttccaggncgnccgatggagcctcacncgtcaccttcnccatcacgctttcanncacgtggacttcgtctgcctggacggtgacagctgctgactggccgcatatgtgctggtgatccttccagtccttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcgggtaagatggcggccccgcggcgagggagaggatcctccacagtggtatcctgctgcgtgcccctccaggacagcacccagaggcccgaattgctgctgggcgagagagcactcggcctcaccccacgttttccctaagttctgtctagtaattccactttggagaggggggtgttccttgacagatttagagagttgatgtaacttcctcggatcagttctgctggctccatcccctacctgctcagccctgcacaaagtggctaagcacgccacactgccggctcccaaggcgatggccacctgcctctgtctcggccgctagtggcaggaagatggaaatccctcactttgtccctagattcattttattttattttgttgtttatgtttttttaaggacagagccttcctctcacccaggctggagtgtggcagtcacagctcactgcagcctcagcctcctgaagctctggcatcaggcgggagccactgtgcctggccccatagactcatgttagcataaacaaataggaaatgtacacagctcaggaaatggtactagatacttaagtcccccaaacagaaatatatttctctgaagaactgaaaagtggccgggcgcagtggctcatgcctgtaatcccaacactctgggaggctgaggtggacagatcacttgacaccaggagtttcagaccagcctggccaacatggtgaaaccctgtccctactaaaaatacaaaaaattagctgggcatggttttgcacgcctgtaatcccagctactcaggaggctgaggcagaagaatcacttgaacccaggaggcggaggttgcagtgagccaagattgtgccactgcacagtgtccagtc

SEQ ID NO: 665565 - DNA, 1053 bp, Homo sapiens
gggagaagctgcttcagtgaacacttgtgaagagcagtgaggttgcgcccccagcgctgccgctaaaccccccaaggcaaagcctgtgccccacacagtcctgtgccaatggacgggagcccaccctccctgcagtgatgctgagtggtacttgggggtggacatttcaagggaggaggtgaacgagaaactccgtgtgacactccctgatgtgcacctatccatagtcctgagatgcttctagcacgatccagtgacgacgtacacgctgaccctcaggcacagtgcggggaacaataagcttgatcaaggtcttccaccgacgatgggcactatggcttctcagagccagctcaccttctgctccgttgtggaccctcatcaatcacataccgccacgaagtctctggcccagtacacatgccaagctggacaccacggctcctctacacctgttgtccaatgtaccagcaggaccagattgtcaagggaggacaggcgtggcaggcacgtgggacgaccagagttaagggtctaatcaccaggcaattgaccatggacaagacgcccgccgcagttatgacccaggctttactgacggagtaccacacgggagcctaccccagggcagcctgccgagtgacgggcgtaacgtgtcgaaacttgccggtcctctcacatgcggaccttcattccacggactactttccacaagtaaagcgcctgggccgcacgaacgttcgcacggaccacacgactgctccgcacacggggaacattacccgttgggaagacggcctatacaccggtgcgcattcaccggcgggtccaacaccggaacacgccagcggccgcacttggtgacagcgtccggggaaatctcgctttcgcattggtaacccttcgccggaaggcccggggagcttcctcacgatccccccgtgcacatttgcgacaggaaggaaggccccgcattggacacaccgcgaccgtcgctgcggtagaaaggctttgcggcagtgcgagtcgcacgcattaggcggcagcccccca

SEQ ID NO: 665566 - DNA, 135 bp, Homo sapiens
tggatcacttgaacccaggaatttcaggttgtagtgagctgtgatcacacagctgtgctccagcctggacaacagagtgagacctgtctctcaaaaaacatggaaaaatgtaactacctatatctatatatccac

SEQ ID NO: 665567 - DNA, 478 bp, Homo sapiens
ccagcataactattcttatatcagacaaaacaaactttaaagcaacagtggttaaaggagacaaagagggacagtatacaatggtaaaaggccttgtctaacaggaaaatatcacaattgtgaacatatatgcacctaacactgcagctcccaaatttataaaataattactaatagacctaagaaatgagataacaacacaataatagtgggggcttcaatattacactgacagtactagacaggtcatcaagataggaagtcaacaaagaaacagtggatttaaactataccttggaacaaatggacttaacagatatatacaaaacacttcatccaacaactgcagaatacacattccattcaccagcacatggaatgttctccaagatagaccatatgataggccacaaaatgagcctcaataaatttcagaaaattaaaattattttaagcactctctcagaccacagtggaa

SEQ ID NO: 665568 - DNA, 227 bp, Homo sapiens
gtctagagggatatgaagcaccgccaggtccttggagttttaagctgggggctcgtagtggtctgggcggagcagtttggtggattaaactggtggcaggtttcagggctcaagcatacggggggtatctaattcccatgttggggtcttagctcatggtggtggtccaaatagtgataaagcccactttcggtaagattaatttgggtggtccacactggggtcac

SEQ ID NO: 665569 - DNA, 3183 bp, Homo sapiens
  misc_feature (379)..(379): n is a, c, g, or t
  misc_feature (396)..(396): n is a, c, g, or t
  misc_feature (399)..(399): n is a, c, g, or t
  misc_feature (415)..(415): n is a, c, g, or t
  misc_feature (426)..(426): n is a, c, g, or t
  misc_feature (441)..(442): n is a, c, g, or t
cgtgttctgcaggtggggctgcgttaggtgtggtgtgtttgtcgtgttgcttgtgtttcgatattgtgggtttggtgtgctgttgtgtgtgtggtgttgtgggaccgtagttcgcgtgtgtgccggcgcactggttgttattgtgtttcggggcaggtcctgtgggcggtccgacggtcttgtgccggtgtttgtcgtctggtcggtgtccgtcggtgttccgggcgtgtgatgtgggttacacggggccactgtcggcgtggaggtgtgtgatggtggtgtcagctagttgtgtaccttccgagacgcgtgttctcacgtccgcgccagagtcctcagggggccgttcgacctgcgtgggcgtcacaggagtgcgagnggccccagcttccaggncgnccgatggagcctcacncgtcaccttcnccatcacgctttcanncacgtggacttcgtctgcctggacggtgacagctgctgactggccgcatatgtgctggtgatccttccagtccttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgaaggtggtagccgcggtggctggaagcaatgtgatgttcttgggggagtccttcttcacgggagttgtgggcagttcattctccttcttgcgccttttgtaaggcacaaaaagcctgactgggccacttaaggtcatgtcgtcgcagcaggcagcacaggtgcaagaggcagcgtgagggtttaagatcccatcctggatgaggcactgcaagggtcggcccgcgtagcgaatgcttcttttccagtccttactgctggctcttcctgccatggcctcaaactcggtgggactgtaccagttctccccctgcttgatgcaccgtccccggccgcctgagccgagcctgttcttgtacagagtgccgctgatgttccggcaccgtacgggcagctcactgtcgtacacagaagggtcccagttgtatttagttccacctttttcttggccgggagccagaggggttggaggagactgaggacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcgggtaagatggcggccccgcggcgagggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggtgagtggactgtaacaccgtgaagactctgtcctaagagttgctatcttttccacacctcgtccgagcc

SEQ ID NO: 665570 - DNA, 610 bp, Homo sapiens
tttgttttctgtttgttctgctttgttttttttttttgcatgcttcctttctttttttacgccttttttttttctttgcacaaaaaaggagaagacacttttttttttttacaaacgacagtcctatttttccccccccctgagcacagacgggaaaaaaacctgttctttaaaaaggcccccatcacctggcctagtgaaccaacggttttgggctcccccgagatgcccccacgggggtcttttccaccccccgagaaaggggggggtgtacaaaaaacccttttttttttccccattccagcccccctattacaaaacaaactgtttttgtctacaccccttataaaaaaccggggtttttttataaaaaaaaaaagaaaccgctggccccctaattagctctttttttgggggaaaaagacccagggtttttttacccacgggaaaaaaaaagctgttttttcttgaacagaccctcagacagtgcggcgtactaggcggtgggcgggaaggccctttcgcgcctcccccttttaaatgtaaattttggccgcggggtttttctcttcgaacactcgggggggaggcaggggaccaacctttttcc

SEQ ID NO: 665571 - DNA, 232 bp, Homo sapiens
  misc_feature (51)..(51): n is a, c, g, or t
  misc_feature (77)..(77): n is a, c, g, or t
  misc_feature (120)..(120): n is a, c, g, or t
  misc_feature (164)..(164): n is a, c, g, or t
gaacacagccgcacccgggtctgtgccagcgtggttggagtgcctcctatngctcatgctcctggtgctgcgggacntgggggacggcgctggctgcagaagaaggggagctgccccttncagagcaacacagaggccacagccctggcttgacaacatccttntcaattcggatggtgtcaccctttcggcatctgtcaccagtatccgtagaccacccagactaggtccc

SEQ ID NO: 665572 - DNA, 2935 bp, Homo sapiens
tttttttgcgcacaaaattgtttccctttctgaaacaaagcaaccttatttacaaaaaccaaaaccaccttaacaacaatagctgtcacttttctttaggaaaagcttcatttgtaaatgactctccacagctcccttttccagaaaggtggggcaggggccttgtgagccaaggtgggtcttgcgcactgggcacaggcaccagggtggcctggggttactcggcacaggtcgtgtcttcccatttgttccaaggttacctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggaccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 665573 - DNA, 495 bp, Homo sapiens
  misc_feature (279)..(279): n is a, c, g, or t
  misc_feature (281)..(282): n is a, c, g, or t
  misc_feature (286)..(286): n is a, c, g, or t
  misc_feature (288)..(290): n is a, c, g, or t
  misc_feature (292)..(294): n is a, c, g, or t
  misc_feature (297)..(297): n is a, c, g, or t
caccgtcggaagtcttctcccctgcacttcgctgcaggttttggaaggaaggatgttgtagaacacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggngnngacncnnncnnncgnaacactgatgggaaatcagccctggacctggcagatccttcagcaaaagctgtccttacaggtaagaagacagagagctaccgaatgattatatctgtgtaactccttacttgattttataaaatcttgttatgctgaatttttcttttcactgatgaagctaagcaaatatatctgccattatctactactttaaaa

SEQ ID NO: 665574 - DNA, 203 bp, Homo sapiens
gagccggtccggttagagcggtctccacagctcatggtaatgctggatccttacccactaagcaagaccaggattgaacccgaaacctcctggttcctagtcggattcgttaaccactgagccatgacaggcgctcccagtactcactacttttaattccctgcagatgtgatatatttttaacttcgtagaccgctcttacc

SEQ ID NO: 665575 - DNA, 2703 bp, Homo sapiens
cagctcttcactggagaaaaggaatgtcttgtgtttgtttaagagtcacagagtatttttcttaggaagggaacacacagttatttcagaccgtgccccgctttgttgtcagtttccaaacaggaacacaccagtctctggtcttcctggccagaacatgtcctgagatggatgccgcgttcgccacagacgtggtgaagacattgtctgcagcagcccccacgttggccactgtcactgtggtcacctctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 665576 - DNA, 2589 bp, Homo sapiens
aattcggcacgaggcgtggagcaggtgtgagggacaggtgtggcgggctggtcacctgggacagttgtgcggggcaggcgcgcggggtaggcgcgcgggaaccggacgaggcgagaggccggcgggcgcacttgcctgcgaaggctgcggcagcggcggcctcgtcggggccgggcagggcctcggcgcccatgtccatgtgcccgggctccgccgccatcaccgccactgccgtgacccgcggcgtctcccgctccgcctccgagtctgcgtcctcctccgagtcctcgtccctgctcagcaccggctcctccgcctcgcctcctgccgcggccgcggccgccgccgccacagcggccgcggccgccaccgccgccgcctcagccaggcccagctgctttgccgccgagtccgagtcctccatccggactccgccgagccttcccgaaggcgccgtccgggaccgcccgaagcgccggtcgcggagcccgaagcggggcccgaagaggacgcccgagctgggccgaggccgcccgaagccgccgcccgaatagggaccgaaaaggcagccagccgccgagcagagccgagccgagtccgcccgcggagcggagccgaggcgaacagaggctgcccgagtaggagccgaacctgcacgaagccgccgagccgagaccgagtcctgaaccgaggagggtcgaagttccccgaagtgggaagccgaatcagtccgaataggtccgagtcctcacgagggcttccgagagactcggcccctgctctcctcactgtcctgacaggctgaggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 665577 - DNA, 165 bp, Homo sapiens
ctaagacctcatctatttgtgtatagctgcagcatacttaaagtagatccgtacttaatgtagcttcattgcttaaaatttttgggctatgcgataatgtctcatcagtagtaagaatctcagggttatgctatatacccccatgggaggtatagacatataaat

SEQ ID NO: 665578 - DNA, 376 bp, Homo sapiens
gggtccaacacatcagcaggatccacctcgtggacaccgtggaacgggctgcgcaaggttgacttctggcattccgatccgtgcaccatgatcaagggaacttctgggcacctgtggccgcccttcatgactcctaagtcctcgcgggcgttctccagcccggaggcctgccgctccatgaagctactgtacaaggcgtcaggggtgtttgacggcatcccccactatcgcttcgtggctcccaaaagcctgttggccaatgggtccatctcaccacccaacgacggcttcggcccgtgcctggagtctggcaattcagaactgtcagcacctgcaggttcagtgccccctggtttctctcccatcctcacgtcgc

SEQ ID NO: 665579 - DNA, 644 bp, Homo sapiens
atcataagcttgattgcctataagatacaggcgcgccgtcaggctcctgagtcgattctctggctccaactctgggaactgagcggactctgaacatcagcgggacccagcctatggataggctgactattattgtcaggcgtgggacagcacctctggagtggcattcggcggggggaccaggttgaccgtcctaggtcagcccaaggctgccccctcggtcactctgttcccgccctcatctgaggagcttcaagccaacaaggccacactggtgtgtctcatacgtgacttctacccgggagccgtgacagtggcctggaaggcagatagcagccccgtcaaggcgggagtggagaccaccacaccctccaaacaaagcaacaaacaagtacgcggccagcaagctatcttgagccttggacgcctgagcagtggaagtcccacaagaagctacagctgccaggtcacgcatgaagggagcaccgtggagaagacagtggcccctacagaatgtcatagggtctcaaccatcacccccagcagggagaatgagctgcggatcccagggaggggttctcctccacccaggaatcagcttggtacgagctgaatcgtatctgtctccttttacggggggagga

SEQ ID NO: 665580 - DNA, 580 bp, Homo sapiens
gtgccatctgtggtgtggctttgggccagtgtgtctcctggacagcatgatgctgtggtgcttcatctgtgcgctggccagctggcttttgccctgtgccaaggtgcttcacatgcagcatgtgctgtcttgtgctgcccacaatgataatgtgctagctccccagacatggacctgtgccacatgtttcttgctctcatgtgaatgatgggggtgaagttgacaccccacaacaaggagactggtgcatgcacatgtgatgtgctcttcctgtgcttgtgaagccacacatcatccccttcatcctggatgaaataggcgcctgacattgaggacagacacatttgtggtgtccttgcgcggcctggcgtcaccatcagctccattgagaagaagctgtcagcgtttctggccatgcccccagtggtcatcctgctgctatgaccaacactccatgtcgctgcgtgctgggacgtggtgtccacctgtgtatgccaccagtgcactgcactgcccaggtggaaggacctcgggatggctcattggccgcagcctgtctgatgcctgctgttccgctttc

SEQ ID NO: 665581 - DNA, 236 bp, Homo sapiens
ggcagctggaattagccgtgatacagaagtccactgggcatctgattcgcacaggtacccttccattcgtctgggtgcgagaaatgctcagggactttaatatcagatctgcgcttcctgagcgcaggtatcggtgctaagcaggaggcaagtgaggcctatctggttggcctgtcggaagacaccaacctgtgtgctatccagtgccagccgtgtaacaattatgccaagagaca

SEQ ID NO: 665582 - DNA, 437 bp, Homo sapiens
  misc_feature (436)..(437): n is a, c, g, or t
gacttgcctgtggttacagagcattaatgtcacagctagaattccaacagctcaagcttttaaaattaccccatgccacttccagggcactgcattgaaagtcagctttggtttaggctctgccaccaattatgtgaccttggacaaatcccctcactcacaagcccactttcctaaactgcaaaatgaggtcaggggtggtggacccttagtcctcagcagagtcctgcagttcctgtgtccctggagcccgttggtctccctctgtaagtctgaccttgggcagcacggtgtctttgcccagagcggttctcattcccttctaaggcagtgtctgtcactcatgccttttgggagctggggctcctatgtggactctgatttaagggctataaggcctgtctcttcctacccaatagaggtttcctaaaaaaann

SEQ ID NO: 665583 - DNA, 785 bp, Homo sapiens
gggtcgccgaggagcctgaggaagagggcggcgaggtggtggtgactgagcggagcctggtgacaggatggtgggcacagatgggtgtggtataggagatctgcaatcccaacggtgcaaagtttgtgccagctaaattcaaaaaactccgtggtgccaggaaaaattcagcacattctctgcacgaggaaaccttggcaccaaaagagagttatgactatctcaagactctggtggtgatgtcatatgtgtgagagggagacttcgatgagactctgaattatccagaacagaaagttgtgactggtggaccaggtcacaacaattggcctcgtgactcctaggggactctcagtgttatcaccaggggggagatagtggccaagcttaagcccttgttgcaggaggccacattttgatggtgcacattccttatctcgggacacaacccacaaaattttgaagcatttgagcattgaaccatcatttctacattaatccagggttcctggccactgggggcatatcagtggcctgtgcgaaacaaaaactattattccccatccattgtggtgtgcatggcatatccagggcttctaccaggggtccaaccttatgtgtatcaggttaacttggcagatggatgtgacaagtagaacggatcgatcacaaaaaacctttaaggccaggctgtctggatgattatggtgtaaaacatggtctggtgaacatcaagttcatcaccattacggcattaaaaagaaacaaataacacacaaattggg

SEQ ID NO: 665584 - DNA, 154 bp, Homo sapiens
acgcgagtactcgaggtggaataggtatgtgattaggagtagggttaggatgagtgggaagaagaaagagaggaagtaaagttgaattatgccgtttttgggttgaggtgatgatggatggtggagcatttgtgtgcatgtgaaagtctgtttt

SEQ ID NO: 665585 - DNA, 97 bp, Homo sapiens
gcggccgcctactactactactactgctcgaattcaagcttctaacgatgtacggggacatgtttataagttatatcagaaccgggacattttacag

SEQ ID NO: 665586 - DNA, 133 bp, Homo sapiens
  misc_feature (46)..(46): n is a, c, g, or t
  misc_feature (100)..(100): n is a, c, g, or t
  misc_feature (118)..(118): n is a, c, g, or t
ggggcctcagcccatcttcttccagatggtgaatgaggcggtgagnactcccgccaaaaagatggtcacggtctgccacgtgggcgtcccaaagtagganaggaggccgtcccaaccnccctggtcttggatc

SEQ ID NO: 665587 - DNA, 374 bp, Homo sapiens
  misc_feature (343)..(343): n is a, c, g, or t
tagagacggggttttgccttgatagctaggctggtctcgaactcctggcctcaagtgatctgcctgcctcagcctcccaaaagtaatccccccaaagtgttgagattacaggcatgagctgccacacccggccaagatgctgaatttcatcaccctcgcagtgcccctgtggccgtgaaagcttttggagtcgtctttggagggctgttactctatctgcatccttccgctcctctctcctactcccttgttcaaatacccttggcaaggctgtctttttaatttgtctttcatatatgggggttattttaattcattaggtcctaaaatggaacaaaggggntagggggctgggggcatctgggggttgtgga

SEQ ID NO: 665588 - DNA, 129 bp, Homo sapiens
tcatgtcggtccaattcggaattcccggtagctttgacctggtactaaaagtaaccaaggacaacgcagctcattgcagcctcaacctcctggcttcaagcgattctcaaacctcagcttcccaaatag

SEQ ID NO: 665589 - DNA, 404 bp, Homo sapiens
cctcagcatcatgcaatatacctattcacacacctgcatgtcctcctgaatctcacatcaaagtcgcatgtgacactaaaccttggttgagatatcaccttagagaggccttagctgaatattctatgtaacaaacaaacaaaacaacacaaacaacctgtcctccatctcttcaccccaataaatttaaccttatagcacttctcaggttatactaatatacactgacatatatatagatagactatatgagacagagtcccactctgttgcccaggctggaataacgcacatcagagagtaacttgattctacatgaaaaaaataaacaaagagcactggtgaaggtaactatgtcagtaaatataacatacagtataaattggttaacgattgtaactctc

SEQ ID NO: 665590 - DNA, 292 bp, Homo sapiens
aaaccccggggccttcccccccccttggtttttggggggggcccccctttgggggcgggggggccccttgccaagcccttttccccccccggggggccccccctgcccccccccccgggcccccccccccccgggggttttcccttcctttgaatttttttggggggcccggggggggggggtttgggggcccttaccccccccctttgggggggcccctttttttttttttttttttcggtttgggggggggggggggggttttttatttttttttggtttccttccttta

SEQ ID NO: 665591 - DNA, 331 bp, Homo sapiens
gcggtccctaggtagactaacacacaggaaaagactaggagtatgttaaaaagaaatgaaatcatatccttggaaacaacaggaatgcagctggaggccattatcctaaggaaattaatgcagcaacagaaaacaaaatactgcatgttctcacttataagtgggagctaaatattgaacatgcttggacataaaaatggaaacaatagatgctggggactactagggaggctggggcatagactgaaaaactacctgggttaggtctacctggccaggtagacctaacatcgttaggtttttttttctcagtgagtacaatatgacttct

SEQ ID NO: 665592 - DNA, 141 bp, Homo sapiens
gtttttcaggtcttcaccaagtatcacagtaataacacacatgaagtgtcattattcacatagtccactgactcctcacatctgttatcttattataaagcacctatttgtagtgactatcagcatctacattctaaacag

SEQ ID NO: 665593 - DNA, 518 bp, Homo sapiens
aaggagaacggaggagagggaaagagaagcccaagcgtctgtgatcatatgacgggccaaggctgagcagggtatcacagagaccctttgaaatgcatttgtctctcatcctagactagtatacaccgacttctcctgttgggttgaaacacgcatgtcaaccttgcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatga

SEQ ID NO: 665594 - DNA, 111 bp, Homo sapiens
actgtctaatgctcaggtcgatggccaaagctgattttcaagtttcgcgtctttttaaacagacgaaagtgaaccttattaaagctgaatgactcattcaaggccatatag

SEQ ID NO: 665595 - DNA, 390 bp, Homo sapiens
gatgaatactaatccaactaacttttcttgtacatgtactatgattcaggtactatgccaggtgttttcactgaatccttgcaataaccccacgtatcattatctaaattttacagatgaaaaaatcaaatgacttgcctaacgcaacttatgtagcgagtaagtggcaatctgggagtcaaaagaaagttgtgtgactccaaagctagtgcgggtttccaatataccacatttctttatctatataaacaatccttcttggactgactatatgatttaccagtcctcacaatgtttttacttgatcctggagaaaaataagtttgtgtaaaacagctcaatgccttttcactggaagtattgagaattatgaacttggaagttcagatg

SEQ ID NO: 665596 - DNA, 536 bp, Homo sapiens
caagtctcttggacatagaaaaaaccttgtaaaaaaggaaaaatttaccgcccaagtgggctaaaagccacccccaattaagaaagggtcaagccccaaccccccttccttaaaaaattcccaaccatataattgaccccctcccccccaattggggccaatctatcccccctatagaagacctaatgttggtataagtaacatgaaaccttttccccccgcataagcttgcgtcagattaaaccactgaactcacaattaccagcccaatatttccaatcaaccaacaagtcattattaccctccctgtcaacccaacacaggcatgctcataaggaaaggttaaaaaaagtaaaaggacctcggcaaatcttcccccgcctgtttaccaaaaacatcacctctagcatccccagtattagaggccccgcctgcccagtgacacatgtttaacggccgcggtaccctacccgtgcaaaggtagcataatcccttgttccttaaataggggccctaaaaaaaaagcaacagatgga

SEQ ID NO: 665597 - DNA, 600 bp, Homo sapiens
ggcccccccccccctttgtggaggactcctttttttttgccccccccccggggggtgttttaaaattctgcccccgggggtttttttccccccccggtttttggggggggaggcgcgtggttgggttctccccctcccccccaagggaaagatttccccccccccccccccctcccccgggtggtggtggtggggggtgggttatagaatttgtgggcgacccccccccgggggccctttttttagagaaagacccccccccaaggtttttccccgggggtctcttttttgggggggggggggggggggggccccccggattttcccccccccccccccgaacctttaccccccccctttttttttttgggggtttttttttttccctttaagggcccccctcccccccttttgggccaccctccctttttctttggggtgggggggggggggggggggggtttttttgccggggcccccggggggggccttttttttttttttgggggccccccccgaaattttttacccccccccccggggttcggttccggggggggcccctgggggggtttttcttttttttttttccggggggga

SEQ ID NO: 665598 - DNA, 539 bp, Homo sapiens
ctcctgttccagattgtcatgtgcctgctcccccttcaccttctgcccatgcttataagcttcctgagacctctctagaagccaagcggatgcagcaccatgcttcctgtaaaggcctgcagaacgatgagccaattaaaactcttttcttgataaattactcagtctcagttatttctttataacaacgcaaaaatggcctaatacgtatatgcacccaacactggaacacccagatatatacagcaaatattattagagctaaagagagcagagatagacttcaatacagtaatagctggagacttcaataccccactttcagcaatggatagaccttccagacagaaaatcaacaaagaaacatcagacttaatctgcagtatagaacaaatggacctaacaggtatatatagaccatttcttccaatggctgcagaatacacatttttttctcctcagcacctggatcattctcaagaatagaccatatgtttggttgtaaaccagtcttccaacattcaaaaacttgaataata

SEQ ID NO: 665599 - DNA, 705 bp, Homo sapiens
tcccttctggagctgaaatacaattttaagctgggtcaaagtaaaatactgggataaaatggtttcttcagctgggatgtggttggcacacacctggtagtttcagccactgggaaaactggaggcaggaggatcacttgagcccaggaatccgaggttgcagtaagctgtgatcatcccatctgcactccagcctcagtgtcagtgtgagaccccatctctaaagaaagagaaaaaaaggttcttcaaaatttttaaaacccgggcaatgaagggggtactgggtgaatttctttccataaagaagagggcattttatatctaccttggagtaatacctttatgtcatatggtcatagaaatacctaggatataattagacagcatataattactaatatggagaatcagggtcaccttggtgggaatagcggtgattttaaaaggcctagaattactttcaggggtgtcacatcatctcatattcacggactttcttcctttgggggaggtggagccaaatggataatcggcagtctaacaaatcttctccctttaaggttacttcaaatctatcaggggaagaacttccattccaaagtccatgctcaggtagagagcagccagcgtgacttgtgtcggacattatccatttaggaggggaaataacactctttgctttgaaaagaactgctgacagggggg

SEQ ID NO: 665600 - DNA, 92 bp, Homo sapiens
atgggatatttttattttttatattttaaaatcaaaaatgtcaaatgtcattgggtatgcatgctttataataaatttacccttggtcctta

SEQ ID NO: 665601 - DNA, 1728 bp, Homo sapiens
tctctcttaactcataactggggccaaaggcagggtgacatcactggggatgccagtgtgtggaggctatcccctgaccagtcctgtccacagtcaggagggcaggggctgcagtgcacagaccgcattgttgtggcatggaggggggtcccacaaaggccttgtcagctcatgggaccacattggcagccagcatagtgacagaagcctcagataggcagtgagccattgccaagactccatggtcccttggtgtctgtggccaccaaacagatgacagaaccagcccctcttgttcagccacctgggaggctgctcccaagcctgttgagcttgaggatccttaaccactcaccagctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 665602 - DNA, 585 bp, Homo sapiens
agcctgccgtctacttcaatggagcagtttctggacgtgagactgggtggacttccctgctggatctgaatccaaacacaagtcatgatttttggcaaattctgttctcatgttcctggcaagttctactgtgtgacgatgtatgaaatgataaatggttttgcatgacaatgccatgtgatgcagctgcttttagttgctcttgtctggccatgtttcgaatgcctttcatgcaagcaaaggtgccagacgctgggtggtagcaggttcacgggtgaaacattgagcaggaagcagtctgagctgtaggggtgcgtgctagttgttgaacgcttggtattccctagattatgttattgggagccattgagcatgagcattgccaaccggtgactgagcctcagtagagtagcagagcagttcaatatgttatttgggtccccctgatctatttctttggttgtgcccccatttgtgcaagcccaaatggagacggggtttccagttggtccagttcctttccagagcttaagccaatcgggtgccaaaggaaaacctggttgctatggattcagaccgaaatgg

SEQ ID NO: 665603 - DNA, 1763 bp, Homo sapiens
  misc_feature (379)..(379): n is a, c, g, or t
  misc_feature (396)..(396): n is a, c, g, or t
  misc_feature (399)..(399): n is a, c, g, or t
  misc_feature (415)..(415): n is a, c, g, or t
  misc_feature (426)..(426): n is a, c, g, or t
  misc_feature (441)..(442): n is a, c, g, or t
cgtgttctgcaggtggggctgcgttaggtgtggtgtgtttgtcgtgttgcttgtgtttcgatattgtgggtttggtgtgctgttgtgtgtgtggtgttgtgggaccgtagttcgcgtgtgtgccggcgcactggttgttattgtgtttcggggcaggtcctgtgggcggtccgacggtcttgtgccggtgtttgtcgtctggtcggtgtccgtcggtgttccgggcgtgtgatgtgggttacacggggccactgtcggcgtggaggtgtgtgatggtggtgtcagctagttgtgtaccttccgagacgcgtgttctcacgtccgcgccagagtcctcagggggccgttcgacctgcgtgggcgtcacaggagtgcgagnggccccagcttccaggncgnccgatggagcctcacncgtcaccttcnccatcacgctttcanncacgtggacttcgtctgcctggacggtgacagctgctgactggccgcatatgtgctggtgatccttccagtccttgcgttggcagaaggtggagcagtagttgaccttgtggcagccggtgcactcgctcatagcctcccggccgcagttaacgcaggactgctccttccgctctgcgtcagcgtggatcttggcctggtttgtggcagcttctcggtaggtgctggcatgcttggcttgctcaaacagcgtcttcagctgctgcgctgtgttgagcaaggagttgaccatctcttctaggtacagccagctccgcggctctgacagctccagcccattgaccaacgcgggaggtgccgctttggtgggagtcgggggtgggaccgccagcgcaggcagggatgtcaacactattttgggatgtgacgttggcaacgcagcttctggaaacggtgcgatctggcagctgtcctgatagccggggtagtgaggctcagggtggctggccctgcatgggggctgcacgctggcctcttggactgtggcccctgcgaagacgtcgccctgggccggactctctgatatgacagcagtggcctctaccgtggacgctcggtcaaaggtcagtgcccccgaggtcgtgatctgtcccgagggggtcacggtgactggaaaggcagaagcacatttcacgcggccaggcagtggcgcccacggcacacaggtcccgtgccacccacgggcgccaatccttgtgggggcctgggctgaagggcgggcagtggtaactgtaccctcccatgtgaaggacacgggggaaatcccagaccttggagaagacctcacaggagaaaaccaggatggccaggatggcaacttgccactaccaattgttcgctgtttaaactgtgaaccatggaaatgtgctgcccagccagaaaacaaacataaaataaaactttcagtgatttttaagtacttcgtggttcgaattaagaaaaaatctttaatccaagctgaaggtaaaaagcagccgtgtcccacagcaaggctgccctgtgtcccacagcaaggctgcctctccagctcaaaaaaaaatcctggcgacagatcttgagactctgctgctgtgggactcttcctgcacccaccacccagggcctcaggaaggagctgacagggtgttttagaaagaccttactctataaatgcaaaaacccagacttagttaacaaaagcctattacaaagacattttctcctattgctacctctccccatttaaatcctgtctgtacaaaaaaataaaaacattagctggt

SEQ ID NO: 665604 - DNA, 297 bp, Homo sapiens
gcattaattgttgagtcctgtatattctggttatatcccttgtagatgggtagttgcaaatgttttctctcattctgtggatatgtctcttcactctgttgattgcttcctttgctgaacagaagcctttacttgctgtaatcccatttgtctatttttgccttggttgcctgctactccttcaggaccttacacaaacaaaagccgtggcctagattccagtgtcctgaagcactttccaccaagcttttgcctctagctagctttcactacgctctctcagactcctctagcaac

SEQ ID NO: 665605 - DNA, 417 bp, Homo sapiens
ggtcacagaactaactgttctgcatggttcacatcgtgtgcaccagagcataacactctgaatagacggagtgcacagtcactaatgagcggaggcagatgtcaacagcacccctgaccatggtcttaacaccatcaattagaaggattgctctgtgtattgcgcactgcatgatgttccctgggctcagacggccgatgtagatcccaatgtgccctagcggtaccgcctgaatggagctcgggttctagtgtatgatgcacgccgagcctgatagcaacgggctgcttactatccctgctgtgcacgatgtgataactgagtaggttagacagtgctcaatacatggagctcagagaccgtgcgccacagatactacggattagcatacagctgttggcatgacatcgtagtggg

SEQ ID NO: 665606 - DNA, 300 bp, Homo sapiens
atggcatgagctttcatggagcgtgccgatcaacgaacacacgcagttctcgaccttgctggatgtgcattacctggcggacaaggccggtaagagcccgattgtggagcagcggttgcaggcgtcggtgtcggggtagttgtaatacaccttctgatctaccttgccctctgtaggagcgagctttaatataacgtcaacgataacgcgtgttttctggataaacgcggccctgttagtgcttcggagtaagctcgccctacagagcatgctagtcttagtacctacgactagccgtgt

SEQ ID NO: 665607 - DNA, 1780 bp, Homo sapiens
  misc_feature (744)..(744): n is a, c, g, or t
  misc_feature (755)..(755): n is a, c, g, or t
  misc_feature (1723)..(1723): n is a, c, g, or t
gttccacgaccgccattcccggctgagccccgccatcggggctgtgttgacggaggatgtgacagggctagatcggcgatcagcgtcgcgctggcacacacgcgagagactgctcggaagagcgcgaccatgcctgatgcaggcatgcctgacatcattctcgacggccgtgagactcaagttggtcggtcagacccaaaggattcgcggcgtctccataggtttatctgtggtggatgagttctatacgaaatgtgaattgaaggcactgggagaattagactctccaagcgttggacgaatatgatcaatgtggatggagcgacgaggatttgttgtcgacgtaaggtaagcacgaactcgacattggtttgacatgacaatatcggaagcactcattgggttagacgcaaataatacgtccccctgcggaggcgcgatacctcagtaggcatcgtgcgcagcgcgaaatgcacacgatggagcatttgcagcgtactcagcgtcgtggcggcattcgtatttaccgccgcactagcatcatctcgaagaccatatggacgtaatctctcggctgctctgtggcccatgagctccgcgacgtcccgagtgtacatcaatcctagtggggaccgaagatgggggcccagacagtaatcacgcagggagcgggcagcccggtaggccctggcgtcgacccgtcggtggtcccatggcacgtgttgcgcatgcagagatacgcgnagcatcttcanaggatgtcctggtggagctgctcaatcccgagggggtccttgccaaccgtgaaagccaacatcgtcctggcgcggtgtccgggcaaccgagagggagtcccgcgcgaatgggggtatcctcttgtagtgcattcccaagcggaaaccaattcgcgtgccgagaggaaggttaacccccagaaaaagtctgaaatttcatggaaaaaccagcccttctcgagcttggatccaatggccccctccaaaccccaaaaggctggtcccagaacacgggggggggtggagaagccccccttaaaaaatcggcccaaacacacattgcgttccggcggttccccaaacaaagacgttggattgggaaaaaaacaaccttagggagtgaaaaaaaaccttaacgtgggcacttttggaaacaaaaacggaaaggggccccttggtaatttgcgacacaattcttgggttttgcccggcagacctcctttaaaaaaagatttgaatccacaacccccaccagagacatcaacggggggggaccactttcaaagcaaaccctgcgtgtgtggtccgggcgcacccattatatacggggcggcacacccaacccagtaacttggggcgggaacccgggggcgcaagaggggaaatcgacgacaaccctctgtcgaaaagactgagcggggggaacccactaggggggcgccaatcactggcagcacgaccagcatctaaatcgccccacgggtgctgcgacccacagttatacgcccggggaggaaccacaagaaacagaggacacgcggacgggaggacaaaacaccaaacaaacgagtgaactaacgacacaacagaaaatagttgagacagtacacaccaacaacacaacaaaaagccggaaccatctagcgaggccacaactgaagcagacgaggcaacagacccagcacacacaatagccactacggacaagnaacacagaactacgagaatacagtagcacacaacagtaccaagccagctcgagaggt

SEQ ID NO: 665608 - DNA, 354 bp, Homo sapiens
taatgatgctacctagttgattaatgtgtctagctggtgctggcgattactgaagactgtcactaggaatgcgcatgtgctcctcaattatttaagcatgttactgtaccacctttgctttagagcactgggatgatattcactaagtgccccttgttttggacttaatatgcattaatgcaattgaccacctctagttttagactaatagttgatctccacatattgcccttgcataaggggcatgttaattatgaatgaaccattttcttttaatattaatgtcatttgtatttgtggacctgtgtatgagagaccctatgttctctcccattaccctttggattgtgcttg

SEQ ID NO: 665609 - DNA, 104 bp, Homo sapiens
catggttttcacttttaacattcttactggtaaaatggaaggggtgggtgacgtctgtgggttccctgggcttactggcaaaccctcaaacctgagtactggcg

SEQ ID NO: 665610 - DNA, 110 bp, Homo sapiens
aaacacatatgaatatggcagcatttaaacgtctttagactgggcatggtgactcatagctgtaatcccagcacttcgggcaggccaacggtgggaggactcatttgacg

SEQ ID NO: 665611 - DNA, 142 bp, Homo sapiens
tcccgtgatgatgtctcctcgattgaactgtgtgggcccttgtgggatgaaggcagtgtctcatccatctttatagccttactgtccctcagactatccctgggagggccaaggcaaacagtttcatctacgcctatttgcc

SEQ ID NO: 665612 - DNA, 245 bp, Homo sapiens
cacaaaccacacactaaggtctccattgcgattgaccaatagcccataccatatagggtgtaaaatgtgttgatcttctccctgtatatagctgtctattgcatagaattatctccatatatattagacattgctgctgaattatctgcaccggggtcaactggggcacttatcaacaatgcagatggttgcgttatacatcacgtgcgaccccactgccatctctagagcacacatagggccag

SEQ ID NO: 665613 - DNA, 928 bp, Homo sapiens
  misc_feature (84)..(84): n is a, c, g, or t
  misc_feature (126)..(126): n is a, c, g, or t
  misc_feature (182)..(182): n is a, c, g, or t
  misc_feature (225)..(225): n is a, c, g, or t
  misc_feature (266)..(267): n is a, c, g, or t
  misc_feature (272)..(272): n is a, c, g, or t
  misc_feature (276)..(276): n is a, c, g, or t
  misc_feature (305)..(306): n is a, c, g, or t
  misc_feature (308)..(308): n is a, c, g, or t
  misc_feature (313)..(313): n is a, c, g, or t
  misc_feature (333)..(333): n is a, c, g, or t
  misc_feature (339)..(339): n is a, c, g, or t
  misc_feature (352)..(352): n is a, c, g, or t
  misc_feature (362)..(362): n is a, c, g, or t
  misc_feature (368)..(368): n is a, c, g, or t
  misc_feature (396)..(396): n is a, c, g, or t
  misc_feature (403)..(403): n is a, c, g, or t
  misc_feature (407)..(407): n is a, c, g, or t
  misc_feature (409)..(409): n is a, c, g, or t
gccggagagggctatggaaagccgccggcggggaatcccggccgtagagggacagtggataggtgcccgaggcctacagctggnctggggctcgtgtctgggcttcggacgttggggcccggtggnccaccctttccgtagttgtcccaaatggagctggaattggatgctggtgacaaganctgctggcttcctgctagaggaaagtggagattggggacgganccgatgaggccgtgatggccccagtgactgtgcgctgcgcnnttctngagngtaccgagcgactgggaagtagatgattnngntgtgntccctgctgagtcccccagngtcgtngaacattctcagnctcctccaanccctgncttgtccaccatgaccacacctactccnctcccangggnanactgtctctatggatctagagagtgagagctgtagaaagaagtaggggacccaagatgactccagcagcatatggaggagctggcagagcaggagattcgctaggctagtactgagcagcatgagcgagaagagtctattggcagaacgcgaggggcttattctgcctgagacacttcctctcgactaagacagagggaacaaattctgaaacgtgtgcggaggaagattcgaactaaaagatctgctcgaagagagccgcaggacaacacagaccggtgtatgtagggggttccgagagcagcggtcttgaagataccacagcccagaatatggccgcttcatgaactaaacgtacagcttctggagcaacgagaatttgtcccttctagaatcaacgtgagcgaagctccaggccatgggtggatcgacgatatctaacgcagaacctgtaggagccagtacctgcatttttggtgccactaaatctcctttggctccttcctgttcctctatgacc

SEQ ID NO: 665614 - DNA, 480 bp, Homo sapiens
  misc_feature (8)..(8): n is a, c, g, or t
  misc_feature (14)..(14): n is a, c, g, or t
  misc_feature (203)..(203): n is a, c, g, or t
ggcaggcngatgcntgaaaaacctctttctaaaaggccctttgtttatacttttttttttaaccagagtcattccaactgagtcctttgaattacctgctggaaaaactaggattcattttggaggcctgagaaagaaagagtcatggtagagttcctttttggatttagctcaataatgatggtcaagattgggcaatgggntgcgcgcatggctcatactgtatcccagcactttgggaggccgaggtaggcggatcacttgaggtcaggagttcgaaactagcctggccaacatggtgaaatcgcatctctactaaaaatagaaaaattagccagatatggtggcacacgcctataatcccagctactcgggtggctgaggcacaagaattgcttaaatctgggaggcggaggttgcagtgagctgagattgagccactgcacttcagcctgggtgagacaatgagattctgtctcc

SEQ ID NO: 665615 - DNA, 479 bp, Homo sapiens
  misc_feature (13)..(13): n is a, c, g, or t
  misc_feature (69)..(70): n is a, c, g, or t
  misc_feature (78)..(78): n is a, c, g, or t
  misc_feature (252)..(253): n is a, c, g, or t
actgtatcccggngagtgcagaggcttaaggtgggatggcagaagaagctatgcaaaaaagtggggagnnggaggctnttgttataaacaacacaaatgaagaaccaaccccttctgtattctgaagctgagcagagttaaggaacctcaaggacaggatgtctacttactgatgggccctgagggctcttggctgggtgttattcccctctcttcagatggagctttggacaagatctgaagttgattctnntggaagtcagagataagcagtatgtacttgctggttttggttggctgcttttaaaagaatcagaactgaagagtgggtgaagacagagggatgtaaagttaacctatgggaagcagaatgaataccactatactgccatagtttcattttaaacaaaatagagtcatagaccagaccaaagtattaccttgcttctgaaagaaatgtctccctccccgggatacag

SEQ ID NO: 665616 - DNA, 94 bp, Homo sapiens
gtcccctagtagccgggccattgctgccacctctggagaagctgggcccccaagaaactcctcggccactgtgactatcaccaggatgatgcag

SEQ ID NO: 665617 - DNA, 456 bp, Homo sapiens
caatccaaagaaaaagaaaaaaaaagaaaaaacattaaagccttaaacttatattaaaagcttttcttggttattggttgaatattccacaatatctggggctgttaaattaccttttattggcattaagttgccctgcaatctggccgtattacattatgattaatcccactgaattaatttctttaagttacccacaaccaccttcctgttccaatgttcccaccccattttaaatattattccagagttcctgtttaccttctgatttgatattaccatccataaaatctttggagcaatttgtaagttccgggttagttgctattagattaccgattaaggaaaaaaagttactttaactttcccccaaaggttaacttccctttacgaattaattaagtttctgcttttattatttacgttatgtattaatttaccctggctttcttctac

SEQ ID NO: 665618 - DNA, 87 bp, Homo sapiens
gcggccgcctactactactactactgctcgaattcaagcttctaacgatgtacggggacatgttaaatgcaaataaaactagttcat

SEQ ID NO: 665619 - DNA, 228 bp, Homo sapiens
gctatggccaaactttttatttagtattctgcagttgtttaacacacacttaaatggtcttattgggggaagggaaaggggagggccttgcaaacccccaccgaaatgtcagaaaggcccaatggccccccttttccaatcgcttctttgggtccaccgggcgaacaccactccccttacataggcctgtgatcccaggttcttcgtactgagaacattgaaattcca

SEQ ID NO: 665620 - DNA, 158 bp, Homo sapiens
  misc_feature (68)..(68): n is a, c, g, or t
  misc_feature (85)..(85): n is a, c, g, or t
tccctctcacagcagtctcgctgttgttaactgttttctctgcttgaccacagtggcctcttcctcgnggctctgggcgtgacantgagaggtcatgctccccgggggccacaccactggtcctccacttccccgagtgcttctgtgctagtgcctcg

SEQ ID NO: 665621 - DNA, 1401 bp, Homo sapiens
gactcctatccctcagcaatcatggcaagccaaagccatttatccaggggaccactatgagggaacaaagttctaggcattcatcatagtactaagtctgcccgtagcaaagtactcgctctagtgtataagcattcacagtccatccagaattcactcatattgtatatctacttcgaaaccgcacttatcccgagctatggctatcatcattccagatgtgaggcgacacgatgcctagaatgctctgtatacgtcaaggcctcgattactatcgcgtaattcataatgaagcctaatttagagcttcccatgtacctctcatgactcaatcggccatcgttaatattaagactcgactacatccaccgcataagggcgtcagtttaacatccaatttcgttacataactctacttcgtgctactgagccgccatagcatacctcatgcgaaaagcgtccttcgtagcccgcacatcaaatatacacttgatagcacgtataggctgtcacaaacaaatagaggcatatatacaatcaaggtaaagcacgaataacttctttttcacacgcgacttcccgaaggtataagtcgacttcgccgcgtgtggaaagaagacggccacaaattggttcggggcataaggccccctcccattcggtcgtctgcgagttccacaaatgtaggctaagcttgtggtcggcgccaagtaagcttcctttggtacaaacgttacagagacaaggggaagtcaatggcggtacatatagagtaatctgggcccgttcaaaaggcacttcccaattatccatccgaaaaacccaccctctttggagacgcaaaatatatcaacaaatagtaggccaccgtaaacaccagccgtgttccccggttttggttcaacattgagtaccccccctttaagtggaagtggttatctcacaattacttaaacagcaaagggcgtaccgcaagtgcttggagcctttaggctgtaaccaaagaaccaaagtagggcttcacataagagtgccggactcaccatttgtggcgacttaaaccttccctttctaaacttccaggtcgccaacacattaatgggcccccttccggataaggtaaaacccaggaccaacatttgctgaccagtgtccgaaaaaaagcccccgctctggaaaaggcattttcacccgagggcaggcaggttccaatttgcttccacttaaatgttcgcgtcgcaccaccggggaccttttaacgagttcccctgcaatttgaaacctaatttttcctgagacccttaaaggcacaaacacttccaaaagccttacgggacagccgggcaccatccacaaagggtgcgggacattcaccattaggtcctcttcatccgtggcaag

SEQ ID NO: 665622 - DNA, 168 bp, Homo sapiens
  misc_feature (1)..(1): n is a, c, g, or t
  misc_feature (53)..(53): n is a, c, g, or t
  misc_feature (55)..(55): n is a, c, g, or t
nctgtgttatcaagaacattatggtcaggcgcagtggctcaggcctgtaatcntnacctcagtgatccgcctgccttggcctcccaaagtgctgggattacaggcgtgagccaccatgcccggccagggttttacatgtatttggcttttcttttttctttttctttt

SEQ ID NO: 665623 - DNA, 186 bp, Homo sapiens
acgggaggacgaggggagacggaagcactcggcaagacgaaggaaatgcgagggaacaccagaagccagaggacatgagtgacaacgaccgtccctagagcctcgggacagagttcaaccctgcggacaccttcattcgtggactttcacacctccacgagctgacagctgagagaataaagtatc

SEQ ID NO: 665624 - DNA, 312 bp, Homo sapiens
tgtcagatgccgttagtgattcaactgtgaaataaaaggtccaaccataatgcttaaaaaaaaaaaaaaggccagcatggtggctcatgcttgtaatcccggcacttggggaggccaaggcagaaggaccatttgaggccaggagttaagagaccagcctgggcaaccaagtcagatcacatctctacaaagattgtaaaaaaaaagaataagccaggcatggtggtgtccatctgcagccctagcgatctgggaggatgaggcagaaggaccgcttgagcctaggagttggaggttacagcgagctatgat

SEQ ID NO: 665625 - DNA, 242 bp, Homo sapiens
ttgtgtgggctcggtctgttgtcaagtcggctcttctccagtctaatctcgctctctatgagtaggcaaactgtcttgaggtgggggtgggggtcgcagagtcaacttgtcagaggattaacaacaattcaatgtatatgcctcttctttggatgacatacttcaatgtactacatgcttaatgcaaactaacacaagtagacacatgcactgtacagtgggagagtacaacctgccggtgg

SEQ ID NO: 665626 - DNA, 100 bp, Homo sapiens
aggagactttgtatttagaatattcatgtaaaacttgtgaacaagctttcattttgatcaaactgatcttccgttttattacaaaaatgaaggtcgacgc

SEQ ID NO: 665627 - DNA, 136 bp, Homo sapiens
  misc_feature (29)..(29): n is a, c, g, or t
  misc_feature (100)..(100): n is a, c, g, or t
ggtcctcaacagcatgtggcagtaccganatctgaggagtctctacaaaaaggatggatggtcacaataccactttttagcctcgttttcaaccatcganagggaccggcaaaggccctactcctcctcccgcacg

SEQ ID NO: 665628 - DNA, 85 bp, Homo sapiens
ccgagcccgggaaaaaaaaagaaaaaacccccccggaaaaaagtgttaaacccccccccacagaaaaaaaaaaagggcgcgcttc

SEQ ID NO: 665629 - DNA, 403 bp, Homo sapiens
agtggtggatatgtacatctaggaataggattgcgcatgtgtgtccctagggtaactggtccgtgggtcaagtgatgggatcaattgaatatagtagtgcgctttgactggtgaagtcttagcatgtactgctcggaggttgggttctgctccgaggtcgccccaaccgaaatttttagtgcaggtttggtagttgcggaccggtgagtaagtgcgagtacgtgtagcattcaataaactatagtctccatagggtctgctcgatcatgctgggttgcgcgtaagggccaggaggcgcatagggaccaggatatcgcaacctatgcgcatcttttaaatgggtaagaagccctgctcgctggcgtgtagccgggggtggaatgcgagcgcgtacgggccagca

SEQ ID NO: 665630 - DNA, 213 bp, Homo sapiens
agaaggaagttgtggaagaggcagaaaatgtgtagagacgcccctgctaacgggaatgctaatgaggaaaatggggagctggaggctgccaatgaggttgacgtagaagaggacgacggtgatccggaacaggagattaaaaagaaagcgagagttcacggactctggcgataaagctgccggagtccgcggcggcggaagaggcgcgcggcg

SEQ ID NO: 665631 - DNA, 320 bp, Homo sapiens
ggtgcgacctgtgggattaatgggtgccatgtaatagaaacaagcagatttgtgggtcatagatctgggcagagctcagctgggcaattcttctactctttgtagcctggactgaggtcatttggtgtcaccttgcctggaaggttccagaatcttcactcacacatctgataccttagtggtgatggctggaagactgagcttagctgggattattttctgtctgtttgtttttcagacggaatctctgtcacccaggctggagtgcaatggtgcagcctcggctcactgcaacctttgcctcctgggttcaagctatt

SEQ ID NO: 665632 - DNA, 222 bp, Homo sapiens
aatctgggcaacaaagtgagaccccatctctacaaaaactaaaaataaaaaattagctgggcatgttggcacacacttgtttatccgctactcggagactgaggtaagaggatcacttgagcacaggaggctacagtgagctatgatcgtgccactccactccagcctgatgacaaagcgagacctgtctcaaacaatgggggaataaagatatagtcattg

SEQ ID NO: 665633 - DNA, 776 bp, Homo sapiens
tgactgtgctgacacaatacaatggctcggagctccgggtgctcagatctcatgacgttatgagtccttggtaccccgcgtgagatataattgtctctactgtgctatgctctttgaattctctctcgttcaatagttgttgtacgcagtatggtagcgtgaccaagtaagacaatctggcttgcaatctttaagattgcctaatcgatctcagggttaatttcatctcgtgcgcaatgcttacccttcgattgaggcgaatatcgaccatgaatttatcgcgttgttcctatcgtatatgcgatatatccaaaatcatatgtagcacatgtgcactcctatcgagttccctttcgtgaaacgatgacctcgttttagcaacttctacaagatcgcataaaatcaatatacaacaatgcggggaaaatggtgcacaaacgaggtcatttgaaattgagagaacgggcggaatcactcaaaaacatcaatcttttaattaaaatctcataggaaattgaagaatacttttgtaccacaacaaaaacatctatataagtaaagtttgaacttagaggaagcgaccttcggccctttagacattattctgggaaactggctgctcccatgtgaaacaggagcactcggctttttacagctaacatgcgaaacaaacttcttacgtgggaacacacactccactttgcacacggaacgaattccggaattatgtatcaaaacaatccgtttgtaacctacctatagataaatttccctgg

SEQ ID NO: 665634 - DNA, 1235 bp, Homo sapiens
gacgtcgcgttgagtatgtcgatcaaaatgttgtcacgatcacagcacatggattcccttgcgcattcctgtgttcgtgcccagcagcaacgtcgttagagcaggtggaggaattacgtgcaacagtcattccctaatggaattaaccagcgccatagtgcgggcatcaagacctctatgcgtagctttcactgcgtctttgcgatagacgtagagtcggtagaggtctatcatctggtgtcgcggaaatctacgtaggattggccaacggatccacacgtggatacacacgaagtgaaagtgagtgtagtgccttgtacaccatatgtcagagaacagccatgcatgtgtagttgtgggcattgcttgtctcaagatgcaaagcgatctgagaggcaatcgagagcactaccaatacacgtgtcgttggggtatgaagtttagtagtgcaagtgcgattgacttgacacggtaaacgtccgtacttagagtaagacggttaggagactaaaggtactaagacagacagcatactgccctttaaaacccagagataagattgccttagcacgattgaggctcgggactgacctggatgtgtcaccgcaaaagcacagctggaaagaaagggccgtcacgagacggaagcccagacaacctaaagcggacacagtcgaatcgccgcagccagatagccacacagaaacacagaatgccgtacagcataaaccgacagggacacaaaaaacaagggacgcacactgactgcaagacgaccacaaggggaaagcgagagccaccgatggtgcaacaaaaccacagaccaaggggcccgagcaagaagggatcagcaacaaaaagagtaacatgagaaagcgaagtaggatagagaacacgtaccagagatagcatcaaataaaaaccggggccgaccacattgcccacacgcctacaaacaaagaccccaagcaaaaaaaaaaaaccaaagcaacacaggccacgcaagaccaccaaagcataacataccaaaaaagtgacataaaaagtatgaaatgcgacattataagaccaaacgaccatcacatggagacagaagacagagaacgaaaaagacaaaaacaacgcaaattcaaaccaaagagaagaaacatagactgaacagggaaaacaaaaacacgaaaggaacaactgaacaaaaaatagcatgactagaagtaaaacacagtaaatagaaa

SEQ ID NO: 665635 - DNA, 218 bp, Homo sapiens
  misc_feature (149)..(149): n is a, c, g, or t
ttttaaattctttttagattcaacttttaaaaaatacattaggccaggcatgatagctcacgcctgtagtcccagcattttgggaagccgaggcagggggatcatctgaggtcaggaagttcgagatcagcctggccaacatggtgaanccctacctctgctaaaaatacaaaaattagctgggtgtggtggtgggtgtcttgtaatcccagctactt

SEQ ID NO: 665636 - DNA, 276 bp, Homo sapiens
ctgaggcaggagaatggcgtgaacccgggaggcggagcttgcagttagccgagatcatgccactgcactccagcctacatgacaatgtgacactccatctcaaaaaataataataataacaatataagaactagctgggcatggtggcgcatgcatgtagtcccagctactcctgaggctcagtcaggagaatcgcttgaacttgggaggcggaggttgcagtgagctgagctcataccactgcactccagcctgaacagagtgagatcctgtcaa

SEQ ID NO: 665637 - DNA, 234 bp, Homo sapiens
tagaggatcctccgctctcacccaccccgggggctggccccacagcaccggggctgaatcggccaagaccaggcctctctcatcccccgacgtgggtattaagctctgtggattccaaatggcaccatcaggctgcattcctccatgagccggctcttgagcagtgacaggacataaatcaatgtgttaagaagtcagagtcagtgtggaaaatgaggggtgggtggagagcgg

SEQ ID NO: 665638 - DNA, 118 bp, Homo sapiens
ggtaccccgtggtagcaacctgggaaacagcgccctgcagcgccagccccagcgccgggaacaggatgaaggtgcagcccaggatcagcgcgtgcatgcctgcactgtcttacgccgg

SEQ ID NO: 665639 - DNA, 187 bp, Homo sapiens
cgcgagtatgcaaacttggacaggtggtgtccatgaactatacggtcaatcttctccagagacccgacgcttcgtctgcaccagcacggacttgcagaggggtgagcacccgctttcttggttcccacacacacagcctttcagcgatgacaaagtcttcggctcactatcacccatacgtggacaa

SEQ ID NO: 665640 - DNA, 805 bp, Homo sapiens
tttagattatgccgtgcaactagtcttaaatttaatttgccaaaaaatggcatatcccagtgtgccccagtcctcatacctaaggtcccacctcagattggcacctgtgcgtgtatatggatacactttccccccaggaccctgcctggttatgggccaggtcagcccagtaaactcgtggtgcctcactcacgaggttctgggttgaggccctcgtcccgcctcagtgctgtcccgagctgccgagccaggtccgcagtcccccgtcttgcctctgtctgccggctgctcccggtggcctgatacctactggcccccatctgggccctgggctgacacgttggcgagctacctgctcacatgtcgctacctcgactccctggcatcacagcttcagggtggaccaattcacccaacgtcagattcggcccgtagagctaggtctcccgccatttcttcccgtaacagcacctgcagctactccaggctctgggtcactaagcacagtgcttgccccatctcacggacacggtcctccagggctcccgaaagctcggggaggctcatggcctgcagggacgcttgccagcccttgaagtcaagctggggggacggctaggcccataagttggctgcacccagggggcatggtcctgccatcactctgagatgacacgctcagcttagacaggctcgcagactggtccaggacaagggcaagatcccgggccaggcccaagtctcccgaagccgggcctgagaggtcctcgcgggcgcggtcttgctcccagcaagcaagtctcga

SEQ ID NO: 665641 - DNA, 1642 bp, Homo sapiens
tggactttaagttcacatttttaaaggtttaaaaactatggttaacagagcagttataagaacagaactctcttatatttctttatttacaccacacactaaaaaaaaaaaaaaaaaaaaaaaaaaaaaaaggggggggcggggccaaaaatttccccgaggagggggcccacaaaggttaagacgagcgatacaccccgcgagttttgtggtggccacacaagggggcgcccccataatagagagaggagaagcggtatatatatataagacgctaagagcgccgaggggcgcgagcgcgttttaaaacaaacggctggagagagacggggggcaaacaagcgcggaacccgctcgggggggggcactcctttggggggaaaagagagagaccaccctctataaaatttcagggagagggggggtgcgcaactataatttttgtgggacgccaaaacatatatcacttataccgagagaagagatatattcaaagacgcctctacagaggggagaaacttttatacaacatctttttaacaaagtgtggtgatacacacagagcgggtgtgtcaaacaaccacacaagcgctgcgccaaataacgtgcacgtgcgcgcgagcaccgtgacaagaacaaccattcagtgcgcgcaaaacacccgaggagagctatacgtgaccactttccgcgccacacacaacttcattatataacgcgagcgggggcgcaccctactgcctaccaacacacccacaggacagaaaacgaccacacacaacagaaagcaagaaagacggcaagaaaggacaagaaagagtaggaaagcgatgagaagaccaacgtaacgaaatcaaggagaccagataaacacaagcgaggcactcaagagaggaaaagaagagcagatcgaagaaacaagaggaaggacgaaaacaaaacaaacgacaagataacgcgacggacaagaacgagaaggcgaggagataacaacaatgaaaagaagaccaacgaacgattagtatacacacgaacagagcagaagacaagaggaagagcgaatagaaagcagaaccgacaagagaagaaacagagaagaaacgaggataaccaccagaagagagcgacaaacaaggagagaaaggagagagagaacaagagagagcagagaaagaagaaaagaaacaacaaagaaacaaagagcggaagacagagaataacagcacagcaccaagaaaaaggaaacagaagacgagaaaacgagaaaaaggaaaggaggacaagacaaaggcgcgacaaagtgaaggagaaaagagcgacagaaaaggggaaagcaaagacaacgaaaagagagaacgagaagaaagagaaaagacgaaagaaaaagcaaaaggacgaacgagagaaaacaaagagacaagaaagaggcacgagagagaacagaagcaacatagaaaaagacaagaaccacaacaacaacacacacaataacagaagagagaaacaaacagaagagaccacacgaaaagcaggtcgaaaagaagaccacaaaagcagcagcggagagcaaggaaaagaaggagaaaacgagagaacagcgagaaaacacgtgaagagacgaacaaaccaacccgcacgacaa

SEQ ID NO: 665642 - DNA, 119 bp, Homo sapiens
atgaaaatgattgtaatctgtagacttattacctgggagatgtctgatgtaaaatcccatccttgggttgtgggtttttgttttctccaaataaatctgatctttaaagttcaaaaaaa

SEQ ID NO: 665643 - DNA, 968 bp, Homo sapiens
tagtcatcggccaagctttaaggtaggaaaaacgtcacccttgggcgcttcacacggcgaagccagttctcttggcgattgcgtttcaggccagtaggcgctatctaccgagtgccctctttgagttagttgtgtcctcgaaccggtgacccctaacggggctagcgggccaaatttatcttccagtcctccagaagggacgatactctcttaaaacttccaaggggataaaaactcaccccaaagaacgcgtttttgtagcgccaaagagggccttttgtttcgtcgctacttattacgcaatggacaactatagaccagccgtgtgcgacataagtttaaaaaaaacccccataggtatgcgacctgtacgtatgctagttgcccaaggaacagggaatacgccttattggcgtctttgaatgcttggggcgcatgtattttaaaacagttatggagacttggtacttctcagctttgggaaaatcattgtcgttgacagacaattgctcagacgagacctgacacccgtgtacaaactgtctgttattccctccataaccgaaagcttgcaggtttagagagtcttcagacaacaatagaaatggttgggtacatgatcctaaaatgtgttaaatggctaaaaggtaattaattccggtaaaaggggtaagttgttttggtttttggaaacgataaattctagaagttgctcataggaaaagcgtataacataggtcttcagaaactataaaagaattttcatatagtattaaaatccatagactaaaatctgagaattttttaacatatgcaagtcatgccaaacataagctaccaaaataaagagcaatgtgttctggctgttttatacttcaacaattttttccctaagtggtaagcaattactttaaaacatatttttaaaaacatcggtatcgggagctgcggtgtaaaccgccgtcgtc

SEQ ID NO: 665644 - DNA, 885 bp, Homo sapiens
  misc_feature (355)..(355): n is a, c, g, or t
  misc_feature (450)..(450): n is a, c, g, or t
  misc_feature (526)..(526): n is a, c, g, or t
  misc_feature (529)..(529): n is a, c, g, or t
  misc_feature (555)..(555): n is a, c, g, or t
  misc_feature (608)..(608): n is a, c, g, or t
  misc_feature (701)..(701): n is a, c, g, or t
  misc_feature (714)..(714): n is a, c, g, or t
  misc_feature (739)..(739): n is a, c, g, or t
  misc_feature (753)..(753): n is a, c, g, or t
  misc_feature (755)..(755): n is a, c, g, or t
tccagcctggatgacagagcaagaccgtctcaaaataaaaaaaaaaaattaaaaaataataacagcctctctggccactgaaaaacttctcactataaagcatgtattcaaggattaccaatgcaaatgggcagcaattaacctggagaccccatgcctatggcagtctcaagaacggaactagagatgctatgtttgaaaatcgacgcatgattaaagcgatacttctggaagcatgcagggcaggcggcccggccatgacgcacagactctgtacagccctgcagacctcagccaccatgctaacaggcggacacttttaccatgcaatcaagggcacgggatcagctgcttngggaagacttatttccaccccctccagtctctcaggctggagcgcagtggcgtgatctcaactcactgcaacctctgcctcctgggttcaggcgnttcttctgcctcagcctcctgagtatgtgagactacaggcacgcaccaccacgcccagctaatgttggtatttttngcngagatggagtttcgccatattggccnggctggtctcgaactcccgatctcgtgatctgcctgcctgggcctcccaaagngctgggattacaggcgtgagccactgcgcccagccaggaagactttcttcatggcaaacagtgggttctttcaggggacatttctgtaatgtncaaaagaacctgnaaaaacaaaagcacctagggagacngaagactgggaaangnccatgaagggcagagctctctcagtaatggaggaacctaataggactgctgctaatggagcccaggtgagcctggattgcaggccacgtggaccagcaccaggttgtgtgagtgcgggtagcctcttagg

SEQ ID NO: 665645 - DNA, 950 bp, Homo sapiens
  misc_feature (420)..(420): n is a, c, g, or t
  misc_feature (515)..(515): n is a, c, g, or t
  misc_feature (591)..(591): n is a, c, g, or t
  misc_feature (594)..(594): n is a, c, g, or t
  misc_feature (620)..(620): n is a, c, g, or t
  misc_feature (673)..(673): n is a, c, g, or t
  misc_feature (766)..(766): n is a, c, g, or t
  misc_feature (779)..(779): n is a, c, g, or t
  misc_feature (804)..(804): n is a, c, g, or t
  misc_feature (818)..(818): n is a, c, g, or t
  misc_feature (820)..(820): n is a, c, g, or t
tttttttttttgagatgggggctccctcttttgtccaggctggcgtgcagtagcgcaatctcggctcactgcagcctccgcctcctgggttcaagcgattctcctattctcctgagtagctgagattacaggcgtgtgccacgacgcccggctagtttttgtatttttagtagagaccggggtttcaccatattggtcaggctgatctcggaactcctgacctcatgatctgcccgctttgacctcccaaagtgctatgtttgaaaatcgacgcatgattaaagcgatacttctggaagcatgcagggcaggcggcccggccatgacgcacagactctgtacagccctgcagacctcagccaccatgctaacaggcggacacttttaccatgcaatcaagggcacgggatcagctgcttngggaagacttatttccaccccctccagtctctcaggctggagcgcagtggcgtgatctcaactcactgcaacctctgcctcctgggttcaggcgnttcttctgcctcagcctcctgagtatgtgagactacaggcacgcaccaccacgcccagctaatgttggtatttttngcngagatggagtttcgccatattggccnggctggtctcgaactcccgatctcgtgatctgcctgcctgggcctcccaaagngctgggattacaggcgtgagccactgcgcccagccaggaagactttcttcatggcaaacagtgggttctttcaggggacatttctgtaatgtncaaaagaacctgnaaaaacaaaagcacctagggagacngaagactgggaaangnccatgaagggcagagctctctcagtaatggaggaacctaataggactgctgctaatggagcccaggtgagcctggattgcaggccacgtggaccagcaccaggttgtgtgagtgcgggtagcctcttagg

SEQ ID NO: 665646 - DNA, 521 bp, Homo sapiens
agagcttatcagtgcattgcctggcactgaatggtggcccagagaaactgtaactgctggtatctctcagccagaaagaaaatagaaggcggaatttctggcctgatttggaggggtagggagggggcagaggacatccttgtctatgtaaactgagtgtgcagtccaggaagagaaggtctcgttgtctttgtgggggcccagcataatcagggtgctcttattgttttgaacagacaccaaatgacagggctgtcatatagctctgagctcggatccttaggtctttcttactctgaaagctgtagaagtgggagaggaccttagcttttctctcgaagtcccggtgacgtcccggcagatagatgtagggtgttgcgttctcctgaaggtggggcattgtgatgctggggcactggtgggaagtcagagtttagtagacattcagctgtttttttgttttgtttttgttttgaaacggagtccagcctgggcgacagagcaagactccatctcaaaaa

SEQ ID NO: 665647 - DNA, 917 bp, Homo sapiens
tcgtggtggcctgctctccatggctttctcggttgatccccggcgattagttgttgtcgatttctagagcgcgtgtgcccacacgtacgacgggtgtagtagtctccccccccccgtgtggggtgtgcaccacggccccccccgggggatttccagccagcacgcgcgtctttgagacaccacccccagctggggggtctggccgttctgaggacaaaatttaacccgcgcgtggctcccatcactgcggaatgattttctatgcacgcggaacgaacgggtgactaggtacgtctgacgtcccacaatagttggtgtcttaaaccgcggacactttctcaagctgctgcaatgtaaccccccctcttatgcccgacgcctaaggattacaaaatcaggacctagtagtacactgcaggaattgtgttaaaaacagcgagtagcggtatttcccccccccaagagtttttaaagttgagtgtatcccccctttatttgaccgcacgtataagcgtgtagttggtggccagctccttacaaacgcattttaaactctttagaagttatttcccccctacaactcccattattgttttgtctacttgatgtttaaaagatgcccattgcgcttttttcattcacccacacatggcacaacaaaggtacttctgcacaagatcattcttgttcaccttacaatggccccccattgtcacccccccctcggtccccccattgtctaacgctcctccccccattggctaaataaagggtctttacttatacgcccctctgtataataaatgaccccctgttttaacaccccccttcttttgctataagccactaatagaactcagttcctacacccagttgcatagtgttttttgaaaaaaccccgggaaaacaaacaaaac

SEQ ID NO: 665648 - DNA, 578 bp, Homo sapiens
  misc_feature (551)..(551): n is a, c, g, or t
gtgggcgcctgtagtcccagctactcgggaggctgaggcaggagaatggcgtgaacccaggaggcggagcttgcagtgagccgagattgcaccactgcactccagcctgggcgacagagcaagactctgtctcaaaaaaaaagccaggcatggtgtatttggactgtggtcctgggagatggaggctgcagtgacctgacatcacactgctgcattctagtctgggcaacagagtgagaccctatctcaaaaaattaaaaagttaggtgaggctgggtgctgtttacacctgtaatcccagcactttgtggggctgaggcaggcagattgcttgaggtcaggggttccagaccagcctggccaacatggcaaaaccctgtctctactgaaaatacaaaaattagctggtcgtggtggctcacgcttgtaatctcagctacctgggaggctgaggcaggagaatcacttgaacccaggaggcagaggttgcagtgagccaagatcacaacactgcactccagcctgggcgacagagtgagaccccatcttanaaaactcacggattcctctgttggggg

SEQ ID NO: 665649 - DNA, 833 bp, Homo sapiens
gaggtgattccaaccaccctttaagtttctcataagcataagaaatttatttctcgatggttctcagtggctgggagagtttcctgatcaatggactctttgctgagtgtgcctactctggtgaggctctgccttcctggttcactagctggccagtcttcttctgtgtctttacctgggacgaatagggcgaggcaagtctctggcttctcttcttgtggggggactaatcccagttccacaaggtgttcctcctcatcacccagtcacttcccaaaggaaacacctccaaatataattgcattcaaacattagattgcactgtgaatttgcgggggacataaacattcagtctatagcagcaatgaataatatattgttcctggagaaacatattccagaaaaaccttttccctgaaactcactcctctgtaatctgcctcaaccagctcattgcctggcctatctgtaggaactcagtatcttatctcatcctacaaaaattgacttttatatcatacagtgctccataacctatctttctcacttattcacataatcatgtcatgcatctagcttcctgcgctgtcagtcgactataccattgctataaccccgatctcacgccatgccaacaacatgggcctattcaacgttaatcccaacaactctacagacaccccacttttcacctcgcaatccccttaacccactttgccacaattcaaactctcttacattttcaactgcccaggcaccacacccacgaacgacacacttgcccacacaattctccaacgtttcacaactgtcccaacaattgacacgaaatc

SEQ ID NO: 665650 - DNA, 374 bp, Homo sapiens
cccgtatttctaacattagtacgcggaatgcaaaatggtatggtatagccattttggaaaacattttggcagcttccaaaaaagttaagtataggccgggcgtggtggctcacacctacaatcccagcactttgggaggccaaggcgggcagatcacctgagatcaggagttcgagaccagtctggccaacatagtgaaaccccatctctactaaaaatataaaaattagctgggtgtggtggtgcatgcctgtaattccagctactcaggaggctgaggcaggagaatagcttgaaacctggaggtggaggttgcagtgagccaagatcgtgtcactgcactccagcctgggagacaaagcaagactccatct

SEQ ID NO: 665651 - DNA, 371 bp, Homo sapiens
  misc_feature (119)..(119): n is a, c, g, or t
  misc_feature (142)..(143): n is a, c, g, or t
  misc_feature (212)..(212): n is a, c, g, or t
  misc_feature (233)..(233): n is a, c, g, or t
  misc_feature (289)..(289): n is a, c, g, or t
cacacagaggcatttgcaccagctccctgcacacacgtgcctggcgtgctcagaggaacaccaataatgctcaggaagacagggcttgctcaataatgtccggctgtcatttctccacntaagagccttccatggctccctnntgcctacagcattgaatcccaacaagtcatactctttggactttgaaggttctccaccctgtgccccancctccccacagagctcttcantctgtctctgttccctgctttggccagtggctatcctcattgtgacccacactacncctctgcccacactgcagctctttacccagtaaccctccagttcctcacaacgtatgcctatttccgtcatgccccggactg

SEQ ID NO: 665652 - DNA, 1746 bp, Homo sapiens
  misc_feature (722)..(722): n is a, c, g, or t
  misc_feature (793)..(793): n is a, c, g, or t
ttttttttttcccaaaaaagagattttttttttatatttacaaggatacctgacaaatatagaaacccaaaaagggacccccggggggggcacaacttctatgtggtttccccctctccccaaacaaaacaggggggagggagggtgtgcgccccttacccctctttttgtgtgctcaattctcgggcgcccctctttgctctccctctctgtggtgtgccgtctctcctataggggcgcggggggcccccacactcttctctcgctgtgagagacagctgtgggagtatagtcgtcgcggtctcacagcccagcacactctgtgtcacagtgtgtcccccacagagacctctctctctttctctccacacaaagagagagagagtttctctgtgtgagagcgagagagagagagacactctgtgtgtgggcccacaaacaccacaagagacagcgcagaatgtagaagcgtatgtagtacacatattgtgtgcgcgcgcgtgtgtgtatacgcaacgcacacgcacaatagtagcacgcgcgtatgtgcccactaaagaatatgtgagacacattgtgtgtacacatcaaaaacaacacaaacacacacacatgtgtgcgcccacagagcagtgtgtttagtctgtgtgtgtcgacacatcacagagagagacacaaacacagtgtgggcacaccagcagaaacactctgtgtgggggganggccgccacagagagaagagagacaacaccaaagaagagagagaggtgtgtgttgtggcgagaccacacgngctgcgaccagaagcggaggtgtgacaagactctctcctgtgtgtgtcatctgtcgtcgtggtggcgcgccccccacttctctctgccgaggagaggcggggggggcgacaccacatgttgcgcgtcgtcgacagttgtgtgcggcgggaaaaaacgcacaacaatgttctgtagcgtggtttttcaggcgggcgagaacacctcattcgccccgccaccaagggccaccacccttcttcttctctaggggtgttggtggcggcggcgcaccccaccgcagggggggcctcttcgtgtgggggggccctattcacccggcggtgtggcgccccacaattgtcgtgtgtggaccgcgtggcaggatttctctccccgttagtcacgcgcccacaatcatttttttgttgtgtttgtcctctccagaaaatactccccccgaaggggggggggagaggagggcgccccaacacggggtcgtggggtcttctttgtgttgcgccccccacctgggggtgatacaacaacgagggcggccatggctagtaggggcggaggaacactaatccacacgccccccccctgttacctgcgtcgctacactctatccagtgatgatagcccccgaagagaggggggcggcgggcgtccgttcccccaaccccaccttaatatagtatgggaggcgggaacacgatctacggcaaaacatctggtgtgcgagcacagcagacgagcatctactacactagttgagtagcccgccccgccacgttggtggtgtgttgcacacacacaacaacaaacatagttggttggtctgtgggagggaagacaaacccccccggagtcgggggcggcacgcaacacacccccgccccgctccatagattgtggtgcacaccacacatcggtctggtttgctgccagcgcgaacacgaggtcaccaacaagc

SEQ ID NO: 665653 - DNA, 384 bp, Homo sapiens
  misc_feature (235)..(235): n is a, c, g, or t
ataattgtgagatgacataaggatctattgagacctcgaccagggaacagaatcaacctgggtctgggataaagagtcactgacatgataaagtacgtgaaagccaagcggagtgaagatgaaatgggtgggtggtttcccgttaaagagttactgacagggttgtccaacgcctttgacaacccttcatcagcatgaacacattatgggcttgcatgcgttggtgcgacgccanggtgtggcatgcaaacggtaagtcaacacgttccctgatctcaggaggaggcagaactaattaacgatttctgtgggaataacaatctagacccacgtctcctagcaccgtgctcaacatatctatagctcttttatttacaatttatt

SEQ ID NO: 665654 - DNA, 380 bp, Homo sapiens
gctggcaggaggcctgggtctcaccagcaggagtgcgtgcaaggtgggagggtcggtccattacagaccccacatcctggagcacccccatctcccatgtgtgaagtagcttcctccctcagcctgcaagggtccgatttgccatcgaaagacgacctctacttttttcttttgtattttgataaacactgaagaagctggagctgttaaatttatcttggggaaatctcagaactggtttatttggtgtcgtggaacctcttaccgctttcaatacacaattagtaatcaactgttttgtatacttgttttcagttttcatttcgacaagcactgtaattatagctgttagaataaagtctcttaactattaaaaaaaa

SEQ ID NO: 665655 - DNA, 174 bp, Homo sapiens
gaagaaggtggggaggaagaggaggaggaagaagaaggtgatggtgaggaagaggatggagatgaagatgaggaagctgaagcaggttcgggccaacgggcaagttgaagatgattaagattgacgatgtcgattaccaagaagcagaaagcccgacgaggatgactagacagc

SEQ ID NO: 665656 - DNA, 295 bp, Homo sapiens
tcacatccacacataccaaaatgtactctttcataagtgagtaactaagatctctatacctggaatatcatgtatgtgtcatttacctggatgtttacagttcaggaaggacaatagttttgtttatttacagcaactgaatacttataaactgttgttccttgggggttatttattccataaaaaataagttcttttctcatggatatataatacctatatgtagagagcacgacaggtgaacgattggtgggggggaggatagggcttatttaaattcaaattgatgtcttga

SEQ ID NO: 665657 - DNA, 256 bp, Homo sapiens
gaagagtgggatacaggtgtgagcactgcaccagaactcacaacaggattgcattagtgctctgatccacagcaattaaagaatcttcaggagcatgtgaatttatcaagaagagtctcactgttgcccaggctgcagtgcaatggcacgatctcagctcactgacaacctctgcctcccgggttcaagcgattcttctgcctcagccttccacgtagctgggattacaggtgacctctgagaaggatgtgcaaac

SEQ ID NO: 665658 - DNA, 283 bp, Homo sapiens
tatggagaagtatttcagctccagggtgcccaacccaaaaacatatcccagttccttgtaaaaattggccgggttaaggccgtctcacctaaaggttcttgggttttaagggcttggggccccctaaagtttaagtgaggttttccttccaatgagaaaaatttccctttttccccttgtcccgggtttaaaacccccccagcttgtataatgtacccctttgggggccccttttaatttggaaaagggtaaccccttcatccaataatttgaaaaaacccca

SEQ ID NO: 665659 - DNA, 524 bp, Homo sapiens
  misc_feature (13)..(13): n is a, c, g, or t
  misc_feature (73)..(73): n is a, c, g, or t
  misc_feature (78)..(78): n is a, c, g, or t
  misc_feature (114)..(116): n is a, c, g, or t
  misc_feature (222)..(223): n is a, c, g, or t
  misc_feature (313)..(313): n is a, c, g, or t
  misc_feature (332)..(332): n is a, c, g, or t
  misc_feature (357)..(357): n is a, c, g, or t
  misc_feature (373)..(373): n is a, c, g, or t
  misc_feature (484)..(485): n is a, c, g, or t
aattcgcggccgntcgaccacatggccaacaagcatatgacaagatgctgaacatcactaatcatttagaganatgcnaatcaaaaccatctagtcagaatggctgttattaannngtcaaaaaaaaaaggttatgcttcctggtcagggaacaacagaaagatgctggtaaggctgtcaagaaaaggaaatgcttatatactgctagtggaagtataaatnngttcagccactgtggaaagcattttggagatttctcaaagaactgtaaacggaactaccatatgacccaacaatcccatatgggtatatncccaaagacatagaaatcnttctaccctaagggacacatgtacncccatattttcactgnagcactattcaccataacaaaggacatgggaatccaacctaaatgacaatccatggtagaatgggataaagtgtggtcatacactatgggattacttacaccggcctaatnngatggagattatggtccttgcagcggacgtgggtgtgct

SEQ ID NO: 665660 - DNA, 461 bp, Homo sapiens
tgacgatgaaaaatgcaggcatcgtgatgggtcccatcagcctgctgatcataggcatcagaggacagtgcactagcatgggtatcctggtgaaatgtgctcaacacttctgccgcaggctgactaaatcctatgtggattatggtgatactgtgatgtatggactagaatccaacccctgctcctggctccggaagcacgcacactgaggaagacgtgtagtgaactatcttcctgattgtcacccagctgggattctgctgagtctattatgtgtatctggctgacaacttaaaacaggtgatagaagcggacaatgggaccaccaataactagccacaacaatgagacggtgattcatgacgcctaccatggactcgcgactctacatgctctccttcctgcccttcctggtgctgctggttttcatcaggaaccaagttatgttataccggggatcc

SEQ ID NO: 665661 - DNA, 289 bp, Homo sapiens
gggaatagttctatgcgagttataataggtccacaagatcaccatatgagccacgaacccctgcataggaataatcatatccggagccaacctgatggttcataagccatctgccatatctagatgggctccatgtatctattagcagagtcccaagtttcatcagcactgaaaccaaccatgccgtcgtaacggtctccaggtctccctccttctgtcataggccatgaggtctccccctctaggtggtggtggtggaggaagaggaagattccgagctctgctaccg

SEQ ID NO: 665662 - DNA, 879 bp, Homo sapiens
cgctggtacgcgccggaagttcgggatgccgcggctcatgcgcggtgcacagaggcttgtttcagcgatctgtaacaacaggaggaggccgcagacctcgtgatgaggaatagcaaggagagaattcacgctccagctgcaaagagcctacaaaatctgagactgtcattgcttttataaggattccagctttcccttcctggccagaaatgttcagcctggactcattcagaaaagatcgggcccagcacaggcagctgtcagtgccgaaacttgcgcgcccacacccgccgttccacctatggtgtgtctaccccataacccaggacgggaccatctctcgatgactctctagggacctagttacagacagagcttcgccacaggcgcgcagagaaatcttgcatcaagaggtgatgacttggagaagcaggcgcatcggaaaatctgcacatgcaggaagatcggaccgttagatcgtacgtgcatacataatggtaccgacggagaataggaaaggcgacgactgcactagtaaagatggaccaagtagcgtggcagcgtagcaacggctagggcagacccagacagatcgaggctgagcggcagggtgcgagctgccggctgccagcctgatacagaggcgggggtctggctaggtccccggactgagtggttgggacggcaggtccaagtgctcgagtgctaggctgatctggctcggctccactgatcgacagctggctggcagcccggacaccccaccatgccccgctacttgctggcgggcagctgaagtcccgagagtatccgcaccagcggggacccagggggccgtagtcgcggtcgtatagcgacgggaagaagaggacggcactg

SEQ ID NO: 665663 - DNA, 1012 bp, Homo sapiens
  misc_feature (335)..(335): n is a, c, g, or t
  misc_feature (377)..(377): n is a, c, g, or t
  misc_feature (394)..(394): n is a, c, g, or t
  misc_feature (403)..(403): n is a, c, g, or t
  misc_feature (440)..(441): n is a, c, g, or t
  misc_feature (456)..(457): n is a, c, g, or t
  misc_feature (460)..(460): n is a, c, g, or t
  misc_feature (478)..(478): n is a, c, g, or t
  misc_feature (505)..(505): n is a, c, g, or t
  misc_feature (513)..(513): n is a, c, g, or t
  misc_feature (516)..(517): n is a, c, g, or t
  misc_feature (525)..(525): n is a, c, g, or t
  misc_feature (537)..(537): n is a, c, g, or t
  misc_feature (541)..(541): n is a, c, g, or t
  misc_feature (557)..(557): n is a, c, g, or t
  misc_feature (591)..(591): n is a, c, g, or t
  misc_feature (600)..(600): n is a, c, g, or t
  misc_feature (630)..(630): n is a, c, g, or t
  misc_feature (634)..(634): n is a, c, g, or t
  misc_feature (642)..(642): n is a, c, g, or t
  misc_feature (695)..(695): n is a, c, g, or t
  misc_feature (711)..(711): n is a, c, g, or t
  misc_feature (721)..(721): n is a, c, g, or t
  misc_feature (938)..(938): n is a, c, g, or t
  misc_feature (991)..(991): n is a, c, g, or t
gaagtcataggacgggagatacaagtgagcacgagaaaatcctttgtataaccccccggggggaccactctttcgccaggctttttcccatttgtgcgacattttagcattatgttcaccaccatgtttaagtccgctgtaggtaaatcgtaataccatctcatggcttgagctgggtttatccggaagttcaagatatgcccgtttcgtcgttacggcagtatgatgccatgcaatgtccgcccctattttttttttagacgattgtgagcagtactagtccgcaaagtagatgagtccttagcaaagtgagctcatactatctgacatgactnagccgatgcagatagactgttccaaaaaaattttttacaaanattgaacattgtagctncaagacctnagcaggtgtcaacacaggacaatgttctcagctagannacatgcttcatctcnnctnagagagctgcaaacatcnactcctcagtttgagttagcctatatntcccaggncannagtatccnacactatagatnaagnagaatacctttctcanggctgaatagctcatagttcctctcctgcacccnagcctcacnatagcctacatagaatagactacactttcncatnttttgccncggctgagatcagtcactcaccgtacaacggggacagagccattcaccgttgnggatctctggaagtgngggattcagncagtggatgtggtaggaagaaggacaggtatcacagcagagcagttccccaccatccttgcagacccgacagaattccatatggtggtcatcctcctcttcgaggtctcccccaacctcttccaggatctcctcaccctccgaattgtcctctttagcttcccactggatgccttccttctcctgcagtaaaggaccacagattcagattattaccnccacccgccaccgcagtctgaagccagtgcccatcattcctttgaatgcttcncaagctcacaacacctcgtgc

SEQ ID NO: 665664 - DNA, 448 bp, Homo sapiens
  misc_feature (152)..(152): n is a, c, g, or t
ggccaatgggccgcgggccaggggggttttccccccgtttttttccccccccctttggccaaaaaaacccgtgttaagtgcccccccgggcccccaagggttattttccccccccccaaaaattgggttggtttggggggtggggggggccnaatttcccaaccccttttttgggggggcgggggggccccccaatttttgccaaaaaggaactctttgcccccgggcggggggggggcccttatcttcttgggggccccctttttggggggggcccccccccccctttggggggcccccccccctccccggaggggccccccctggcccccaagggggtttttttttttcccccccggttggggttttccgggggcccccccttttgccggggaaaaaaaactttgttttggggccccctttaatttttttttttttccccccttca

SEQ ID NO: 665665 - DNA, 932 bp, Homo sapiens
  misc_feature (140)..(140): n is a, c, g, or t
  misc_feature (157)..(157): n is a, c, g, or t
  misc_feature (255)..(255): n is a, c, g, or t
  misc_feature (297)..(297): n is a, c, g, or t
  misc_feature (314)..(314): n is a, c, g, or t
  misc_feature (323)..(323): n is a, c, g, or t
  misc_feature (360)..(361): n is a, c, g, or t
  misc_feature (376)..(377): n is a, c, g, or t
  misc_feature (380)..(380): n is a, c, g, or t
  misc_feature (398)..(398): n is a, c, g, or t
  misc_feature (425)..(425): n is a, c, g, or t
  misc_feature (433)..(433): n is a, c, g, or t
  misc_feature (436)..(437): n is a, c, g, or t
  misc_feature (445)..(445): n is a, c, g, or t
  misc_feature (457)..(457): n is a, c, g, or t
  misc_feature (461)..(461): n is a, c, g, or t
  misc_feature (477)..(477): n is a, c, g, or t
  misc_feature (511)..(511): n is a, c, g, or t
  misc_feature (520)..(520): n is a, c, g, or t
  misc_feature (550)..(550): n is a, c, g, or t
  misc_feature (554)..(554): n is a, c, g, or t
  misc_feature (562)..(562): n is a, c, g, or t
  misc_feature (615)..(615): n is a, c, g, or t
  misc_feature (631)..(631): n is a, c, g, or t
  misc_feature (641)..(641): n is a, c, g, or t
  misc_feature (858)..(858): n is a, c, g, or t
  misc_feature (911)..(911): n is a, c, g, or t
cccggggggccccttttcgtcagctgttcccattgtggccagtcctggttagtaaaccccggtttagtccgctgagtcaatcgtaaatcatctcctggatggagagggctatacatgaagatccagtatgacagtccgtngtgacgcgtatgacccnagcatgtcgccctagttttttttatacgagggcacgcagctcactctacaagttaatgagtccttagcaaagtgagctcatactatctgacatgactnagccgatgcagatagactgttccaaaaaaattttttacaaanattgaacattgtagctncaagacctnagcaggtgtcaacacaggacaatgttctcagctagannacatgcttcatctcnnctnagagagctgcaaacatcnactcctcagtttgagttagcctatatntcccaggncannagtatccnacactatagatnaagnagaatacctttctcanggctgaatagctcatagttcctctcctgcacccnagcctcacnatagcctacatagaatagactacactttcncatnttttgccncggctgagatcagtcactcaccgtacaacggggacagagccattcaccgttgnggatctctggaagtgngggattcagncagtggatgtggtaggaagaaggacaggtatcacagcagagcagttccccaccatccttgcagacccgacagaattccatatggtggtcatcctcctcttcgaggtctcccccaacctcttccaggatctcctcaccctccgaattgtcctctttagcttcccactggatgccttccttctcctgcagtaaaggaccacagattcagattattaccnccacccgccaccgcagtctgaagccagtgcccatcattcctttgaatgcttcncaagctcacaacacctcgtgc

SEQ ID NO: 665666 - DNA, 633 bp, Homo sapiens
tgcccccgcaaatattccttttgggcgagaacaacgcggctagatattatttcacgttggaagaggagacttccttgacaacgagcagcacggaatggtgccacttgcctcaccgcacaccccaccgggctcatcaggcggggggtgaaacaaacaatagtcggtaagatctcaccacgttgtttgtcgcacaacaatcacgcggtcctataagaagaagggacaaaagtggggggtaccacacaaaaaggccactcttttattctctgttgttaaggcgttccttgatcacgagggggcccacatcatgtggggccctatgcggctgtgtaatgtgccagttgttgctgtgtgaactcaatggagacatgccacagagggagtggcccctggtgtacaagcgttgtggaccacgctgacaatggagacctggtcgttcaattcgggtgccccaaataaacatcactggaggggagagaacgccatacgtccacatccaagccccccttatggggtaaatttttggaccattgggccaacggcctttttgggtcccttcctaattctcaatttttaaatattcttttttaggccccaggtgtgaaaagaaccaaaattccaatcccccccgga

SEQ ID NO: 665667 - DNA, 638 bp, Homo sapiens
gccaggctgcccagattcaaatcctgactccgccacttttcccactgtatgatcttgggcaagtcacttcacctctctgtgccttggtttcctcatttataaaatgtggattacaggccgggcgcagtggctcacgcctgtaatcccagcactttgggaggccgaggcaggtggatcacaagatcaggagattgagaccatcctggctaacatggtgaaaccccatctctactaaaaatacaaaaatattagccgggtgtggtggtggagcacctgcggtcccagctgcttgggaggctgagagcaggatgaatggcgtgaaactgggaggcagagcttgcagttgagccgagatagcgccaacttgcactccagcctgaggcctaacagagcgaagaggtaccggtcgtctgcaatgtaaccatattacagtatgaatgtaagttactagcaagaaacacgacaaattgaagtgacacttaagtgatggggttaaatttcataagtaaccgttcgccgtactatactggtccagggcaatgagaagcctagcggatgagcattctccgaggggcaggagactgtgtaacgaaggagaccaataaaaaaggctcaagaaacccacagagtaagaaaat

SEQ ID NO: 665668 - DNA, 521 bp, Homo sapiens
tgagcagtaggtctcaattgtaggcttaaaatattcagcacatcatgttgtaaacagatgtgctgtcattcgtgctttgctattccatttctagagcacaggcagagtagatttagcataatgcttaagggccctacaattttcagaatgataaattagcactggcttcaacttaaactcactggcttcattggcctctagcaagagaatcagcctgttctttcaagcccatgcactgacctctctctacctatgaaagctttagagggcatcttcttccaatagaagggcgttttggctccattgaaaatctgtttttagtgttgccaccctcatcattagctagattttgtgtataacttgctgcaactgccccactaatgcctgctgcttcatcttgcacttccatgttatggagatggcttttttccttaaactgcacacaccaaggctggctagcttcgaacttttgttaagccacaccttcacctttatgagcttaaatgtaatggtgaaagtta

SEQ ID NO: 665669 - DNA, 333 bp, Homo sapiens
  misc_feature (2)..(2): n is a, c, g, or t
  misc_feature (9)..(10): n is a, c, g, or t
  misc_feature (12)..(12): n is a, c, g, or t
  misc_feature (42)..(42): n is a, c, g, or t
  misc_feature (78)..(78): n is a, c, g, or t
  misc_feature (164)..(164): n is a, c, g, or t
  misc_feature (182)..(182): n is a, c, g, or t
  misc_feature (188)..(188): n is a, c, g, or t
  misc_feature (194)..(194): n is a, c, g, or t
  misc_feature (198)..(198): n is a, c, g, or t
  misc_feature (208)..(208): n is a, c, g, or t
  misc_feature (218)..(218): n is a, c, g, or t
  misc_feature (251)..(251): n is a, c, g, or t
  misc_feature (266)..(266): n is a, c, g, or t
  misc_feature (276)..(278): n is a, c, g, or t
  misc_feature (281)..(281): n is a, c, g, or t
  misc_feature (302)..(302): n is a, c, g, or t
  misc_feature (310)..(310): n is a, c, g, or t
  misc_feature (323)..(323): n is a, c, g, or t
  misc_feature (331)..(331): n is a, c, g, or t
anaatcaanncncctttaccaagcacaggaatgaggcagaangtcaccggagtgcaatctttcagcgagcgggaaganccagtaataaagcacacagagagttaacatcacagtacagtaaaatgccacaaagcccagaagctgcagagagagacagacaaagngggattcttctgagtgtnccccangagaanggancgtttcaacngttcttttancgctgaggtttagctgaaggatgtcggaagggnaacaaagattgtccngaggtacacnnnggntttctgcaagcttctaggaangtttccanagttcgcctgcanttcgccantg

SEQ ID NO: 665670 - DNA, 171 bp, Homo sapiens
tcgaaaggctgaccacaggacaatcgtcctcatcggcctgctgtggaggagagtcttcaaccagacccaccttcaccacgccaatgaagggaataaacttctgataggagtcttcatcagggaacttatgccggcaagtcagcatggcttcggcccaacggagagaagctg

SEQ ID NO: 665671 - DNA, 220 bp, Homo sapiens
gcgccaccagatgcaactgccattgacatgttctgcagctgttcgatcctctcgctgaagccggacacccactggatgacggtcatgccggcaggcaccgggtagtgggaccagctcctaggcaaggtccctttcactagctcgttgatcagcgtgcgcaagtagttgggatgcttcttctttccttcgcacacccggacgacatctgcaaggaggctca

SEQ ID NO: 665672 - DNA, 223 bp, Homo sapiens
  misc_feature (66)..(68): n is a, c, g, or t
gctgcgtttaggagttcagtcccacagaggccacttgggttccagaggtggctgtcagaagcagannntaaggctgaggtatcttcttttgtgtgtgtgtttttccaaggccaacacacttctacagagtctctattaaggcaagctctctaagtaaatgtcgtagctcatagcactgtgtaaacatcttcagtcgcgatatatccctctgacctcctctcga

SEQ ID NO: 665673 - DNA, 534 bp, Homo sapiens
  misc_feature (236)..(236): n is a, c, g, or t
  misc_feature (282)..(282): n is a, c, g, or t
  misc_feature (312)..(312): n is a, c, g, or t
  misc_feature (345)..(345): n is a, c, g, or t
  misc_feature (373)..(373): n is a, c, g, or t
  misc_feature (379)..(379): n is a, c, g, or t
  misc_feature (388)..(388): n is a, c, g, or t
  misc_feature (397)..(397): n is a, c, g, or t
  misc_feature (424)..(425): n is a, c, g, or t
  misc_feature (431)..(431): n is a, c, g, or t
  misc_feature (446)..(446): n is a, c, g, or t
  misc_feature (459)..(459): n is a, c, g, or t
  misc_feature (484)..(484): n is a, c, g, or t
attaatgccttaaaaaacacaaaaagttctgaacacacatttattatctggaggaataaatgcactccaaatgcttatcatcagaactctggaaaaagacatataaattctctccagtattttaaaaattggtatctaaataatttcattttgaactaggttagcaacctaagttgtcttcattcagcttttaaaattgaaaaaaaattgtttcaaatataataaagacttaagtncacattcaaaatttattttctgttacagttttcttgccaaaagganttgaagaatttttttgcttatcttacttangacaaatgttgtcagattaaaaaaaaaataacnggatagttgttgtaaagctaactctatntgaatnggtttaatntagccccangttaaaccaccttttaatggtagatcnntttcgncttgggtggatgtcnctttttaaaaatntcaggtttttctcatatcatttctnggatggggcttggccccattcttacaatttttttcaacatggactttttt

SEQ ID NO: 665674 - DNA, 660 bp, Homo sapiens
ggagcggcgcagcaagatcccagctcggaccccggacggcgcgcgccccgaagcccggatcccagtcgggcacgcagctgaacgccagattactgtgcatcccgaatcacgaacacctgcattaatgaatcggcaggcacgctgagtatgcacgcacgaaagcaaggatcaccagcggccccacaacccgcacacagaacacaacacagacagaatcaaacaaagaagacacacaagcagcgcaacacgctcggaaggacaagagagaaacgaaagcacagcagagacgacaaaaccacaaacacacagggacccgacaaagcacaagacaaacacaactacccacgcaacgcaacaaaaaaaagagaacaaagcacagagagaaagaaagaacggaataggacgacagacaacacaacagagaacggacgaaccaaggaacacacagagaaaacaagaaaaagaaagaaaacaatcaaaggaacacacaaggagaagactcacacgagagataaaaacaacacacaaacacgacacacaagaaacaaagacgaacgaaaagaacacaacaaagcgaaaaaaagaagacagaaatgaaaaggactacgacacgacaagaaccacaaacgaacgcaaaacacaaaaaaacaaacaaaacac

SEQ ID NO: 665675 - DNA, 360 bp, Homo sapiens
tttttttttgtaaaagatttggagagatttattctaagccaaatttgagtgactataacccatgacacagccctcaggagaccctgaaaacatgtacccaaggtggtcagggagcagctgggttttatacattttagggagacatgagacttcaagtacatttaagaaatacattggttctgtccagaaaggcaggacaactcgaagggcggggaggggaggggagcggagtgcggacgttccagtttataggcagatttaaaaattttttggttgacaattggttaagtttatctaaagacctgggatcaatagaaaggaatatctggggttgagtagaggttgtggaaccaaatttta

SEQ ID NO: 665676 - DNA, 416 bp, Homo sapiens
  misc_feature (5)..(5): n is a, c, g, or t
aaacntaaaagcccgaaattaaaagcagctggtgagtaatcttaaattttagtcattaaggaaaaattttaagacaaaactctaattcagctacttacctggaaacaaggctcaggctggtgatcgttctctgccatcttagaagctggaaacaacttacactcaccttccctgtcagaagcaagctgaaactcaggaaaggaggtgcctgctctccatcaccacagaagcaggaaaacttgccttccttgttggaaatgagtaaaacttccagaaaaggagttgtacagcaaaatcaaacttagatctcaaccagattttgggagatcagggactctttgcaggggagaagctccacaacctcagcaaattatcctgttggtttgggcaataaagatagcccaggttggtatcaa

SEQ ID NO: 665677 - DNA, 305 bp, Homo sapiens
  misc_feature (1)..(1): n is a, c, g, or t
ntgaacatctccgccttaccttccgggcttcagggcccagtgcgagaccctcactgcaggccaaccatcttagacctctctctggttccaggctctatataatatcccctcccaagctgacttttattcccatcctgcagccactaacatctgctaggtgataaagaaaagcagatgcaatggcgcgatctctggctcaccagcaacctgccgaccatacccgggcttcaagcgcttctcctgcctcagcctcccggagtagtggaattacatggcatatgcctagcatagtccgtgctaagtta

SEQ ID NO: 665678 - DNA, 954 bp, Homo sapiens
  misc_feature (16)..(16): n is a, c, g, or t
  misc_feature (92)..(92): n is a, c, g, or t
  misc_feature (105)..(105): n is a, c, g, or t
  misc_feature (310)..(313): n is a, c, g, or t
  misc_feature (324)..(324): n is a, c, g, or t
  misc_feature (333)..(333): n is a, c, g, or t
  misc_feature (346)..(346): n is a, c, g, or t
  misc_feature (350)..(350): n is a, c, g, or t
  misc_feature (366)..(366): n is a, c, g, or t
  misc_feature (384)..(384): n is a, c, g, or t
  misc_feature (393)..(393): n is a, c, g, or t
  misc_feature (399)..(399): n is a, c, g, or t
  misc_feature (417)..(417): n is a, c, g, or t
  misc_feature (434)..(434): n is a, c, g, or t
  misc_feature (440)..(440): n is a, c, g, or t
  misc_feature (449)..(449): n is a, c, g, or t
  misc_feature (471)..(471): n is a, c, g, or t
  misc_feature (495)..(495): n is a, c, g, or t
  misc_feature (508)..(508): n is a, c, g, or t
  misc_feature (570)..(570): n is a, c, g, or t
agaagccaactatgantattaacgatgtccaacccttctggcccaccagggtccttttgacactgctctaacagccctcctctgcactcccncctgacacaccangcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactcgcgtcacggattccgtcggcatagctccggggtgcgcagttnnnngaaaatgggcncaacccgtnagccccagttcangcanctgtggcagagttacngttctgtggtttcatgtnagttacctnatagtnactgtgtaattagtgccncttaatgtatgttcccnaaaatnaatatatcnacccccgactagatgtagtatnttttgtataattggatttcctaanactgtcatcctcnaagaaagtgtattggttttttaaaaaagaaagtgtatttggaaataaagtcagatggaaaantcattttttaaattcccgttttgtcacctttgttctgatataaagagtggccactatgtacccctctttcggccccactgtattctcacgtaccccactggagctgggctaagtaaaataggaaattggtttcaccgccctgaggccacattagacacctttggaagatggcactaacctgtctcaccctggacttaagcgtctggctctaattcaccacgtgctcttttctcctcacctgtatccacggttccctccccgagggagccacccacgttctcactgggtggcacacccacgtctctcttctctccacgctgactaaactttttttctgtaccagttaatttttcccactactaatagaataaaggcagttttcta

SEQ ID NO: 665679 - DNA, 231 bp, Homo sapiens
agagaattacggctacccgccgcagttacgatcattctatttccccgctcgtatgatccccacgtccaaatatctcatcaacaaccgactagtcagcacccaacaatgactagagtcaaagctgaagctcaagaacaagatgataaccatacacaagactagaggacgaacctgatctcttatactagtatccttaatcatttattattgccatttttattttcttctctg

SEQ ID NO: 665680 - DNA, 113 bp, Homo sapiens
cgtttccaaagacacaaagctctaagagttaattatgtatcatccaatccattccctacagagaaaacttttgcatgatagcaacttttaaatctagtctatcttggatatcc

SEQ ID NO: 665681 - DNA, 685 bp, Homo sapiens
gcgcggcccgatgctctccccacccccccagtccgttcgggaagggaggggctgggggctaggcgcccatcactccaggcacgggttcgtttctgggtggggggttgaaccccggatacatacccgtaccaagccgagggcaactttggagtgcccctggaaggctaggatccagatacttcgctgatgtgcttacgctgaagaatcacacacccgacagagcgtcttgcgtgcacacccctgtgctgggttcaggcaggctacgcacactgcgagcccatcccgtttccctgctttggcaatggaggagctacttaatggcactcaacctgctcgattaattggcagcttccagttgggctgtgcatgcaaccttgggactaacttctgttgcaaggggagtgcgcggaacagttgcttgcaatagatcatgatgcgcgaattgagataacacgaagaaaatcgattacatgcagagctggtaaatatcacatggaagaacaagtaggagccgcaagagcaagacacaaacatggtcagaaagaaatgagagagtagttgagcacatcaatgatcagacaactttttctatcaatctggcggtagtaaatagacaccttgagtagttgagattattaacattaatcgcgcacttgcaaacgagagaagaacagagaaaaggcgt

SEQ ID NO: 665682 - DNA, 592 bp, Homo sapiens
tagacctgaatcaccgaactctctaccccagctgtatatccaaaatgtcgcttaactaacaagctgacgctggacaagctggactgttaaatgggaagcgggtctgttatgatgagtcgacttcaatgttcctatgaatgaacaaccatgataacaaacaaccagaggattaatggctgctgtcccaagcatcaaattctgcttggacaatggatgccaagtctggtagtacctatatgagccacctagtgcctggcctgatggtgtgcccatgcctgacaagtactaccttagagccatgtatgctgtagaactcaaatctctgctatgggcaaggattgtacttgaactatgaagtgacttgtgtaagtgcccagaaatgtggagacatgcctgtgccaacccagcttgctgggtcttgtacatccttgcctggcgaacctccgcttaacatgtaggagctgaagacgggaaggggaaacagactgctaactgggaaccacggataaagcctgagccagccaaactagaagcatccgagcacactaccaagcaggggaagcattcaagatgcaaaggaacgacaagacca

SEQ ID NO: 665683 - DNA, 319 bp, Homo sapiens
ttgggttgtggcgcgtggggtgtgggcggggaagaacagagtctcgctcctgtcacccagtctagagtgcactggtgtgatctcggctcactgcagcctccacctcccaggttcaagctattctcctgcctcggcctcccgagtggctgggattataggagcgcactaccacacttggctggtttttgtatttttagtggagatggggtttcgccgtgttggccgggctggtcttgagctcctgacctcgagtgatctgcccgcctcggcctcccaaagtgctgggattacaggcgtgagctgtgccgcgcccacaacc

SEQ ID NO: 665684 - DNA, 200 bp, Homo sapiens
tagtgacaaaccccaaaagaagaaaaagcacaagccccaggatggttcctcaggcgaatggaatgaaagaaccatctatctctttctccaaacccgagactaccgcaatctttcaccaaggaggagtagatgagtagcgatcctaaagagaccgctgacagaacacagtatacccgagaggaagaagtctacacccaagg

SEQ ID NO: 665685 - DNA, 658 bp, Homo sapiens
ggtgctgagacctttgcaaaggatctccttcacgaggactggaactttatagtggagaaccacaatgggtagggtcaagaaatggctgtgaaagacctattctagagagaaagaggaaaaccttaactggtatggcacaatcttgaatgggatgacagagggcagcgggcagacttctcccgcaggtgacactcctgcctcaggtcccaatggttctgctgactccagatgttccccatagctgggaatcagagaggaaaacgtgtcgtgtttcacatgatcagacactgttcaccactggcacctggtgggcccgaaagatttagggcatccaggtcaaagttgaggcccggaggcatctctccagccagctcttttggaggatggcctaaatcttgtagctgctgcataaagatccagcaccatctcaaaacgagccttttgagtggttcactgtctgtggggggctctgcctcaaagtgctcacatattttggcccttacgctgtgctgctcctgatatcttccaactgtctggaagtgagatcccggtgatctttgagcctcttggaactttctggacccctcgggggggtacgccgactttcgagaaggctcgcaaaaccccttaggggggtccctcccaccttttatcaggc

SEQ ID NO: 665686 - DNA, 401 bp, Homo sapiens
ggcagtattgggctggcggacgtgtgctgcctccccagtgctcaaaatcacacctctaaaggccacgcaggtgggacccatcaagacattgcaaatcgatagaaggacggccaggaaggggaggggatcgaacctgtcaaaatagatattcagaaaatctgtgctctaaaataaggcagcccttccctcacagcacacttattccctaatttcaacaggagtcctagtcttgccccacagctgtcacagcctacagcaaattagaaactggggtggggggcggatattattccaccagtaatacccttgggacggggcacacaagatgtttgccctcctacctctctgtcaccttcccaagaaagggtcaagatgaaacagtgtgcgtatatggtatagcg

SEQ ID NO: 665687 - DNA, 332 bp, Homo sapiens
tggggcactggcatgtataactagacaatcgttaactaatgaaaactcaatttcaaaagtgggcatccagaggccaggcattttggctcaggcctatatccctagaacttgggaggctgaggtgggatgtattgcttgagctcaggagtttgagaccagtctgtgtcatgtatgtgcgacctcagtctccacaaaaagaagaaacaagccaaaaaaaaaaaaaaaaaaaaaggttatacccagtttttttttatagggccagacacccagttatgtgtttttaaggagctccattttggctctttgttctcccttagttattcacgggtggg

SEQ ID NO: 665688 - DNA, 269 bp, Homo sapiens
gttacccagcacaaggttgattttagaatatgtttcatgcgcagataagaagaatgtatattgtgttgctgggtgaagtgttctgcaggtgtctgtcaggtccacttggtaaagtatcaagtttatctcctgagtatctttgataatcctctgcctcaatgctctaatactgtcagtggggtgttcaggtgtcccatgattattgtgcattggctaagtctcttcataggtctctaagaccgttttatgattctgggtgtctccagtgt

SEQ ID NO: 665689 - DNA, 487 bp, Homo sapiens
  misc_feature (91)..(92): n is a, c, g, or t
tggagcgattttttttcaggttctcatcacatatggggaaagggtcattcccagagcaatgcctaatttagtaatttgcccatgttggggnnctgcaccgccagcccactagctaagcacagtccctcgacaaatctgctctgaaatctcaagtcctactgacgtcagaggcagctgatgtcactcagagaacagcagtcttgtcttggaagcctggatgtcagtgctggttctgcctttgtggcctgtgtgatttctgaccaactaaattccagttagctaatgttcagctttctatgaacaggtgtctgaaaatgaaacttgccctgctgtatcctataaactgtctgcactctgaggaagggtctgggctctagattctgattttatacccagtcccactggacaggagggactggggctgtttctgttttataccaggcctggtgacagaaagactgggaggggttggggggcgaaatggatt

SEQ ID NO: 665690 - DNA, 341 bp, Homo sapiens
atcatcccatccccacaggttatctaacgttggcgcaccttgttgaataattgcatggtgagtgaacgtcgagtcgatctcaaactcagggttataaagcgaaaggtcgtatattagctctagcagtcgctgcgagtgcgcgcgatctaattcaaattgctcatgagttttgtagttccaggtaatcagatgttgtgatttggttaagaaaaataagttgggatttatttgcattgttttcttcccattcttagggctgggttggcgtacaacccagcttgtcattaacgacttatttaggcattccaatcaatgcgaatgtcgacgcggccgcgaattta

SEQ ID NO: 665691 - DNA, 362 bp, Homo sapiens
ccggcgaatttcaagcgcgcaaatgtgattcttcttaatgaggcacatcatagagttgaccctcaggtgtgctggatggcacgctgggtatgttcagagtgactggaacttcataccgattgtcgttgggatcatgaatcttgaactgtagcatttcattcttatggtaagtgacattcaggcaaagggggttcacgggtgtgtaagggaaggcataggcatgcacagaagactttaaggagatctcagctgttgcccccttggagttatactaacatcatttacagagtataagtcgttgactaaatagcatacagggactcctgaaaaattggatgcctcccagattcggcacgggcagt

SEQ ID NO: 665692 - DNA, 268 bp, Homo sapiens
taatcccacgttatatgtctagatttgcctcttctggacaccttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaa

SEQ ID NO: 665693 - DNA, 347 bp, Homo sapiens
  misc_feature (1)..(1): n is a, c, g, or t
  misc_feature (9)..(9): n is a, c, g, or t
  misc_feature (161)..(161): n is a, c, g, or t
  misc_feature (198)..(198): n is a, c, g, or t
  misc_feature (206)..(206): n is a, c, g, or t
  misc_feature (264)..(264): n is a, c, g, or t
  misc_feature (317)..(317): n is a, c, g, or t
  misc_feature (334)..(334): n is a, c, g, or t
  misc_feature (343)..(343): n is a, c, g, or t
nagaccatncctcaaggacccgcagccgggacttatgccggttacaacaacatgtaccactacgcctgggggtggccactcggacatcgacctcatgggtgggacgagagcgggctgtggggcgtgttacgccaccaaccagaacgctgggcaacatcgtnggtcagtaggcttggaccccgtgttccttgcagaccntgcagacntggggacacgagcttaccccaagcgcaggccggggaggcttttattatcttgcggganttgttacgttaaccaacggttatttagggggtaccaaggttcattattggatnaccagaccattggcttncactattgnattt

SEQ ID NO: 665694 - DNA, 370 bp, Homo sapiens
cttgaacctgggaggcagatgctgcagtgagctgagatcctgcccctgcactccagcttgggcgacagagcgagaccatgtatcaaaaaaaaaaaaaaaaaaaaaaaaagcatggttggactttaaacctacccctcaatatcctccagaaatgtgcataagaacgcttgtcttcagcctgagcaacatggtgaaacccagtctctaccaaaagtacaaaaaattagccaggtgtgctggcacacacctatggtcctagctacccaggaagctgaggcaggaggatcgcttgagcaggggaggtgggggttgcagtgagctgaggttgcaccactgcactccagcctgggcaacacagtgccccctctct

SEQ ID NO: 665695 - DNA, 963 bp, Homo sapiens
  misc_feature (37)..(37): n is a, c, g, or t
caggcagtacacatcatcaattatattaaagctcgancacatcaatccagactattaaaacttttatgtgcggaactgggtgctcagcaacacagcacttcttctaacatacagaggtgaaggtggctttctcgaggtaaagttcttgtcacagactttttgaccacttcgtcgtgaactttcggtttccatggattctgcttttcgactatctgatgtgtctaccacacattcatccttggctggctaaggacttgcataatcttcgccagactgttatctcaactcaccttcaactcgacgtcactattgcgtccacactgccacacggaacaccatgtgcaccggtctacaaccagtcattcgcactccacactgtcgtccactgtcaacgaaaaacattggacatttcggggccctcatctgtaggccccgcacgcaacccctttggatgcgtttacctaaccactcaggtgactttttggactgacacttacttcttaccgttgataaaacgatattcgcaagtgccatgtggccgcaccttaaggcgttgcgccgctactctgttaaaatactttccggtaaccaaatgacactaatgctgtgggtcagaacttccatttcacacgttactgttacacacagcttcaatcagacaccggggactatgagaagcctgcatgatttacacttggcgtctcaaggtgacgcacacataaagtgaactttcactaacagatattggactacctactcggaatacccacgcatgcagggatcagtgcgtgacttttcctcgtaacatgcaccggtgtaacagctttcatataacgcgcccaccaacattcgacacgctgcgtgcctcatagcaccgctgcaaatcacctatcacggctgtgctacacacacaccgtctcacagcgacgcggtcgtcgacccgcctaaacacttccaaaccac

SEQ ID NO: 665696 - DNA, 251 bp, Homo sapiens
gcgagtagatcgagacatgtaagcagcatcatggaggtttgaagataccgcatttaggatggatgaataccaaattctgcttgctagctttctaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctt

SEQ ID NO: 665697 - DNA, 269 bp, Homo sapiens
gtcttgcagcaaagcacggccggataaatgactaggcaaaacgtagctcctggggtatagccatcattacaccagtagcgcctatagctctgacacatcccatactcagtgcttctgtctccaacattgtagtttgtcactcgtgtgttgtagtcactctcccatttggacaaacacatccagtttgctaggctgatacccctgtagccatccattcccaatcttttcagagttctggccaactcacacctttcaaagaccttgccctg

SEQ ID NO: 665698 - DNA, 238 bp, Homo sapiens
gacacccaatcttaatgaccaccatgtccttgggcatcattataaactggtacaccagcctctgtcctttcactttggccagtatgcctctttggtagtagtatcttagtgcccgccccattgtctcatagttcatgccaggcttgtttttctgcttcccccacagtttgaacacagttttggttccaccagttagaagatgcctttctctcgctgggtccacttgatgtacttggga

SEQ ID NO: 665699 - DNA, 532 bp, Homo sapiens
gaatacctgcatatagctggaataaacgttaaattactgttccgttatttgatttcttatccggctgctcccctatcagacctcatctttttgtgaatattattttttgtttacctccctccattcattcacatgctcatctgagaagacttaagttcttccagctttggacaataactgcttttagaaactgtaaagtagttacaagagaacagttgcccaagactcagaattttttaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcggattgaagttggggatcctctag

SEQ ID NO: 665700 - DNA, 244 bp, Homo sapiens
  misc_feature (88)..(89): n is a, c, g, or t
  misc_feature (92)..(92): n is a, c, g, or t
  misc_feature (95)..(95): n is a, c, g, or t
  misc_feature (98)..(98): n is a, c, g, or t
  misc_feature (100)..(101): n is a, c, g, or t
  misc_feature (107)..(107): n is a, c, g, or t
  misc_feature (109)..(109): n is a, c, g, or t
  misc_feature (115)..(115): n is a, c, g, or t
  misc_feature (221)..(221): n is a, c, g, or t
cggtacccattgcatatggcaaggccaaggagttgtgtaaggcagcggacatggtgcaggatatcaagatgaaccactagtgaggtgnngcntanggnannccttgncnttgcanttgcatatggcaaggccaggtcagaagatgaaccacgtgacgaaatagaaaaagctacctatggagttgtgcccctacgcaggtacttggccttgccatatgcaantatgcaggccttgccataataca

SEQ ID NO: 665701 - DNA, 168 bp, Homo sapiens
  misc_feature (24)..(24): n is a, c, g, or t
  misc_feature (59)..(59): n is a, c, g, or t
  misc_feature (69)..(69): n is a, c, g, or t
cccaggtcctgctgcccccctganaccctggcctcccgggcatgtacacagagtctctnggaggtctgncccagggtggtaacatgtgcgccatggttcctacttctcatagcagcgacagtgccaggccagcactgaccacctaaggtggacgggcgccttactatt

SEQ ID NO: 665702 - DNA, 455 bp, Homo sapiens
  misc_feature (255)..(255): n is a, c, g, or t
  misc_feature (348)..(348): n is a, c, g, or t
  misc_feature (407)..(407): n is a, c, g, or t
  misc_feature (443)..(443): n is a, c, g, or t
tctaccgtcatgctgaccggtaaaccaaaaagcgtaatggcctgatcaagaagatgtggtgctaaatcgtaccagataccgctgcctgggccgccctgttcacgccaacgatcgcgcacctgcgacggaagcggtcaaaatgagactcaaagtaagcaacttcacccagcacgccttccgcgagtaaaccttttagcgtcaagaaatcgctatcccagcgacggttatggaatacagacagcacacgccccaggntttttgccagcgcatccagctctcgcgcttgtgacagtgtcaggttaaagggtttatcaacgaccacattgtttacccgccttcaagcgccgnttttgggttaacggggaaatggggtatcgttggggtgttgggattgacattcaggtctntgtttgggttcgtttaaacagatgctttggctcagngacaaccgtcca

SEQ ID NO: 665703 - DNA, 116 bp, Homo sapiens
  misc_feature (6)..(6): n is a, c, g, or t
  misc_feature (10)..(10): n is a, c, g, or t
  misc_feature (116)..(116): n is a, c, g, or t
ggtgantctngaggatcccttcttatggcaaggccaaggtcagaagatgaaccacgtgacgaaatagaaaaagctacctatggagttgtgccctatcttggccttgccatatgcan

SEQ ID NO: 665704 - DNA, 355 bp, Homo sapiens
taaataaggggtccccctttttggtttgggcaaagaaatcccggtttcccagggccttttggtaaaaaaaagggcccttttcccttggataaggtggccttttgcccaagatttttgggcccaaaatgggaggggtttcttttggggcctattttattcccctgggcaaaaaaatcggttttttgcccgggccccccccggttggggtaccggagccttgggggaagtttttaaaaccccggggggggatccccccgccttttttttggttttccagaatggtttggggggcccggggtcccttgggtgggcaatggcttttgggggggggctttttttttttttttttttgcca

SEQ ID NO: 665705 - DNA, 287 bp, Homo sapiens
cagcgcatcttacgtgtaggtgcgcgagtgtctcaccactctgcacttccaggactctgtcatctgcctaggcgggaaatgctgtcgttggattgcaaccccgaggtggatggtctgaagcatttgctgaagacagggcctcggtcaacgcaccccggatccttgcaacagtcgcctgtccacttagccgcaggaagcgggctttgcttgctttcttctctggcagctgcaaaacggtcgctgacctcaagcagcaggtaactaggtaactgtcgctgtgtattccg

SEQ ID NO: 665706 - DNA, 264 bp, Homo sapiens
  misc_feature (183)..(183): n is a, c, g, or t
  misc_feature (203)..(203): n is a, c, g, or t
taagaatcctagctttaaagaaaagaactaggattttaggttaccagaaactggctctgagcggagaaactggctctgagcgggagaaactggctctgagcgggagaaactggctctgagcgggagaaactggctctgagcgggagaaactggctctgagcgggagaaactggctctgagcgngagaaactggctctgagcgngagaaactggcactgagcgggagaaactggctctgagcgagagaaactggctctgagcggg

SEQ ID NO: 665707 - DNA, 887 bp, Homo sapiens
ggatccaggcgtgagaccctgcatttcggggcatgatgctattgaacgactgtgtccgtgagtcctcaacttcaggatgttgacaagcattgctgccgatactgctgctgtctggctgggccttttgtagccataggacgcctcagatggccgtccaacagacttcatatgctccagatctcctacattccgcgtaggccctatcagcgtgtggtaccaggggcaacggcgttcgtctggggggacacctaacgcactgtgcgtgtgaaggcccatgacacacaatcactcgaacgatcaattcaagctgacagccacccttgagaggtagccccagaggagcttggggctgccgtcagcgccaatgaggtggaccctgcaaagctcgcgtaccatggcatccgagtttccacaggtccatcgatgcagacctggatgtcgaccacggagacggacgctttggaccttttccctcttggacgcgattccggctggctttcgctgcgggcgtgttgagctgcacgtccctgagggctcttagaaggccccatgtctttcttcggagaggtggaccttgtagacatgggggaagctaccgtttttgtagaggatattcctgggcctggcagacgaagcccttgatggccagggcaagactacaccaagggtcaccatccgggagatgggtcaacccttcacccctgacagtcaagcattcacacgtggccatagcaaatgccggtcgacttcggggtattgaaacctgagcgcggaaaatttcccttggaagggacaaccattgtgttggcaggtactggtggcaaggacaaccatattttcccgagcggacaccaacacgaaacagaatacttcctacttaaggaaat

SEQ ID NO: 665708 - DNA, 153 bp, Homo sapiens
aaaaaggggatgattttaggttgtcctaaattttgctgtccccccttccagggaaggggcattgtaaatgaataaaacattttcaactccttttggatttatccccccagaaacccttttttccctgtaataaatcaggatggttttttttga

SEQ ID NO: 665709 - DNA, 254 bp, Homo sapiens
  misc_feature (173)..(173): n is a, c, g, or t
  misc_feature (193)..(193): n is a, c, g, or t
gctgttgtaaggaaactggattgcatggctgcgtaagttaagatggcttctgttaaaaaccttagaatggcgggagaaactggctctgagcgggagaaactggctctgagcgggagaaactggctctgagcgggagaaactggctctgagcgggagaaactggctctgagcgngagaaactggctctgagcgngagaaactggcactgagcgggagaaactggctctgagcgagagaaactggctctgagcggg

SEQ ID NO: 665710 - DNA, 1390 bp, Homo sapiens
ggctcggtacttgcatatggcaaggccaagcagacgccccagggaggaacctggttttaatgggccctgtgctcagggaggccttcagtcagcagggtcgcctcagcagcatttgggagcctgccctgcagctccctgcctccaccctgcacgctgtgcccacacccccccacaacacgtaggtgaaagcacaggcaccatgcggaggccccgagcaccccttagtggggcggggtggggggaggaagtcagtccataatgttgtagttacggatcttggggggcctctggcagcctttagcttttgcaggatgagaccgggaggctcctgtggtcttggccttgccatatgcaattgcatatggcaaggccaaggacatcgggacctggctgcaggtgctggagaccatcggtgtgctggcggtcattgccaatgggatggtcattgccttcacatctgagttcatcccccgagtggtctacaagtaccgctatagcccatgcctgaaagaaggcaactctactgtcgactgcctcaagggctacgtcaaccacagcctgtccgtcttccacaccaaggacttccaggaccctgatgggattgagggctcagaaaacgtgactctgtgcagatacagggactaccgcaatccccccgattacaacttctccgagcagttctggttcctcctggccatccgcctggccttcgtcatcctctttgagcacgtggccttgtgcatcaagctcatcgccgcctggttcgtgcccgacatccctcagtcggtgaagaacaaggttctggaggtgaagtaccagaggctgcgtgagaagatgtggcatggaaggcagaggctgggtggggtgggggcaggctctcggcccccaatgcctgcccatcccaccccagcatccatcttcagtgccaggagcacagacgtgtagggccagagcccgtccagaggccaccaggagctgagacagtgccaccaccagcacctcccacaagcccaccgctgtgcgtgttgaggggtgctgtgagaaggctgtgcccatgtggggccgcaggaatcccctgtatgttcagggctgtgagctgccaccctattccgcctgctccgtctttgtgggggctctcaggcttggcacagccctgacttgaactctgggtgaccctgggcacccacagaactgggagtgagggctcctcaggcagccacaaggcaggaaaactggcgcaaatttcctgggcctccctctgacttctgggcgccagatcctgccgtgcccccatcctggctgttgggggtgtcctgagcccacctcgctggcctgttcccttcagccaacccgtttctgcagtaaaattaagcctgtctgtcttgcaaaa

SEQ ID NO: 665711 - DNA, 2922 bp, Homo sapiens
aaaccccagctggaactccggccacagccagcatgcagggcgaagagagcctccggatcctggtggagcccgaaggggacagcttcccgctgatggagatcagcacctgtgagaccgaggcctccgagcagtgggactatgtcctcgtggcccaacgtcacacccagagagacccccggcaggcgcggcagcaacagttcctggaggagctcaggagaaagggcttccacattaaggtgatccgggaccagaaacaggtcttctttgggatccgtgctgacaacagtgtctttggcctgtaccgcactctcctcctggagcctgaggggcctgccccccacgccgagctggccgcgccgaccaccatcccggtcaccacgagtctcagaatccgaatcgtgaacttcgttgtcatgaacaacaagacctcggctggtgagaccttcgaggatctgatgaaggacggggtctttgaggccaggttccccctgcacaagggggagggacgcctgaagaagacgtgggcgcggtggagacacatgttccgggagcagccagttgatgaaatcaggaactactttggggaaaaggtggccctgtacttcgtctggctgggctggtacacctacatgctggtgccggccgccctgacgggcctcttagtctttctgagcggattctcgctgtttgaggccagccagatcagcaaggagatctgtgaggcccacgacatcctcatgtgtcccctcggcgaccacagccgcaggtaccagcggctctcggaaacctgcacttttgccaagctcacccacctctttgacaatgatggcacggtggtgttcgccatcttcatggctctctgggccacggtgttcctggagatctggaagcggcagcgcgcccgcgtggtcctgcactgggacctgtacgtgtgggacgaggaacaggtgaggtggagctggcagcgcagctgaggccgacccgagcaggggctgttggcgcccgatgccctgcacggcccacatatgcctgccgtgtctgaggaggaaatggcacttcagctcattaactgccccgactacaagctccggccataccagcactcctacctacgcagcaccgtcatcctcgtcctgaccctgctcatgatctgcctcatgatcggcatggcccacgtcctggtggtctaccgcgtcctggcctccgcgctcttcagcagctcggccgtgcccttcctggaggagcaggtgaccacggccgtggtggtgaccggggctctggtgcactatgtgaccatcgtcatcatgaccaagatcaacaggcgcgtggccctgaagctttgtgacttcgagatgcccaggaccttctcggagcgagagagcaggttcaccatccgcttcttcacactgcagttcttcacccatttctcgtctctcatctacatcgccttcatcctgggcaggatcaacggccaccccgggaagtccacgcgcctggcgggcttgtggaagctggaagagtgccacgccagcggctgcatgatggacctcttcgtgcagatggccatcatcatgggcctgaagcagacgctcagcaactgcgtcgagtacctggtcccgtgggtgacccacaagtgccgctctctgcgggcctccgagtccgggcacctgccccgggaccccgagctcagggactggcggcgcaactaccttctgaacccggtcaacaccttcagcctgttcgacgagttcatggagatgatgatccagtacggcttcaccaccatcttcgtggccgccttcccgctggcgccgctgctcgcgctcttcagcaacctcgtggagatccgcctggacgccatcaagatggtctggttgcagcggcgcctggtgccgcgcaaggccaaggacatcgggacctggctgcaggtgctggagaccatcggtgtgctggcggtcattgccaatgggatggtcattgccttcacatctgagttcatcccccgagtggtctacaagtaccgctatagcccatgcctgaaagaaggcaactctactgtcgactgcctcaagggctacgtcaaccacagcctgtccgtcttccacaccaaggacttccaggaccctgatgggattgagggctcagaaaacgtgactctgtgcagatacagggactaccgcaatccccccgattacaacttctccgagcagttctggttcctcctggccatccgcctggccttcgtcatcctctttgagcacgtggccttgtgcatcaagctcatcgccgcctggttcgtgcccgacatccctcagtcggtgaagaacaaggttctggaggtgaagtaccagaggctgcgtgagaagatgtggcatggaaggcagaggctgggtggggtgggggcaggctctcggcccccaatgcctgcccatcccaccccagcatccatcttcagtgccaggagcacagacgtgtagggccagagcccgtccagaggccaccaggagctgagacagtgccaccaccagcacctcccacaagcccaccgctgtgcgtgttgaggggtgctgtgagaaggctgtgcccatgtggggccgcaggaatcccctgtatgttcagggctgtgagctgccaccctattccgcctgctccgtctttgtgggggctctcaggcttggcacagccctgacttgaactctgggtgaccctgggcacccacagaactgggagtgagggctcctcaggcagccacaaggcaggaaaactggcgcaaatttcctgggcctccctctgacttctgggcgccagatcctgccgtgcccccatcctggctgttgggggtgtcctgagcccacctcgctggcctgttcccttcagccaacccgtttctgcagtaaaattaagcctgtctgtcttgcaaaa

SEQ ID NO: 665712 - DNA, 266 bp, Homo sapiens
gaacggatgtttccccctccttttccaacctctacccccccattaggggatttttctataaaaacagtggaaccccagccctaaagtcctgctgaaataaagtccttttgttttaattggttttaaaaaaaaaaaaactacttttggtccccttagctatgaggggggggcaaattcagggatttaagactaatgattttgttttgttttggtccccaaagagcaaatcaaaaaaaaattacagcaagaaaaaaaaaggggtttta

SEQ ID NO: 665713 - DNA, 1518 bp, Homo sapiens
ggctcggtacttgcatatggcaaggccaagcagacgccccagggaggaacctggttttaatgggccctgtgctcagggaggccttcagtcagcagggtcgcctcagcagcatttgggagcctgccctgcagctccctgcctccaccctgcacgctgtgcccacacccccccacaacacgtaggtgaaagcacaggcaccatgcggaggccccgagcaccccttagtggggcggggtggggggaggaagtcagtccataatgttgtagttacggatcttggggggcctctggcagcctttagcttttgcaggatgagaccgggaggctcctgtggtcttggccttgccatatgcaattgcatatggcaaggccaaggacatcgggacctggctgcaggtgctggagaccatcggtgtgctggcggtcattgccaatgggatggtcattgccttcacatctgagttcatcccccgagtggtctacaagtaccgctatagcccatgcctgaaagaaggcaactctactgtcgactgcctcaagggctacgtcaaccacagcctgtccgtcttccacaccaaggacttccaggaccctgatgggattgagggctcagaaaacgtgactctgtgcagatacagggactaccgcaatccccccgattacaacttctccgagcagttctggttcctcctggccatccgcctggccttcgtcatcctctttgaggtgagccagaaccgggagaggcctcggagtggttctgggcagtgctctccccagtccttctccccggccctgaacccccaaatgccagctggcacctgaccgtgctgggcctctcctgtgcgcgctagcacgtggccttgtgcatcaagctcatcgccgcctggttcgtgcccgacatccctcagtcggtgaagaacaaggttctggaggtgaagtaccagaggctgcgtgagaagatgtggcatggaaggcagaggctgggtggggtgggggcaggctctcggcccccaatgcctgcccatcccaccccagcatccatcttcagtgccaggagcacagacgtgtagggccagagcccgtccagaggccaccaggagctgagacagtgccaccaccagcacctcccacaagcccaccgctgtgcgtgttgaggggtgctgtgagaaggctgtgcccatgtggggccgcaggaatcccctgtatgttcagggctgtgagctgccaccctattccgcctgctccgtctttgtgggggctctcaggcttggcacagccctgacttgaactctgggtgaccctgggcacccacagaactgggagtgagggctcctcaggcagccacaaggcaggaaaactggcgcaaatttcctgggcctccctctgacttctgggcgccagatcctgccgtgcccccatcctggctgttgggggtgtcctgagcccacctcgctggcctgttcccttcagccaacccgtttctgcagtaaaattaagcctgtctgtcttgcaaaa

SEQ ID NO: 665714 - DNA, 415 bp, Homo sapiens
ggggggagggtaaaaaaaaaattttaaaaaaaaaaaaaaaaaaaaaaaaaaaaaaaaggaaaaaaaaaaaaaaaaaaaaaaaaaaaaaaaaaaaaaaaaaaaaccttgtggcccgcttggccccagtcgcttttaaactgggccaggtttttccttggggccgaatttggggctaattgggccatttgcccttatggggggccgttttccatttaatggcccgcggtttaaaaaggtcgaactgggaaaaccctgggggtaccccaattaaatggcttggaagaaaatccccttttcccaggttggcttaatagcaaaggggcccaaccggttggcctttccaaacagttgcccaccttgatgggcaatggaaatttgaaggcgtaaatttttggtaaatcggggtattttggtc

SEQ ID NO: 665715 - DNA, 1292 bp, Homo sapiens
  misc_feature (1211)..(1211): n is a, c, g, or t
  misc_feature (1231)..(1231): n is a, c, g, or t
ggctcggtacttgcatatggcaaggccaagcagacgccccagggaggaacctggttttaatgggccctgtgctcagggaggccttcagtcagcagggtcgcctcagcagcatttgggagcctgccctgcagctccctgcctccaccctgcacgctgtgcccacacccccccacaacacgtaggtgaaagcacaggcaccatgcggaggccccgagcaccccttagtggggcggggtggggggaggaagtcagtccataatgttgtagttacggatcttggggggcctctggcagcctttagcttttgcaggatgagaccgggaggctcctgtggtcttggccttgccatatgcaattgcatatggcaaggccaaggacatcgggacctggctgcaggtgctggagaccatcggtgtgctggcggtcattgccaatgggatggtcattgccttcacatctgagttcatcccccgagtggtctacaagtaccgctatagcccatgcctgaaagaaggcaactctactgtcgactgcctcaagggctacgtcaaccacagcctgtccgtcttccacaccaaggacttccaggaccctgatgggattgagggctcagaaaacgtgactctgtgcagatacagggactaccgcaatccccccgattacaacttctccgagcagttctggttcctcctggccatccgcctggccttcgtcatcctctttgaggtgagccagaaccgggagaggcctcggagtggttctgggcagtgctctccccagtccttctccccggccctgaacccccaaatgccagctggcacctgaccgtgctgggcctctcctgtgcgcgctagcacgtggccttgtgcatcaagctcatcgccgcctggttcgtgcccgacatccctcagtcggtgaagaacaaggttctggaggtgaagtaccagaggctgcgtgagaagatgtggcatggaaggcagaggctgggtggggtgggggcaggctctcggcccccaatgcctgcccatcccaccccagcatccatcttcagtgccaggagcacagacgtgtagggccagagcccgtccagaggccaccaggagctgagcgggagaaactggctctgagcgggagaaactggctctgagcgggagaaactggctctgagcgggagaaactggctctgagcgggagaaactggctctgagcgngagaaactggctctgagcgngagaaactggcactgagcgggagaaactggctctgagcgagagaaactggctctgagcggg

SEQ ID NO: 665716 - DNA, 231 bp, Homo sapiens
agtgaaaaaagaagtctcaagaaaaaacaatcagcaggcatatatttattttagttgttataagttgttggccaggcacagtggctcacttctataatcccagtacattgggaggctgaggcaggaggatcggttgggcccaggaggttgaggctgcagtgagccatgatcatgtgatcacgccactgcactctagcctgagccacagagtgagaccctctctgtgaaaat

SEQ ID NO: 665717 - DNA, 534 bp, Homo sapiens
  misc_feature (98)..(98): n is a, c, g, or t
ccgacccgagcaggggctgttggcgcccgatgccctgcacggcccacatatgcctgccgtgtctgaggaggaaatggcacttcagctcattaactgcnccgtccagaggccaccaggagctgagacagtgccaccaccagcacctcccacaagcccaccgctgtgcgtgttgaggggtgctgtgagaaggctgtgcccatgtggggccgcaggaatcccctgtatgttcagggctgtgagctgccaccctattccgcctgctccgtctttgtgggggctctcaggcttggcacagccctgacttgaactctgggtgaccctgggcacccacagaactgggagtgagggctcctcaggcagccacaaggcaggaaaactggcgcaaatttcctgggcctccctctgacttctgggcgccagatcctgccgtgcccccatcctggctgttgggggtgtcctgagcccacctcgctggcctgttcccttcagccaacccgtttctgcagtaaaattaagcctgtctgtcttgcaaaa

SEQ ID NO: 665718 - DNA, 787 bp, Homo sapiens
  misc_feature (433)..(433): n is a, c, g, or t
  misc_feature (529)..(529): n is a, c, g, or t
  misc_feature (764)..(764): n is a, c, g, or t
ggctcggtacttgcatatggcaaggccaagcagacgccccagggaggaacctggttttaatgggccctgtgctcagggaggccttcagtcagcagggtcgcctcagcagcatttgggagcctgccctgcagctccctgcctccaccctgcacgctgtgcccacacccccccacaacacgtaggtgaaagcacaggcaccatgcggaggccccgagcaccccttagtggggcggggtggggggaggaagtcagtccataatgttgtagttacggatcttggggggcctctggcagcctttagcttttgcaggatgagaccgggaggctcctgtggtcttggcctttgcctgggctgctgtcttcatccctggggtggcaatgcctgcctgcatcttgacgggcctcctgtcggctgctggaggagctgggagcncggaggctgcatcacggaaggcgggcacacaggcctcacttgggcgagaagagacccagagacgcatggccttcctcctgggccggctcccgaccngagcccatctgagctcagcccacaggaaggggaggtgccaagaaccccaagcacaggtggctgcaggctggtgggtgccgaggaggccactaggaggctgagacggtgagagccagggccaggcagtggcctgagagctggacagcctctgggtatctccacaccccacccttctcctgcctttcagaagataaacgcaccgcgaacgccccgccgcccaggcctcgctaccttnagtactcagggtctgccgtcgtg

SEQ ID NO: 665719 - DNA, 133 bp, Homo sapiens
caaggggtcattacttatggagtttagaaaactttcaagttcgtgacatatgttaagtgcacttaaatagacagggagagaaagatttataaagggcagtcattcaaagaggatttttacagttggggtgtgc

SEQ ID NO: 665720 - DNA, 782 bp, Homo sapiens
gagacgcagtctccgtcgtgacgttagtcgcagtcttcgccgctaacgttgtatgagtggctaaaatggtgaaatgctgctccgccatggatgtgcttctcgctgctgtgcaaaattcgaagttaaaaggactgacatttcacgtattccccaagatgaaaacatcaaaaggaaatgggtattagcaatgaaaagattgatgtgaatgcagcggcatttgggagcctaaaaaaggagatgtgtgtgtccgaggcatttaagaagacagatttgtgacagaagtgtccaaatattaaagctgaaacctggagtcatactttctatcttgtgattctccatatcacctacaggggacaaagagaaaaaccttcatgtgtagaaaaaatttcaccctcaaaaccgttccagccactaactacaatcaccatctgtgttgggtgcttcctcatgtattgaagaattccaatcccagttcattttgtgaacatagctacagttgtaatggacagtccaaagaaaacttaaagcataaattagatcatgtgatcggcgagctaggaggatacaacgggacagtctacggaaatgttttagaccggggaaaacgttttcagaactccattggggaagacactcagggacttaagggttactgtctgatccgcaagaaccgcaaatgatggccttctcgtgggcctgtggccgggagcattgacaggtattttcgggacatttgtgtcgttcccaaatggttggccacttttaaatcttccccaatttcc

SEQ ID NO: 665721 - DNA, 858 bp, Homo sapiens
cagagagggtgcccgcagtgtgcattgctatatattgggggtcccgcaagatcgatgttagcacccggggaaagattaaacgtcgtggtgctacgccccgctgacgattgtagccacaattatagttgcccctggtcgacccgcgtaggtgttgggcgacagaacaaagaaggtgtgggtttataagaaggcggaagattagcccctgcgtgagctccgtttgatatgttgcgcccgttaatgtatggtgcgtccacccgcccccacgatcgtaccgctatttacatcagtggcgtattatatactacccctgttctcccttcggtcaagtgggcgccgaaaattcgcagtgtctatgtagccggcgagagaagcaccttgtggtaaattaaacccgatcacgtctgatctcacacgatgttttttaaaaacatatagacggcgtcatcgattatgttagccactacgagatatacagacagcaccatttgtgttggtagaatgctgtccaccagataaaggagcaccgtatgtatatgcttatacgcgaagaccacacaaagatagtaggagaggggccacacctacattcgttagcccacacacacctattacaggctgatagaacataagtgtacgaaattatgtgttggcccgcagtcgtcgattgtggtggtgcaggagttcggttttacttaatgagcgcactccggcagatagaccttcgtgatgtagaaagacagtggtacccacttatactttgtagtgcacactgtagagtgcatgtctttaaaactgtagttgtgtgaatacctctctctgtgaagatatattataaagaagaaacataaaaaaaac

SEQ ID NO: 665722 - DNA, 844 bp, Homo sapiens
gtccgtgatgtccgggtcttaagcgcggcgctatctcttcccttgtccttctgcactcttcgggacgcgcctctgtcctattctctcctcctggtggtcatttttctcccgcgggcgcctgcgtttccccccgcaattgggcctctttcaccctttgtggttgtccaacgccccggggcgcctggccgtgctgtccccccggtgtgttggccccgcctctgtaacacccccttctttctggaggtcctccgcattcttcatggaagcgggccccaccagcactgggctacactctcgctccggcaccatacggaggtccccttggccaagcatcttttgtcccgcgagccagcaacccacgtaattgcgggtgcctgggcgtaacccccccgtcaggcccgtgtcgccccccagaggggccgcccccagaagtcccctgcctggagcactggagtgtccctcaaccttttctagcccttatggaaggtgattagggtccacaaacggtccacccgaggtcagtcagcgagcacacactttcttccctgcactcagggaattcaccccaactttttgtgacaggagggtcccaatgtacgagcacccgaagcacactgtgcgaagtctgtcaaccaccaaccctggcgcaaccatcagtctcccctgatcttttttatcgatgagcttccccactcttgtgagcaatctcgtcgaggacgacacgcataggaataacccgtatttcccagaggaggggagaaaaaactattttaggccaaccccaacagtcctttcgcttgcaccccgcctttcaaagatttcccctccccccccacataacaca

SEQ ID NO: 665723 - DNA, 1968 bp, Homo sapiens
  misc_feature (120)..(120): n is a, c, g, or t
  misc_feature (162)..(162): n is a, c, g, or t
  misc_feature (232)..(232): n is a, c, g, or t
  misc_feature (780)..(780): n is a, c, g, or t
  misc_feature (947)..(947): n is a, c, g, or t
tagtactacgctcgcagagtgactgtgtctattatgctatgaatgagctatactgtctccaggaagtcttctcctcctcgctgcatgcgaaacctggtacaaccatctatcatagccaanatccatcattgcactccatgtatatgtcggtacataagtagngctaatcagcatatctaaaaaacatatagaagaattcaccctgctcatttgtcagctgttctggagctcnccttgaggtattgagccgcatgtgctactcacgtcatgtaccagtgcgcagagacgctgtcttgcgtcttgtacatgacatgcattgccaatacatgtatggcactgcttaatcgtgcaaagtacatatagtacctcaaaaggtgcatgcatacaccctgtacatgggtaaattcatggtaagggcaccctgtgtgcatgccctctactttctccttcaagaatccattcgttcacaaatactatgaatgcgacggggcattgatataggagtgttagtgcttgtatagagcccgacacaacactatgcctataaggactatagatacgtctgtgattacacttaagctacgcgtacgatactctcttgaatccacggaccaaatgaagcgggagtggggaaggtaagatttcaggggccatactataccttcattcgcggtgaaccaagaaacgccaccataattagctaatttaaatcgcttacttatcctgataaaaattttctaatatccatttattctccttactaatatatactagctcctnaaaaagcttttaccatgaatcccccgttcgaaatttttcggcgctaatcctaaatcatacttaaaggctttgtgatgatattatccttccaacaaggccccaaacgctagcggacaacactctttcattcttaaccgtttattttcttcttgaccccttgtggaaanaacctaaaaggcatgaagacaatttagtcaccgctaaagaacaaaccccccgtatgagatgtaattctctgggtaccacaactcggcgatctcggttcattttcccttgttaaagtatgctgtgccattgaggcaccttacggcagatataaaccccgtggtcatttgtggtgtggccacaccaaaaaactttgtgggggccaattttcaattcggcacgcaggacacattgtccatgtgcaccagatgtggaccctagcgtaagtctcctatgcgaggtacgagatacccccattggggccaggatccaattaaggacgcatggcacgagtactaggccccattagcacatgaaagaaggacctgtcgtaacaattgttgtagagccgctggaggggcataaatatccttaccagtggcgaagcgtttgataatttctccacgaaaatatgttggccaccatgatttccacagtcaattggttgtgagaacatatatatgcagtagagcagacgcgtgtgcacacaactacacagaagcagaggccacagcacacaccaaggtgtacgtcgtcaccacagatacataatagggccatagaaaagagggatataccaccaagacggggggaatccgccggcataaaaaagaggacgccatgtatatgggcagcagcaaaacgtagaccaagagaatcgagagcgagacacgacgagaacgacatcgaacaagaaggaaatgaggagcggagcgcagagacgaacgaaacgcggagccgagattcacacgaccgggatagtgcgcacatgtagtacagtcgaaagacaagggcgacgaaacaaacgaaacgacgagaagttagacacacaagagtggatctagtgcagcactccacatgaagtctaagacgacgtagaggacagaggacagaatgaacagacagcggcgacagtcgacgcgtacacagagaaggctaggaagcagctgaggagcacagcgaccgaagcgcggaggtgggaga

SEQ ID NO: 665724 - DNA, 889 bp, Homo sapiens
  misc_feature (30)..(30): n is a, c, g, or t
  misc_feature (65)..(65): n is a, c, g, or t
  misc_feature (68)..(68): n is a, c, g, or t
  misc_feature (101)..(101): n is a, c, g, or t
  misc_feature (103)..(103): n is a, c, g, or t
  misc_feature (116)..(117): n is a, c, g, or t
  misc_feature (137)..(137): n is a, c, g, or t
  misc_feature (141)..(141): n is a, c, g, or t
  misc_feature (143)..(143): n is a, c, g, or t
  misc_feature (145)..(145): n is a, c, g, or t
  misc_feature (148)..(148): n is a, c, g, or t
  misc_feature (169)..(171): n is a, c, g, or t
  misc_feature (177)..(177): n is a, c, g, or t
  misc_feature (189)..(191): n is a, c, g, or t
  misc_feature (199)..(200): n is a, c, g, or t
  misc_feature (204)..(204): n is a, c, g, or t
  misc_feature (206)..(206): n is a, c, g, or t
  misc_feature (213)..(214): n is a, c, g, or t
  misc_feature (235)..(237): n is a, c, g, or t
  misc_feature (247)..(247): n is a, c, g, or t
  misc_feature (257)..(258): n is a, c, g, or t
  misc_feature (262)..(263): n is a, c, g, or t
  misc_feature (268)..(270): n is a, c, g, or t
  misc_feature (282)..(282): n is a, c, g, or t
  misc_feature (286)..(286): n is a, c, g, or t
  misc_feature (289)..(289): n is a, c, g, or t
  misc_feature (293)..(294): n is a, c, g, or t
  misc_feature (297)..(297): n is a, c, g, or t
  misc_feature (300)..(300): n is a, c, g, or t
  misc_feature (308)..(308): n is a, c, g, or t
  misc_feature (314)..(314): n is a, c, g, or t
  misc_feature (320)..(320): n is a, c, g, or t
  misc_feature (341)..(341): n is a, c, g, or t
  misc_feature (366)..(366): n is a, c, g, or t
  misc_feature (377)..(377): n is a, c, g, or t
  misc_feature (380)..(380): n is a, c, g, or t
  misc_feature (829)..(829): n is a, c, g, or t
  misc_feature (874)..(874): n is a, c, g, or t
ggggagaaacgacttcaaaactgcgatagngctacttatcggtgggtatctggtgattcttagtnggnacaaatgccctgcctagcccccttaactgcgtnanttcacagatgganngttttgttgttggtgttgtngggngncnggnttgccttacacgtggggaggnnngaccancttgagtgaaannncgcggtgnntttnantttgttnntatgtgtgttttaatgcaacnnncagctcacantttccaagtnntttnnttttnnnttgcatcatgtntttnttntttnngtnagntcttaaantgaacntcattnttcatggtatccacaaatttnctatctgtcactatttattaattcnttccatcaaangancttaaactagagaattaagcccactttatgaagagcgatttcacggctgcttgaaccattcgaatttggatttgtgttcagcactttaaaaggttcaactttttgcttctacccagattggtctcaggtctgtcttctcatccatccctttctaaagccaaagcacatttgtagcacataatccaggagaagcagaagtaaatgctatgactggtggtatttcttagcctggttttgtagtttttaggcagtaagtagattatgagcgaacaaatgtgaaggttcatgtggagtcataatacctgtgatctaggtatggtcttagtcaagctcagagacaacaaagccttctaggtcattaggcaatggtgggtttctagcaccatagactgtctactgacctcatttttcttttggaatggagttagacatggggagctcaaaaaganagacctagcaattcatttgagtggaagacacacatcaaagctgtnacaggcatgtagatt

SEQ ID NO: 665725 - DNA, 118 bp, Homo sapiens
tttcggctgactctagaggcgcgtaattctgcaccacagccttggttggtataaggcaggagtatgtatgacggtcatctgtgatgagcagtggctcaccaccgtcttgaacgaggtg

SEQ ID NO: 665726 - DNA, 364 bp, Homo sapiens
tcttcccatgagactgctggtgtcttctccagtgaggcctcatcctgcgagaactcatacagggtgaccgaggcaccgtccagcatcttctgagcggacacatgcagacaatggggctcgggggccaacctcagcaagacctcaggaaggacggacacaggcctacacaccaggccacagacaatggggctcggggggccaacctcagcaagacctcaggaaggacggacacaggtctacacaccaggccacagacaatggggctcgggggccaacctcagcacagacctcaggaaggacggacacaggtctacacaccaggccacagacaatggggctcggggggccaacctcagcaagacct

SEQ ID NO: 665727 - DNA, 737 bp, Homo sapiens
aggccttctttcgaaaggcctctgacttggcatacaggcgcaggttgcagtagtcagaggccttctttcgaaaggcagatggacgtgagccctgccccgtggtcccaggcagtggagggacagatccggagcctgggtcagagaactaatgaaaggaagcatcgaagaacggaagaccaggaaggcacatacgaagaaaaagaagagagagaagcacatgtacggcgaactcagacgatagccagacagggacagacccagaaaagcaaacaatgacaaacaagaacacataagaagagacaaaaagagaaaaaggacagagaaagaacacagagagaacaaaacaaacaaagaaaaaaaaaaggaaaaaaaaaaaagtaaaacacatagacaacaaaaagaacaaaaaaaacagaagaaaaaaaacagaaagaaaaaaaaaagaaaaagaagagacaaatacaagaaaaaaagaaagaaaagagacaaagagagaaaaaaaaaaaaagaaaagaacaaaaaaagaaaaagaaaagaaggcacacaaacaaacaagaagagagaaaaaaagaccaagaaagaaaaaagagaaaagcaagagaaaaagaaaaacaaaaagaaagaacaaaacaaaagaacaaacgaaaaaacaaagaagaaagaaaaagaaaaagagaaagaaaacaccaacaaaacaaacaaaaagaaagatacaagaaaaacaaaaaaagaagcac

SEQ ID NO: 665728 - DNA, 176 bp, Homo sapiens
gctgtacagtagtattgatcattaaattgtactggcaccctgattgtgacgcactcatagctaatctaagctgagtgtctattgctccagcgtacactataatcaacagcaaagctaaggagctgcaggcactttatagcctgtaaagcctgaaatattttactatcaactcatca

SEQ ID NO: 665729 - DNA, 326 bp, Homo sapiens
catgcaactctgcctcccgggttcaatgtgattctccttgcctcagtctcctgagtagctgggactacaggtgcgtgccatcaggcctggctaattttcgtattttaagtagacatggggtttcaccagtgtgggccaggctggtctcgaactcctgacctcatgatccgcccgcctcggcctcccaaagtgctgggatcatacggcgagagccactgtgcccagcgaagcagggtcacttttcaagggtggtaagctagctggggttagaactaaacggcagagagccattccatacctgtagttctagctactggcggaggcca

SEQ ID NO: 665730 - DNA, 485 bp, Homo sapiens
tgtttcatggctcttttcggtgtccccatgtattacgaacgtacagtttctctccctcctcccctcatatgcactatgctcagatttcattatggtgcggcccatgtacattcaagtgtgatacttggcacatgaaaacattcaaacagtctctgtggaaatctgagagaaattggaggaaagctgccgagatgcattcctcctgtagtagctacaagctaatgcttcatcctctctaataactttagatagacaggggctagtcgcacagaactctgagaagccctggaaaaacgcagatccttgtttgacgatctcaagcgcagagtctgcaagttcatcccctctttcctgaggtctgttggctggcggctgcagaacattggtgatgacctggaccacgccatttgtggccctcatgtctggctcggcaacaggctccttgttgacactcaacacattgttatacaagctgacttccagct

SEQ ID NO: 665731 - DNA, 840 bp, Homo sapiens
  misc_feature (42)..(42): n is a, c, g, or t
  misc_feature (71)..(71): n is a, c, g, or t
  misc_feature (86)..(86): n is a, c, g, or t
  misc_feature (98)..(98): n is a, c, g, or t
  misc_feature (126)..(126): n is a, c, g, or t
  misc_feature (128)..(128): n is a, c, g, or t
  misc_feature (130)..(130): n is a, c, g, or t
  misc_feature (136)..(136): n is a, c, g, or t
  misc_feature (181)..(181): n is a, c, g, or t
  misc_feature (274)..(274): n is a, c, g, or t
  misc_feature (299)..(299): n is a, c, g, or t
  misc_feature (314)..(314): n is a, c, g, or t
  misc_feature (319)..(319): n is a, c, g, or t
  misc_feature (321)..(321): n is a, c, g, or t
  misc_feature (392)..(392): n is a, c, g, or t
  misc_feature (445)..(445): n is a, c, g, or t
  misc_feature (450)..(450): n is a, c, g, or t
  misc_feature (594)..(594): n is a, c, g, or t
  misc_feature (702)..(702): n is a, c, g, or t
  misc_feature (726)..(726): n is a, c, g, or t
  misc_feature (730)..(730): n is a, c, g, or t
  misc_feature (744)..(744): n is a, c, g, or t
  misc_feature (769)..(769): n is a, c, g, or t
  misc_feature (788)..(788): n is a, c, g, or t
  misc_feature (804)..(804): n is a, c, g, or t
  misc_feature (818)..(818): n is a, c, g, or t
  misc_feature (827)..(827): n is a, c, g, or t
  misc_feature (831)..(831): n is a, c, g, or t
tttggtttcgtggtgtcccaacaaaaaatcccgttggcacgntaaacctcatgaactgggagtgcgccatnccgggaaagaaaggnactccgtgggangaaggcttgtttaaactacggatgcttntnanagatgnttatccatcttcgccaccaaaatgtaaattcgaaccaccattttntcacccgaatgtgtaacttcgggaacagtgtgcctgtccttctaagaggagaacaagaactggagcccagccataacaatcaaacagatcctnttaggaaaacaggaacttctaaatnaaccaaatatccaanacccngntcaagaagaggcctacacgattaactgccaaaacagagtggagtacgagaaaagggtccgagaacaagccnagaagtttgcgccctcataagcagcgaccttgtggcatcgtcaaaaggaaggnattgntttggcaagaacttgttaacaacatttttgcaaatctaaagtagctccaaacaataactagtcacctgggggggttgagcgggcgccatcttccattgccgccgcgggtgtgcgatctcaattcgctaaattgcccgtttccanacagggtctcttcttcggtcttttgtatttttgattgttatgtaaaactcgcttttattttaatattgatgtcagtatttcaactgctgtaaaattataaacttttanacttgggtaagtcccccaggggcnagtncctcgatctgggangcaggcatccttctcaccgtgcagngctgcacttggcctcagcntggctgtatggaaatncaccctccctcctnccgttcctntctngaaccttct

SEQ ID NO: 665732 - DNA, 336 bp, Homo sapiens
acccagagttaggatcgtggctgagcgtttacatgggagtcatatcgctgagagcgtgcgccagctcctcgctgatggctttgtacttcagcttctgagcgtacagctcgtcttgtaagccatcaatgcttttctgcaatctagatactgacctctccgcaaactcagcccgagtctcagtctccttcagctggtcgtgaaggaccttgatctcttcctcatatctgtcttccttctgcgagtacttatcagcctcagccttcagtgacttcaagacccgcgtcacagttctcaattgttcttcaagctcgtgacattggccttctgagagctcag

SEQ ID NO: 665733 - DNA, 150 bp, Homo sapiens
acctgtttgttaacaagtcaccaagggctggaaaaccagatactcttcagggttgacacaaaaaataggcacttaatttgctcctgagtgtgagccaccagggaaggcctcacccggagattagcaggtcagggccctcccgccgcccag

SEQ ID NO: 665734 - DNA, 609 bp, Homo sapiens
atttgtggtgggaggactttgcatgatccagatagttgtaggatcccagtgtagtaggagttatctacccctcagtagtatggccaacctgggcagtcctgcaagtgatagattagataggttttgagatctggtaagtgggtgtagtttcaacatcagttgctgcttctcgccacacagcgatcgagaccatagggggccagcactagtggcagctgggggtagccttcttcccgctaggtaacgtggaggtcacctgtgaaatacaccagtagttgttgcatgccaacagttccacgccagttgcctgccacacagccttgactcactggactagggctaagaacttgccagtgaggctgccgcacaagcactccagaagtggttgggcaggcactcagacctccgaggcggctacaaattcaggccacctcacttagggtttcagtcacgccagagtttgtctctgagggtgtgcagttttagttactgttgcaaatagatatagtaaaaatttaatttcaaatcaaaaactgtcctcccaccacaaacgtgggatccgtgcacgttaacgattactaggacaggaaaatcctttctgggttgttt

SEQ ID NO: 665735 - DNA, 486 bp, Homo sapiens
  misc_feature (463)..(463): n is a, c, g, or t
ggctcggtacttgcatatggcaaggccaagcagacgccccagggaggaacctggttttaatgggccctgtgctcagggaggccttcagtcagcagggtcgcctcagcagcatttgggagcctgccctgcagctccctgcctccaccctgcacgctgtgcccacacccccccacaacacgtaggtgaaagcacaggcaccatgcggaggccccgagcaccccttagtggggcggggtggggggaggaagtcagtccataatgttgtagttacggatcttggggggcctctggcagcctttagcttttgcaggatgagaccgggaggctcctgtggtcttggccttgccatatgcaagccaaggagttgtgtaacaaagatggaagatgaaccacgtgacgaaatagaaaaagctacctatggagttgtgcccctacgcaggtacttggccttgccatatgcaantatgcaggccttgccataataca

SEQ ID NO: 665736 - DNA, 458 bp, Homo sapiens
ggctcggtacttgcatatggcaaggccaagcagacgccccagggaggaacctggttttaatgggccctgtgctcagggaggccttcagtcagcagggtcgcctcagcagcatttgggagcctgccctgcagctccctgcctccaccctgcacgctgtgcccacacccccccacaacacgtaggtgaaagcacaggcaccatgcggaggccccgagcaccccttagtggggcggggtggggggaggaagtcagtccataatgttgtagttacggatcttggggggcctctggcagcctttagcttttgcaggatgagaccgggaggctcctgtggtcttggccttgccatatgcaagccaaggagttgtgtaacaaagatggaagatgaaccacgtgacgaaatagaaaaagctacctatggagttgtgcccctacttggccttgccatatgcaagtag

SEQ ID NO: 665737 - DNA, 609 bp, Homo sapiens
accaccgttatagaggatccctctctgctcccagattcttgctagcgtcatcaatttggtggatcttttcaaaaaaaccaactcctggattcattgattttttggaagagtttttgtgtctctatctccttcagttctgctctgatcttagttatttcttgccttccgctagcttttgaatgtgtttgctcttgcttctctagttcttttaattgtgatgttagggcgtcaattttagacctttcctgcttactcttgtgggcatttagtactataaatttccttctaaacactgctttagctgtgtcccagagattctggtacgttttgtcttttgtcttattagtttcaaagaacttatttatttctgctttaatttggttatttacccagtagtcattcaggagcaggttgttcagtttccatgcagttgtacagttttgagtgagtttgttaatcctgagttctaatttgattgcactgtggtctgagaaactgttatgatttttgttcttttgcatttgctgaggagtgttttacttccaattatgtggttggccaattttagaataagtcgatgtggtgcgagaacaaggttatctattgctt

SEQ ID NO: 665738 - DNA, 2556 bp, Homo sapiens
  misc_feature (2140)..(2140): n is a, c, g, or t
  misc_feature (2143)..(2143): n is a, c, g, or t
  misc_feature (2147)..(2147): n is a, c, g, or t
  misc_feature (2149)..(2153): n is a, c, g, or t
  misc_feature (2156)..(2157): n is a, c, g, or t
  misc_feature (2177)..(2177): n is a, c, g, or t
aaaccccagctggaactccggccacagccagcatgcagggcgaagagagcctccggatcctggtggagcccgaaggggacagcttcccgctgatggagatcagcacctgtgagaccgaggcctccgagcagtgggactatgtcctcgtggcccaacgtcacacccagagagacccccggcaggcgcggcagcaacagttcctggaggagctcaggagaaagggcttccacattaaggtgatccgggaccagaaacaggtcttctttgggatccgtgctgacaacagtgtctttggcctgtaccgcactctcctcctggagcctgaggggcctgccccccacgccgagctggccgcgccgaccaccatcccggtcaccacgagtctcagaatccgaatcgtgaacttcgttgtcatgaacaacaagacctcggctggtgagaccttcgaggatctgatgaaggacggggtctttgaggccaggttccccctgcacaagggggagggacgcctgaagaagacgtgggcgcggtggagacacatgttccgggagcagccagttgatgaaatcaggaactactttggggaaaaggtggccctgtacttcgtctggctgggctggtacacctacatgctggtgccggccgccctgacgggcctcttagtctttctgagcggattctcgctgtttgaggccagccagatcagcaaggagatctgtgaggcccacgacatcctcatgtgtcccctcggcgaccacagccgcaggtaccagcggctctcggaaacctgcacttttgccaagctcacccacctctttgacaatgatggcacggtggtgttcgccatcttcatggctctctgggccacggtgttcctggagatctggaagcggcagcgcgcccgcgtggtcctgcactgggacctgtacgtgtgggacgaggaacaggtgaggtggagctggcagcgcagctgaggccgacccgagcaggggctgttggcgcccgatgccctgcacggcccacatatgcctgccgtgtctgaggaggaaatggcacttcagctcattaactgccccgactacaagctccggccataccagcactcctacctacgcagcaccgtcatcctcgtcctgaccctgctcatgatctgcctcatgatcggcatggcccacgtcctggtggtctaccgcgtcctggcctccgcgctcttcagcagctcggccgtgcccttcctggaggagcaggtgaccacggccgtggtggtgaccggggctctggtgcactatgtgaccatcgtcatcatgaccaagatcaacaggcgcgtggccctgaagctttgtgacttcgagatgcccaggaccttctcggagcgagagagcaggttcaccatccgcttcttcacactgcagttcttcacccatttctcgtctctcatctacatcgccttcatcctgggcaggatcaacggccaccccgggaagtccacgcgcctggcgggcttgtggaagctggaagagtgccacgccagcggctgcatgatggacctcttcgtgcagatggccatcatcatgggcctgaagcagacgctcagcaactgcgtcgagtacctggtcccgtgggtgacccacaagtgccgctctctgcgggcctccgagtccgggcacctgccccgggaccccgagctcagggactggcggcgcaactaccttctgaacccggtcaacaccttcagcctgttcgacgagttcatggagatgatgatccagtacggcttcaccaccatcttcgtggccgccttcccgctggcgccgctgctcgcgctcttcagcaacctcgtggagatccgcctggacgccatcaagatggtctggttgcagcggcgcctggtgccgcgcaaggccaaggacatcggtcagaccgggcgggcgcaggatgggcgggaactgggcggcctcaggcctgtgggcttcccgctggccaggccggctcacctggaaaaaataatctctcggatctcaggccgcagacagcccccagcccttctccgacggcctcggatgcgggttgagcctgggtgggagggtaccaggagtgggcggggccgagcgctttgtaggctcctcccacaaaccgtcanganctcngnnnnnctnnacgcccccaagggggacccnggttctgccagtggctggggctggaacagagcagccggcctctgtcccaagactggccacgctgagacggacaggcagcaggggagcgacgggagctggggcgctggatgtggggaaagggagagaggtgttagggaggcccccagtctcgggcccaggttacaaggtcttaccctggggtgggaacccaggaggtggagtggcttgggggcacagctgagaagttcaggaagatggaggatgaggattcccaggttcctccctgtccatgtcaggctgaggggtgcaggagcacaagaggccatgctctgccatggctggggacttcctttgtgaatactgcaagcctagggctgcaaggggacaacacgcacagaga

SEQ ID NO: 665739 - DNA, 460 bp, Homo sapiens
  misc_feature (44)..(44): n is a, c, g, or t
  misc_feature (52)..(53): n is a, c, g, or t
  misc_feature (62)..(63): n is a, c, g, or t
  misc_feature (87)..(89): n is a, c, g, or t
  misc_feature (97)..(98): n is a, c, g, or t
  misc_feature (437)..(437): n is a, c, g, or t
gagccatcatgattctcgactggataattgtcatctctaattcncctgaagnntctcagctnngctctagacctgatcagtatacannngttcttanntggaaaaccccttgggtccaccctgcacgctgtgcccacacccccccacaacacgtaggtgaaagcacaggcaccatgcggaggccccgagcaccccttagtggggcggggtggggggaggaagtcagtccataatgttgtagttacggatcttggggggcctctggcagcctttagcttttgcaggatgagaccgggaggctcctgtggtcttggccttgccatatgcaagccaaggagttgtgtaacaaagatggaagatgaaccacgtgacgaaatagaaaaagctacctatggagttgtgcccctacgcaggtacttggccttgccatatgcaantatgcaggccttgccataataca

SEQ ID NO: 665740 - DNA, 636 bp, Homo sapiens
  misc_feature (20)..(20): n is a, c, g, or t
  misc_feature (37)..(37): n is a, c, g, or t
cggttgtttaaaaaacccanactgttttagttattgnggctttatgatgttcctttcctgattttcattgttaatttattcagtgaatttagtaaccctgagcaaaagcctatttatttttctgtgcaaaatcaattttaattccatggtctgctagtcactcacatattacatttctctattagttataaagtaaaataattgcagtaatgatttaagaagcaactggagctcaaacgaaattttaatcctagtggattttcccatttggaattaataatgtattgaatagagaaattgcctagatccaattgccatagacatgcatccattattgtaaatacagctggctctctgtatccactgattccatatccacaggttcaaccaaccacagattgaaaagactgggggaaaaaactcaaaaacaacaaaaaaagaacacaatagtaaaaactaatacaaattttttaaaaaatacagaatacagtgtaacaactatttacatagcatttacattgtcttaggtattataagtaatctctagagatgatttaaagtatacaggaagatgtatataggttatatgctactatgacatttatttgcagatactgagggacagctctatcatct

SEQ ID NO: 665741 - DNA, 225 bp, Homo sapiens
tacactagtatggctagtagaggaatagcacagtgtttccctagtttataccatcccctgcaaactgcagagtggcactcattgcttgtaggacggaccagctcctccaaggctctgaaaaggggcttccagtccctgtacaccttgccctgccttgcctccgggagccaggggcttgtgcacttggcaggtcccttgcggtacccagaacaaccgtcgaagggg

SEQ ID NO: 665742 - DNA, 839 bp, Homo sapiens
  misc_feature (827)..(827): n is a, c, g, or t
ggctcggtacttgcatatggcaaggccaagcagacgccccagggaggaacctggttttaatgggccctgtgctcagggaggccttcagtcagcagggtcgcctcagcagcatttgggagcctgccctgcagctccctgcctgcctgggctgctgtcttcatccctggggtggcaatgcctgcctgcatcttgacgggcctcctgtcggctgctggaggagctgggagctctctatgaccagagagtgaagcgtctcactgaagaactgtggccggcgtctccaggaaaggaaggagcctcgctttctccagggcaggggcagcgtggggcggggcaggccgggtgtgtctgtggggagtgggcgcgtgctcacactctttaagctgcgactgcttcctttacgacaggatgaagttctggagttgagtcaccctgggaggtgacaccagaagggctggatcccaggtctagcaacctccacgtgtcctggagggtgccactggcaaaggaggaggagctgtgggattggcgaccatgctcctcagggtgcttgggagcctggggtggctttggggacctgtcttctttctgccgaggtgatttacaggtcaccgtgtggatgctgtgttgtgtcttcgggccttgcagggcgttaagtccgctgcccacctgtgctgagcggggctggtgctttcccaagtttcttgaaggagcctcatcctcggcactcttggcgtcctgagatgtaaaatggggctgcacctgtcccaaaggtgggctgcgatccaaaggcctcctgggctcctcgcctggcttccgggcctcangggcaggaggga

SEQ ID NO: 665743 - DNA, 687 bp, Homo sapiens
  misc_feature (20)..(20): n is a, c, g, or t
  misc_feature (37)..(37): n is a, c, g, or t
cggttgtttaaaaaacccanactgttttagttattgnggctttatgatgttcctttcctgattttcattgttaatttattcagtgaatttagtaaccctgagcaaaagcctatttatttttctgtgcaaaatcaattttaattccatggtctgctagtcactcacatattacatttctctattagttataaagtaaaataattgcagtaatgatttaagaagcaactggagctcaaacgaaattttaatcctagtggattttcccatttggaattaataatgtattgaatagagaaattgcctagatccaattgccatagacatgcatccattattgtaaatacagctggctctctgtatccactgattccatatccacaggttcaaccaaccacagattgaaaagactgggggaaaaaactcaaaaacaacaaaaaaagaacacaatagtaaaaactaatacaaattttttaaaaaatacagaatacagtgtaacaactatttacatagcatttacattgtcttaggtattataagtaatctctagagatgatttaaagtatacaggaagatgtatataggttatatgctactatgacatttatagggattcatggattttggtatctgcccacggggccctggatctagattctttgcagatactgagggacagctctatcatct

SEQ ID NO: 665744 - DNA, 482 bp, Homo sapiens
tgcggtcactctagagatcccctcagcaccatggaggatgtcagcagcatggcgtgttggtgtctattgtgaggctggggtttaaagatcatctaggggccaggcccgatggctcacgcctgtaatcccagcactttgggaggccgaggcgggtggatcacctgaggtcaggagttcaagaccagcttggccaacatggtgaaagcccgtctccactaaaaatacaaaaattagccaggtgtggtggcaggcacctgtagtcccagctactcaggaggctgaggcaggagaatcacttgaacctgggacgtggacgttgcagtgagccaagattgcgccaccggactccagcatgggtgacagagcgagaatccatctcaaaggggggacacatcatctaggtcaagccgaccacagatttatgtgtgcagtccagccacgatcaggcaactttgggcccatcctccatgggggtgaggggt

SEQ ID NO: 665745 - DNA, 295 bp, Homo sapiens
gggttagctgtgttggcaggctgtcttgaattcctgacctcaggtgatcagactagctcggctcccaaagtgctgggattacagacgtgagccgccgcgcccagccagcagatttttatttttttaaaccacggggcattcctaggcacggtcacaaagcagaaatccataaggtagatctcattttctatgtaagatatactgggaaatttggttttttggagacacagtctcacggtatggcccaggcacgatctccactcacggcaacctcagcctctcaggttcaagcaag

SEQ ID NO: 665746 - DNA, 142 bp, Homo sapiens
ggctcggtacttgcatatggcaaggccaaggagttgtgtaaggcagcggacatgtgcaggatatgaagatgaaccacgtgacgaaatagaaaaagctacctatggagttgtgcccctacttggccttgccatatgcaagtag

SEQ ID NO: 665747 - DNA, 569 bp, Homo sapiens
  misc_feature (437)..(437): n is a, c, g, or t
  misc_feature (459)..(459): n is a, c, g, or t
gctggccaggctctaccttatctggctatctctgccacaaaccctttcctagccacacactagggagcggggcagagcgtcaggtggtgggatttcatctagaccaacctcagcactatggacatcggggaccagataatgctgggtggggggggccggtccggtgtgtaataggatgtaaagtaacatccctgggcctccacccccaccatggtgacaaccaaaagtatctccagccagggccaaatgtcacaagaggggcaaaaccttcccgtacggagagctagtatgggggccatggaccaccgggaggttagccaatcagagcagaaggggggggcggaaaggaaacggggtcttagttccacaagtaaaataggctttagggtcaggcggccctgcagatgagtgggtcctgattctgtcccccagtcggngaggaaacgggatatccgtggnagcagctgccatgagacacctccccacacgtgccgctgaggaggagctggggggccatgggtggctggcccaccttgtcaaaatactggcagaggagggctctggtctct

SEQ ID NO: 665748 - DNA, 127 bp, Homo sapiens
ggctcggtacttgcatatggcaaggccaaggagttgtgtaaggcagcggacatgtgcaggatatgaaatagaaaagctacctatggagtgccttggcctgccatatgcaaggtaccgagctgattta

SEQ ID NO: 665749 - DNA, 127 bp, Homo sapiens
  misc_feature (123)..(123): n is a, c, g, or t
taaatgttttgatttatataatagtataattatatttgtgtagggctagggctaggattagttcagagtgttcattggtcatgaaatcttctgggtgtaggccagatgctttaatatttagcnctac

SEQ ID NO: 665750 - DNA, 1352 bp, Homo sapiens
gtcatctggaggagatttgcattctctttccgctcccaaaggggaggacattgaaactgagtggcccacgatgggaacaggggaaacgcgccaggggtacaaggatggcctctgaggtgaaggcagaggctatagcatgggagttcggagcgacctatggacctgtgggccttagacgcgatctttggtgctgtcatgtactgtacactatcgatcgatctggcttcacgcgtgctccatgtctgcgtggcttgtacaaggacgtgccggcgaagcacgtccggttgtcaaccaacccagcaacgatcgcaacacaacttgtgtgctgtcaatgccctcatgtgatctcctcgagccatcctagagttcgtggccgcaccaatgcgtaacgcacgtggaaaccaagagacatgaagctagcggcagtaacccgaacacactcatgccagctggtcgagacgccaatgggacagtgcgctacggcggaagccgagctccctgaacactcgatagtggtcgatagtagcgccaaaacaccgaacgcatataaagcaccacagagacactcgaagactccctaattggtgggggcccgcgacccaaggggcgcattgaccccaatctgagggacgcccctaggggcctaggggaaggggaaagccaagccacacaggcgaggcccgcatataagaatgcccaggcgcactatgcgcctatggcacctttcgcttgttaaccaaaaacctccgggaggagctgataaacagtagtttgggcaatttgcccgccccgggaaaaggggtccggtggtcacactccataggaaaggcgaaattccactcctttgcgggtctccatacgttcctacgtgccatatgcgcaaacccatgctgagcgcttcgtcaatttggctatagggctaggcttggaattggaatgcccggtcctggcaaggagttgggggactcggctttgtcagaaggaggacgtgcctggtggaggatttcgccctttttttaacctggacacctccgaccgagattggtgttggcgctggctccattgggggcggcgctggtgatgtgtctttacccccgaaaggtggggaccaaaacccgcggggtgtttgttgtctcccctccttacaacatggccgcccacaactgaaaatgggtctttggatttgggcccagatggagtcagaactcagtgcgttgaattcaaccgcgattggtgcaccccttggggtttacgtttaatttagacttcgtagagatcttggctaaccccagtttccattgggaaattatgtctcttgggaactcaaaagacggacatagtggggggggaga

SEQ ID NO: 665751 - DNA, 1193 bp, Homo sapiens
ggtgtgagtgctgtggtctctgctgcgtgactgcctggtggtgcctggcgctggtgtgtggctgcccccgtgcctcgccgagtgcagctgctgccctgaatgtgccatgttgcctgctgctcctgctcctgctgtgccctgtgctgcccatgtggttgtgtgctgtgtggatgtgcctgcctgctgcatgtcttgcctgcacttgcttacaacctgcctgtgctggcctgtctgtttctgctgttccctgcttttcctgtgccacctgctgtgctgcccaattcttttgtatactgctgctggaatgctgcctggctggtaatgtggttgtggaaccccaatgctgggcacgacgcctgctgtgggatatttgctgtgccctggcctgaaccattgcccggtccagtacccctgcctagactgtgagttgggctgcgttgtgttgttgctcccgatggcaaacacaatgaacccttgggatggcagttgagactgtgctggcaacagacagttaccatacagtgcaaagacgtgtgtgcgactttcaaagcctgttccctggaataccgttttctggagacagcagtgcgcgaaccttccacctggttgacatggcttttacacgatgttgacgccaatatgcttccacctggccagccaaaagggaccgcgagaaagataggtttataagttacggaattattcgagaaagaagagcaccaagcgcagattaagtttggagccgcaaaggagagtttggttaaccagaaagtagggagaatccgttatgcctaataacggtggcaagactggagcacaaagagcgaagacgttcgtaaattaagcagacagtgagaacattggtggggaagttttttatacccagtttacatttagccgtttggcgcacccgcttgacacacagttaacagtgaaacgagaacaagttccaacaactggcccccccttggggccccagcggagaccaagcactttcccacagccaaaccctttggcacacgcatgaaacgcctagtgtttttgggagatccattgggattcccgtcccagcgtttatgcccgaaaacggcagcgcgcgcacgttcggtatttcgagcccagacgcgtttcggctggggaaaggagagatccttggagactttcccactgcagctgagacctcagcgggggag

SEQ ID NO: 665752 - DNA, 377 bp, Homo sapiens
gtttacttatagcactgctatatttgtctttatctgccctgtgatttcgcttcctgtccttcaaaggtcttttatcgtaattctaaaggaaaaaaacagtgtattcttatttgataactaggcaaaatcatttgccattgtttatttcataaatatttattcttctatctcatacactgatcaggtatactttaaaaattctgcattactcttgcctctcatgtacttaatccagttatcaattattgtaaaatgttaactggagatactgcattcagtcggaccacttaacacttaccaggaatgttagtgattcatctgatctagtaagtgaccatgtaagctataaccttgtgatagctaattccatctatttg

SEQ ID NO: 665753 - DNA, 246 bp, Homo sapiens
tgccctgagacctctgatccctgccctctcctccccgtgcccggtccggcgtgttctgtcctacctcacgtgcggggagcggcatcggtcgagcggtcagtgtacgcctggccggagagggggccaccgtatctgtctgttacctggagcggacagcggcacaggagacagagcgggtgctgggcctgccagggagcaaggaggggccgccccgagggagccatgctgtcttccaggctgacgtgt

SEQ ID NO: 665754 - DNA, 544 bp, Homo sapiens
ataggcggatcacatcgcagattaggggctggagaccggcccggccaacacagcgaaaccccgtctccaccaaaaccaatcaggcgtggcggacgcgggcctgcaatcgcaggcattcggcagactgaggcaggagaatcaggcagggaggttgcagtgagccgagatggcagcagtacagtccagctacggctccgcatgagagggagaccatggggagacggagacggagacggagacggagacggagagggagagggagagggagacttttaaaagaaactgacatttgtattgatataatatggtggaggcccaggttcaccacgtggtccccgctgatctagtaacaggtctgcagggatgaaattcctggataccctacttggctttctgtctccaccttggaaggggtatagagtgcttaattacagctatgagaggttggaaatctaggctccccacttggcctttgctagaacgggtaggttaaaaccacagtattaacttggtgtatggctggggtagattggttatagtctaa

SEQ ID NO: 665755 - DNA, 104 bp, Homo sapiens
aacactgggaatatttatcacaatccaagagtcaaaactattgatgccaatcactagtgtctcatgcctgtaatcccagtgctttggagtaggccaaggtaggt

SEQ ID NO: 665756 - DNA, 406 bp, Homo sapiens
  misc_feature (322)..(322): n is a, c, g, or t
  misc_feature (358)..(358): n is a, c, g, or t
  misc_feature (393)..(393): n is a, c, g, or t
ctgaaagaaaaaaaaaaagcctagactatatataaccaagaaggtgaaacatctctaccaggggaactacagaacactgctgaaaaaaataatagatgacaaaaattaatggaaaagcattccatgttcattaattgtaagaatcaatattgttaaaatggccatactgctcaaagcaattacatattcaacgccaatcctatcaagctactaacatcttttttcacagaactagaaaaaaactactctaaagttcatctaaaaccaaagaatagcctgaattgtcaaagcaattctaaacaacaacaaaaacaaagctggnggcatcacattacttgacttcaaactgtaccacagnctacgatagcaaacagcatgcaaaacagacatagntcatggcacaaaa

SEQ ID NO: 665757 - DNA, 141 bp, Homo sapiens
ggagcccttcccaacatggctgttggtcatggagatcctcaatggtcacgctggtgcccctacggaaacgcaccaggaacaaaatgtcagtggcaggtgggagttcaagttgccagcatggagaaccggtgtgcattggat

SEQ ID NO: 665758 - DNA, 166 bp, Homo sapiens
gttctttttagtgtaatattaataaaaggggtaaaaggatattcattttaagaaaaccatatattagtaacctgtagcctgtccttataggtagaccgtaaacaaggtcttcacagtatgaacatgatggaggcagcagcatccgaagccttgcttgaagaacact

SEQ ID NO: 665759 - DNA, 868 bp, Homo sapiens
gacagtttgatgcatctcaattcagccaaggccctgtgcctggcacttgtgtgactggatcccacagtcgggtcttgtcccacaggacctccccagaacccaccttctgcaccctattgtggcattgtttttcagggagctcattaagctctgaacagtctggctccattgcaacatcctggaggctttactaaccaggccttcttgttgggcaccttccctagagctggattctcccccaaggcttaatttctctcttcctacaagacccttgattccccatcagaaggtagggggtcttattcatccctctgcttactctccttttcattttcaaccttccgcaagcctctttttgactgccaaccctttagggcctgccaaatgggcctcttgtttaaccttgaggctctttgccggtcagagtcccggataccccagtagatctctgtctctctagaacgaatcagtaggcagtctcgaagggcagtgtcggattgtcctgtcattgctttacaaagttctgaccacagacagttgattgagcttatcaagaagtactttcagaacagcctgctgtttaccaactttacttgtgcttccccagattgccagttttcccgtgctttctgtcagtaccagcagcgcactgcaatattgtgcgccccaccccttgccggatgctgttcctggccggaactcctcaggttcaagacagggggatgggtctggggcctaaccccgcatggcggctttaatctttacacacggtgtcgcgcgttctaacaacagggtcacccttgtgtgagggagcagttctgcgcattccacacccgggtatgatcttccgccgcagggaggggcctcc

SEQ ID NO: 665760 - DNA, 161 bp, Homo sapiens
aacaaaggtgcctaagcaagacggggcactagaagtatgcctacacaaagacaggtatgtagactagatagttaaatgacatggagggagagacgaggcctgtgatgtgaggatctctgtttcttggctcagatccgtaagtaggcacagagtttacctgg

SEQ ID NO: 665761 - DNA, 1948 bp, Homo sapiens
  misc_feature (313)..(313): n is a, c, g, or t
aatccattccgatccggacatttatctgtgctatctttgatgcttgtccctatgtgctattcatttctggtactgtactactgcatctagaatcactcctagttggacttgggcaatctccgtgcgtccttgtgtgacatcagctggtgcgtgcatcttcgtcgtgtcgccatgtgtacggcatggcagtaattcgatgttccctagcctgattttcgagtctacagtcctgattgcgtgcgtcgtcgtggcctctctgtcagcctctctctggtggagctagtgtaccccacggtaacatctctcgtctcgngactacgtcaggcgctcgccggattcacaccttcatatactgattcgtgaccaatgaatgtgcccacaactttttccatgccgagggtggcgcacgcgataccgatagttctgccctcgacgtggcgcaagtcaatcagtcattcagacgagaattcattcactgaggcgtagtcctgtactatcgaggtcttgctaagcacacggaaggtgtccagtccatttgcacaaccggtgggcaaagtaaaattctccccattcgccttcatacatatccttcatttgctctccccatttcaagatccttttctttcttgctaacttccaacatttcacctctctttgcaaggctttcgaagaacggtttgttcgcagttgtcgtttttgcccccttctaaatgtgattaacgtttcgtgtctcagagggaatttggaagggctcccctaataaattaacgatgtataaccgtattttggtatggaagggatgtaacctctcggacgcttggagggcggtcaggttcctactttccaattcgcggtccccacacttccaaaaaggggaaaaacacgagggcggaacaggtcaccctcttatcggaaaagcgcgtcttgaatcgagaggaaccccgcttgtttaaaatgcctgatagttttacaacacgatagcatatcctgaaagggctaactttcccttcaaagttgaggacagaacctattattgtcgcgttccgacatatcatagagctgtatataactttccaagggcagtataaagggtggtgaaaatggggcataacagcgaaagggggcttttagttgtgtccaccacccggtggtgtggagagactcactctttgggggtcactgctcttgaaacgctttccccacggcatcggatttcaccccgtgtggtccaccagggattcaaccatgaggaaataaaatctcgcccctgaaaaaaacgtttctttggtgccattctccccagtgggggcctgttaactaaatgagaggggccctaaaaaccaatgatactcttgtcatcacggttttccatgcaaccaggtgatgaactacgcggcgcgccttttttatcaccacccaactaaccagaaggaagaagatatttccaccaatgaaaaatttgtcgggctattatagcaagaacagacggaccttagtgtgatctacacggtgtagtagtagccgcgacaaacataagtaccccccaacggattgaattagtgaggagacaaactagtatatcaccagcagtcaacaacatgtggacagtgacagagaagagtcaacaaggaaaggcgcgaatcataatgagggactagtatcacaacagccgctggtagatagggagggagaaagaaatagcctagtggtgtcgtaaactaagacagaactaaacacctctcacccacttcggtgtataagtagacgctgctacacagcaagagcgagtaaacatgatatacattacaaatgatgagctagacagcaccagtcgacttaccattctaatgttttgcttgtacacttttatcatacttacaagacaaatagaagagaagcacgaaaacgcagagagaggagaagagcgaggagggagagcgaggaagga

SEQ ID NO: 665762 - DNA, 107 bp, Homo sapiens
ctctagcaggatcccccgactttaatacttccaacgatgtatccagttgtgagggcaacgtctaggttgccagcagcctgcggttaattccagctccgtgatcagcg

SEQ ID NO: 665763 - DNA, 192 bp, Homo sapiens
atccactctccctactgtatcctagcctggattgtactgccatgatctcagctcgctgcaacctccctgcctcgggctcccgtgattctcctgcctcagcctcccgagtagctgggattataggcatgtgccaccccacccagctaatttttgtatttttagtagagacagggtttcaccatgttggccagg

SEQ ID NO: 665764 - DNA, 713 bp, Homo sapiens
gggtatctgtgatgatcttatccgaaacctgaacttctgttgaaaaaaaaaaatataaaaaatcatcaaaaaaaaaagcctcactcgaaacataaaaaagaacattaaaacaatgaattggaaaataaaaaaaaaataccttgtgggccgcctgggccaagcatattttaattttgacaaagttaagggggggggccaaaattaagcccccttgggcaaattgaccttatagggggtcgtataacatttaacgggccgcgttttaaaacggatggaatgggaaaacccttgggatacccaaattaaatccctttgaagaaattccccttttcgccattgggggaaaaagcaaaaagccccgccctgatggcctttccaaaaagtggcccaccctaaagggcaaatgaaatttgaaacccttaatcttttggaaaaatcccggaaaatttttggtaaaacaacctaatttttaacccaaaaggccaaaatcggaaaaaccctttttaattaaaacaatttacccggtatggggttgggtgtttttcccgtttgggaacaagggccccctttaagaaccggggccccaaggtaaagggggaaaaacggctttaaggggaaaggccccttacggaaaccctcccttaataaagtttttggggggaaggggcccaaaaaccaaaaaagggacccttaaggggccccccatttaaaac

SEQ ID NO: 665765 - DNA, 452 bp, Homo sapiens
ctgttcttgaggatccccctatctgtacagtacctggtttgggggaaactgccaggaactggcatgggcaggtctgttgcgccccagaggttggaggattctgggggtgagagttccttctttggcaagggagagggtggcacaaagcccaggcagaggggtcagctcggggtgagaccatgactagcagtactacttcccaccctgaacagaatccagggatgctctgtcctggacacgtcagaagctggggttgacggtggccctcgggtcaaaggtcaggagctagatgtgctggccagggtcagaggtcaggaggtcggaggctgatctctgaggtcaggaggcagagatgggagtgctctacagggtcagagggcagggagtggggggactgttctgtggagtcagaggtcaagatgtgggagctgccttcagcctgttgccactcc

SEQ ID NO: 665766 - DNA, 150 bp, Homo sapiens
gacacgacagcataatgagagtagagaatttttttggccaggcgcggttgcttacgcttatctttctattcctatgtccagcactttgggaggccgagacgggttatacgaggtaggagattgagaccattcttgctaaaagtaaacccg

SEQ ID NO: 665767 - DNA, 427 bp, Homo sapiens
ctatgtgaggaagacacggcatttagggctgaggatgtgtggtccgaacgcttctgctccatgactaactgctgttcgctctacgcctaggaacaagaaggccaggaagcccgcgcacatgcagcaaggctcttaaggataccggaaaaacacccgtggagccggacgtggcaattcaccggatacgtatcaccctcacaagccgcaactgtaaatacttggaaaaggagagtgctgacttgataagaggcgccgaaggaatcttatagcgaaaggaccagttcaattgcctaccaagacttagagaatcactacgattacgccgtgtggagaaggttctaatacgtgggatcgattccagagtagaattgacgcgactcattggcttgcacagcccttatgagattgttcagcatattagttcctc

SEQ ID NO: 665768 - DNA, 674 bp, Homo sapiens
  misc_feature (12)..(12): n is a, c, g, or t
  misc_feature (94)..(94): n is a, c, g, or t
  misc_feature (97)..(97): n is a, c, g, or t
  misc_feature (99)..(99): n is a, c, g, or t
  misc_feature (102)..(102): n is a, c, g, or t
  misc_feature (115)..(115): n is a, c, g, or t
  misc_feature (119)..(119): n is a, c, g, or t
  misc_feature (131)..(131): n is a, c, g, or t
  misc_feature (152)..(152): n is a, c, g, or t
  misc_feature (158)..(158): n is a, c, g, or t
  misc_feature (177)..(177): n is a, c, g, or t
  misc_feature (181)..(181): n is a, c, g, or t
  misc_feature (184)..(185): n is a, c, g, or t
  misc_feature (218)..(218): n is a, c, g, or t
  misc_feature (223)..(223): n is a, c, g, or t
  misc_feature (225)..(226): n is a, c, g, or t
  misc_feature (228)..(231): n is a, c, g, or t
  misc_feature (242)..(242): n is a, c, g, or t
  misc_feature (245)..(245): n is a, c, g, or t
  misc_feature (281)..(282): n is a, c, g, or t
  misc_feature (287)..(287): n is a, c, g, or t
  misc_feature (289)..(289): n is a, c, g, or t
  misc_feature (301)..(301): n is a, c, g, or t
  misc_feature (318)..(318): n is a, c, g, or t
  misc_feature (329)..(329): n is a, c, g, or t
  misc_feature (333)..(333): n is a, c, g, or t
  misc_feature (349)..(349): n is a, c, g, or t
  misc_feature (381)..(381): n is a, c, g, or t
  misc_feature (386)..(386): n is a, c, g, or t
  misc_feature (389)..(389): n is a, c, g, or t
  misc_feature (392)..(392): n is a, c, g, or t
  misc_feature (407)..(407): n is a, c, g, or t
  misc_feature (484)..(484): n is a, c, g, or t
  misc_feature (552)..(552): n is a, c, g, or t
  misc_feature (674)..(674): n is a, c, g, or t
ttttttgagtanttcggctatgggaactgagaagcctgaggtgatgggggctctgccttaggcctcctcttcggcctcctcaccgaaatcctcntcntnttntggggtggcatcntgtnttttgttgtttntcagagacgaggtcgttcatnttgttntcagcctcggtgaattccntttngtnnatgccctcgcctgtgtaccagtggaggaaggcnttccngnngnnnntggcagtgaantgntccgagatgcgcttgaagagctcctggatggctgtnntattncnaatgaaggtgantgccatcttgaggccangaggtgggatntcanagacggctgttttganatttttggggatccattccacaaagtagctgntgttnttnttntgcacgttaagcatntgctcatcgacctccttcatggacatccgaccacggaagacagcagccacggtgaggtatcggccgtaggcggaggnaaaaaaaaaaaaacatgttcttggcatcgaagacctgctgggtgagttccggcactgtgagagctcgntactgctggcttccacggctggtgagaggggcaaagccaggcataaagaaatggagacgtgggaaggggaccatgttgactgccaacttgcggaggtcagcattgagctggccagggaaacn

SEQ ID NO: 665769 - DNA, 1121 bp, Homo sapiens
gggcgtgatgtctcacagaaagttctccgtgtcccagacatgggtccctcgtgcttcctgtcatcggaagcgcagcagcaggcagtcgtgggaaggtgaacgagcttgccctaaggactgacccatccaagccggctccacctcacagccttcctgggatacaatggctggtcattgacgtcacatcgttgcgggaagtcgacgaggccggttgatccaacgttgaatcgaagaaggaggtggtggaggcgtgtgagccattgtagatgacaccagccatggtggcttcgtgggcattcgtcgggctatccgttgcgataagccaccttccgagggtcctgcgcgtgaccccttacgagagaacttgtactgtgtcgtctggatgccatcagtgcaagttgagttgaaattggcaactgagtgggccgtcttactcagttaaaggcaactttctgggcaagtaaaaattgcttacaagagaatgaaagcgggccttgtaacgcgagaggtagcttgctagagggaacacgtgggacgacggtgaatgcacgggagttgagccaagggaacgcgagggcgtggcatggaagcgagcgttcaagcaagccagtcgacacgaaaggtaacctgcgcaaagatccatcccagatggtccaattgcgaccacacccgcaagattgcgcgcctgtctttccctcctgtcggccagaagtgaaggcctcgactcgtgactgggatgatccaagtgtgaaacctggatggcctactgtcgtgccagaggaaggcctgagaactgaggccccgtcggatgacgcgctttgacggcaaggcagggtaaccttgttggaaaccaaaggtagttctggggcacttgactagaagatcgattcgacgctcaatcaggcgagtagaccaacggtgccaaaagggcttaccaaaagggggtcaacccaggtcgtttggcactaccctaaggaatgctgcccccggaaagaaccaaccgagggcctgcgccaaggtggcctgtattggggcatggcatcctgctcgtgtagccttcttctgtgggcacgcgccgggcagaagggttaccatcacccgatgggatcacagaagttata

SEQ ID NO: 665770 - DNA, 404 bp, Homo sapiens
ccgggaaaaaaggcggggcgggggggagagggggggacccccccggatgtttggaacgttgagagagttaggttggtgttgggccggaggaaagcgggaagactcatcgtgagcgtgtggcatttgggaaagccccgccgcattttttaaccctagatctcgaaatgcatcgttggattcctgtccatttggacttgtaaggtttaaatgtagggggccaatcttgtgaaaacaagtggcaacaagaacggcgagactacggaccccggggacggccccataaaaccgggcggccacacatagccccaacaactgaagaaagcacgcagagcaactcgccagaccaccgagacgctcagggatagcaaaagcacaaagcagcaacctccaaacaaagggaaaga

SEQ ID NO: 665771 - DNA, 898 bp, Homo sapiens
ggcggctgcgtcccagtagcccggcctggcctcgtgcaccgcgtgtctgtgggggtccctgggccgctggctgcatgtggcctggggctggctggctgaggcctgaggtggctgggaatgccactgccctggcctggcatgtgtgaactgtgcaagtcgatcccctaacccagaaatgccccagtgctgctggtctctatgtgtgctggcccctgctcctgcttctgttttatttttttacggacagtggtgtcgctctacctgccctgggtttgtaatgcaatggtgtgatcacgggctcacctgcagcctcgcacctccctgggctgaacgcgatcttcccgcctcaggcctccatgagctaacctgtggaaccagcagtgcgcgccctgcctgtgctttttttttttcttcttactctcatacggcggccccagccacgcggcggcgccccccatctgcgacgccccggccccccccacctcacaactcccggcgcccacaaccaaacacgcaccgtgccacccccccccacaaaagcaagtcagcaccaacaccaagagccaaatacacacaaacgaaaaacgagtccaaaaactaacaaaagaaagggacacaaaacaggcacaaaaccgccgcaaacacaacaacccaacaagaaaaacacaacggcaacgaccaaacagtagagaagtacaagcggccacacccccatacaccaccacccacaacaacaacccaacaaccacacctccaaacgcaaaccaccatcaattaaaaacccacccacgaaaacccacagcacacacaacgagcaggcagcggacccccccaagaagtagtaaagaaccaaaaacaaaccgatgaggcaaaaaagtagaacgaccaacaccgccca

SEQ ID NO: 665772 - DNA, 610 bp, Homo sapiens
  misc_feature (1)..(1): n is a, c, g, or t
  misc_feature (50)..(50): n is a, c, g, or t
ntataaacttgtctgtcaccatatttggggagtttgcagctacttgagtnggggggggaaattctggacctcatggtagtgtgggtcatttctctaggtttaaattttcctccccagtccaccagttttgtttaccttccagtctacttggttgctttttctgttgtaatcagcaggtgatataggcagtagcaagcatactctatcttggctgctgctacttcaattttacagataaggacactgaggttcaaaaagtttaggtaacctgccgaggtcagatagctagtaatctgccaaattagtattctgattctggattctaaatttggtccaactcctgtactttgtactgtatcatgttgctcttccaagatttcctggcttcatcagtttaaatagttgatagattgtaacaaagtttgcaggtcacttccttagtataatagagtatacgaatgtcaatttaagtactgttagaataaaatgatgttaactactgcatatgagtccctggatactccaaggagagtcttgttcttacattaattgaaatacttcaaatgtgtcatcatttagaaataagaaataagaccacgtgaaggaagtt

SEQ ID NO: 665773 - DNA, 818 bp, Homo sapiens
gggcggcggcggcgatcgtgacagaagtggcggttgctgacgcctggaaattcccctaaggtggagcaccacccaacccccctggtcccacctccctcaagctcctccgctccctcaccccctggtggtcactctgggtcctacctggtatcgagttatggtaaggtcagcctcgccagccaagctcatcaatggcggcatcgccgggctgactccggtgtcacctgcgtgtttaccatcgatcctgggcaagaccaggctgcagaaccagcagaacggcagagcgtgtacacgagacatgtccgactgcctcatcaagaccgtccgagtccgagggctacttcggcatgtaccccgggagctgctgtgaacttgaccctcgttcaccccgcgagaaggccacttcaaagctgggcagccaacgacttcttgcgacatcagctctctaaggacgggccagaagctgaccctgcgcttaaagagatgctggcgggctgtgggtgctggcacctgccaagtgatcgtgaccaccgccatggcgatgctgaacgatccagctgccacgatgcagggcgcaatcgccgcccagaggaagatccttggctggccagagacagctcatcgccccaggaggggtgccagaacataagtggaggactcaagctggccctcggaccacggacacacaactgaaccgaaacctgttgcgagcaccgtgaattgcggtatctaaagggactcggggcaagctgctaggatgtcccaactacagaatgaataccgcgtttgacacctacaacagagcgccgggtcgaaaa

SEQ ID NO: 665774 - DNA, 149 bp, Homo sapiens
attgcacatgttcctactccacatcttcatccatgtggtgtcctcgggctaagatggtgaacggggcatggggaccgaacggtgcatggggaccgaacggtgcatggggaccgaacggtgcatggggaccgaactgtgcatggggaccg

SEQ ID NO: 665775 - DNA, 508 bp, Homo sapiens
  misc_feature (3)..(3): n is a, c, g, or t
  misc_feature (89)..(89): n is a, c, g, or t
  misc_feature (96)..(97): n is a, c, g, or t
  misc_feature (99)..(99): n is a, c, g, or t
  misc_feature (102)..(102): n is a, c, g, or t
  misc_feature (109)..(109): n is a, c, g, or t
  misc_feature (117)..(117): n is a, c, g, or t
  misc_feature (121)..(122): n is a, c, g, or t
  misc_feature (132)..(132): n is a, c, g, or t
  misc_feature (134)..(136): n is a, c, g, or t
  misc_feature (143)..(144): n is a, c, g, or t
  misc_feature (150)..(150): n is a, c, g, or t
  misc_feature (152)..(152): n is a, c, g, or t
  misc_feature (154)..(154): n is a, c, g, or t
  misc_feature (158)..(159): n is a, c, g, or t
  misc_feature (172)..(172): n is a, c, g, or t
  misc_feature (180)..(181): n is a, c, g, or t
  misc_feature (186)..(186): n is a, c, g, or t
  misc_feature (200)..(200): n is a, c, g, or t
  misc_feature (208)..(208): n is a, c, g, or t
  misc_feature (364)..(365): n is a, c, g, or t
  misc_feature (383)..(383): n is a, c, g, or t
  misc_feature (424)..(424): n is a, c, g, or t
  misc_feature (483)..(483): n is a, c, g, or t
atnatacaaagtatgaatttggttacaattttgttctgaaatccccgtttcttttcattatttccatagcaccctaaaaatacacaggnggcaggnntngtncactggngctaaatngtanntgtgggtaanannngaggggnngggtgngntntttnngctctgggtcggngtatattnnatggncgagagagatagangtgggganctcacaaatgctataaccaacaggatctagtttttccacgtgatggagttccaagcttttttttttgttttgttttgtttcgcaaaataaaaacaatacacattccaagagaaatgaatgcatctgttgacacgtctctatttctcatttacatanntacacacgtaccataaancgctgatgatgacacggccatgtgtggacgggtcaggcccnaggcccgtcgggagcagacctgtagctctctgggggatcagggcttccattagggaganagtattagcagtttcttaaaacata

SEQ ID NO: 665776 - DNA, 314 bp, Homo sapiens
gaggatccccccgctggccaatggatttgatagtacttatcacttctgtgcgagcttgtggaacagctgactcagtgaactgcttcctgtcttcagatgcgtgatgacacagatgtgtcaagcttaatagatcttatatgtcaatttaagaataagaagttttatagccaccctggttttattccaaagttactgctcatgcaatttggggctccatccttaggaagatactggtgaagcaagaggagcattttttcatcatgcgtgtgtgaaatgtcgtggtgctatagaggggtgactatggggccaggggg

SEQ ID NO: 665777 - DNA, 324 bp, Homo sapiens
  misc_feature (286)..(286): n is a, c, g, or t
caattggccaggcctggtggctcctgcctataatctcagcactttgggaggccgaggcgggaggattgcatgagcccaggagtttgagaccagcctgggcgacatagcaagaccccatctctacaaaaaatacaaaaattagccagacgtggtggggggtgcctgtagttccagctactgaggagggagttgcttgaatccttttgcttcaatcctccttaaagcaggtagattgcttgagcccgggaagtggagtttgcagtgagcccccctcccccccctacantacagactggatgtcagaatgagactcaaataaaaaaa

SEQ ID NO: 665778 - DNA, 437 bp, Homo sapiens
agctgactctagagtgatcccccgccgatcacgcatcggtcgtgaccttcggtggacagcagtgagcgatgctcggacaggagcggcgcgcaaatctcctgtgcggccgccgaagcaatccttgaggaggaaggcgatggccgatcgaagcgcgtcgagatcggcccggtagacgatcgagcggctgaagcgctccgaacgaacgagtcctgcccggctgagaatgctcaagtgcgacgacatcgttgttgtggggaacctcgagaacggcgcgcgacctcaccggcgggcagaccctccggctccgcagtcaccagcaagcggaagacatcgaaggcgcgtgctctgggccagacgcggccaggggaggataacttgttcaatttccatattgtcggagactaaatcgacatatttgagggatccagtgacctcac

SEQ ID NO: 665779 - DNA, 100 bp, Homo sapiens
tagcaataggtaaatgcatctctaccaactaaccgcgaagtcatcaagcccatcatttctaaccaccacgttttggcaaaatgggacattactatttgcc

SEQ ID NO: 665780 - DNA, 253 bp, Homo sapiens
acaatcgagctcggctacgctcgataagggccgaaccgcacagtgctggagattacagagcttgagccaccacgctcggtcacacaggtatcgttctagatcaacgtcttgctgggattgtttgacagggcctcagtcatccgagtgtccccatatctcatggagagcgcagagttgatctccccgtgatggtctgctctgaaacgatgtttgcttctgctcagcctgtgtgacattgttttcccctatcgag

SEQ ID NO: 665781 - DNA, 832 bp, Homo sapiens
tcatacatcttctctttccttgtttcctctacaatggaggagaaacaaatatatttcttactagcaaaatagaaaattgaattatttttctccaaattgagactctcagaaaaggaagattgaattagcgtgttatttgttagttgttttgtatatgttttcgtttttttgagatggagtttcactcttgttgcccaggcctgtagtgcaatggcacaatctcggctcactgcaacctccgccccctggtttaagcgattctcctgcctcagcttcccgagtagctgggattacaggcatgcgccaacatgtctggctaattttgtatttttagtagaaatggggtttcgccacgttggccaggctggtcttgaactcctgacctcaggtgatccagccactcggctcccaaagtgttgggattacaggcgtgagccaccgaaacccggtcccttgtgtaccatctgtataagagaattcttttagctaggagtgcagaatttcaaagtaccattttgaatgatcttaattttgctttcatgagaacacatttccaatcatgaatcatgctgtattgtactaagagggaaaagtgtatttcaagtcaaagggtgagagacttaaggttataggtagaccttgagagacctaagggtgagcagacttgaccacactggaggacgtaacattagggatctacttctacctcaattaagttagacgaatataacattcaagaggcttacaaaagtcaaatttaatcggcccaatggtatggtctccaatgtttcatttcaagaacaagaagggttcctcttatatcagaataggt

SEQ ID NO: 665782 - DNA, 767 bp, Homo sapiens
gactcgggaagacttcagagaagtctcacaaaggactcggtggctgttttctcagtgccgaagccggccatgtcgtctcagaagcggctgaccaagggcttgcctcaggacgctcgcgccctcaggtgtgttcatctttttgctacgggccctagacaatacgatggaacgttctatgaatttcgtacttattaccttaaaccttcaaatatgaatgcgttcatggaaaattcttaagaaaaacattcatcttcggacctcttactctgaatgtgctggattcctggagtgtagaattttggaggcagaacgaataaagtgtttccatattctggaagtatgataatttgtgtcatcggaggatgaagttcggaaaagctttaggccaactgttaaggaatggcaagaacaatctatcattccaaaatttggtcggcatgggttaaaccaagaggagggaattacttacctgattaccgtggtccaaattagaaaagctccaaaagaaggggtctaatggacctagactggtttctcagatggaaaccgggtggggccagcctctcgtggggggtggatgcttttgaaaagaacccaataaaggcccatgtcaatttaggcgtccaccaacagttcgtggggttttcaccccaaggacattgggggactcaaccaaagtcacggcctcgggggcatgaactgcaatagtcctgcactgggaacattatcccctggatagccaaagtggggcatgccgaaggtcaccc

SEQ ID NO: 665783 - DNA, 849 bp, Homo sapiens
  misc_feature (128)..(128): n is a, c, g, or t
  misc_feature (511)..(511): n is a, c, g, or t
  misc_feature (573)..(573): n is a, c, g, or t
ggcgctttgcgtacacaagcgcatctatgggctgtccagcagacacccatgaacactcgaatgctcatttggtgacgatgcaccgacactctactcaatagtcgcgaggattcactagcatattgccnctgccaaggataatggttgatggtgagacggtcgacacctgatgaccattggacctgctctccacaacagcagggcaggaaatagaccgacaagacgcttccagcagcagctgcatagtgcacaatagagggaacgctgtcccgtgagacattgtctgcatggaagcacggaccgaatctgtcggcatggtattctcatgtagtgtgcgctgtggcttgaagcctatgcccttcgaaggatctactaccatctgtggcatcaccacgggcgagcaatcccatgcagtcatgtgattcgtggcatgtaaacgtacaatgcatatcacatgcatgctgtgtgtaccctcgggaacgcgtatgctccaccatcgtacaactcgganggcgccggccggagtacatggtgaaagtaccgtatcatgtgagcttggtgcaatgtgtgtgncatcctcgcctgctgggcagaacgcggatgactgagctggagcgcctatacatgagacttccatgttgcggcatgtgacgtcgtcgtggaagagtcttgacacttcgcgcggagaaatagctatgtaacgaccgaattggtcgtggaagttggcacgtggggccaagaatgaacgctccatccaaatggcttgacctaaaggagtctcgctcggatactctcataatgcccatttacagatagcaatgggcacgaggcctcggaggccgtgtggcc

SEQ ID NO: 665784 - DNA, 706 bp, Homo sapiens
gcgtcggtctgcgggagaagatggcggtctccacaggagttaaagttcctcgtacattttcgcttgtcgcaagaatcttgacagacagggacaacaacggagtaggacgatggtaacagtttacgactggaggtcttgaccgcatgatgaacgctatgaccccttacaatggtggacatggcatgaattatcgggccaccaaggacctaagttatgaaaacagacatatatacgcctgacaccagtcgcatgtggaccctaacagtacccagaaggctcctccgtcagtatagattctgtagacacaaaattaatatgacaccggcaataacactcattccaggttgggatgggtggatgcccggagcatacgcaggtgttaagcgaaaattggcaacaattcatactacgccttaaagttgtacttcgaagagctaaagacgtctaatgatgtccaactgtatcacatcatgccagcttccaacagccgaccagaaggacgaaactatacaacaattaattctcagctggatctcaaacttgtcttacaatcaacaaaccttctactcatgtcaagtgtcttgattcacatatcacaatgcaaaatacacattaagtaacacgaattccagcctggtaaacattgacctggacatttgtcacgctatattactatatgtcccccaatatgtctccggtaacaggg

SEQ ID NO: 665785 - DNA, 1014 bp, Homo sapiens
  misc_feature (9)..(9): n is a, c, g, or t
  misc_feature (76)..(76): n is a, c, g, or t
  misc_feature (107)..(107): n is a, c, g, or t
  misc_feature (109)..(109): n is a, c, g, or t
  misc_feature (277)..(277): n is a, c, g, or t
  misc_feature (315)..(315): n is a, c, g, or t
  misc_feature (322)..(322): n is a, c, g, or t
  misc_feature (338)..(338): n is a, c, g, or t
  misc_feature (396)..(396): n is a, c, g, or t
  misc_feature (417)..(417): n is a, c, g, or t
  misc_feature (510)..(510): n is a, c, g, or t
  misc_feature (523)..(523): n is a, c, g, or t
  misc_feature (659)..(659): n is a, c, g, or t
  misc_feature (721)..(721): n is a, c, g, or t
  misc_feature (802)..(803): n is a, c, g, or t
  misc_feature (808)..(809): n is a, c, g, or t
  misc_feature (814)..(814): n is a, c, g, or t
  misc_feature (844)..(844): n is a, c, g, or t
  misc_feature (891)..(891): n is a, c, g, or t
  misc_feature (893)..(893): n is a, c, g, or t
  misc_feature (897)..(897): n is a, c, g, or t
  misc_feature (902)..(902): n is a, c, g, or t
  misc_feature (909)..(909): n is a, c, g, or t
  misc_feature (912)..(912): n is a, c, g, or t
  misc_feature (927)..(927): n is a, c, g, or t
  misc_feature (934)..(934): n is a, c, g, or t
  misc_feature (939)..(939): n is a, c, g, or t
  misc_feature (977)..(977): n is a, c, g, or t
gtgtttttntttctcactgattgtttcctgaaggtatcacaggtcttggcaaggtcaagttaccatcgctggttanacatatcctggatatgttcaggttccctgtntnaaggccttttgagccacttggagatgtaatttaaaaaggcaaaacaatgcacagaacaattggggaaaagttacaagtaaaataattttatgcagacagaaatgtttttaaagccgtccatgatttagtagaaagaatcaggagcttgaaacaattacttctgtcgcnctttttctgaggtttcattccaatgagagtcgcacacngtcagcntggttttgtggctgcngatagtcgtactttcttgaaatggaatacatttccagttgttgtcttaaacgaatctngcttatcgtgtcataaaagtngggctctgacaaagtttcctctgtaggtggcacactgaatatcctcataattctccttttgttccttttggcatacatgaagagaccgaagcnaacaaggataacnatcaagtaaacattggtggcttcattccaggcttcgtgaacagtataatcaatagaaccatcgtcacccatcactccataacccccagccatggggaagctcacaggcctccacccaacatccaggaaagccattnacaggtgctgggcagtccacagagtcactgaattatcccaacaaccctgctgggcggcactnaagctccattttacaggagaagaaactggggtggcggcggtggttatataacttgtccaaagccacaaaggcctgggcgtnnttttnnggggntgttttacacacgactcccaaacctgaacncttccagtcttggccccgatcctgcgagatctgctccttccggaagntntttnttttnttttttnttntaatgttatcctctnccaggancagcncgggtcccagggcggcgaggctctagggacgttccgcngccgccgcctgcgcgtgaattagctcaaccccccgcg

SEQ ID NO: 665786 - DNA, 321 bp, Homo sapiens
ttatttttctgagacagattctaggtctgtcacccggctagagtgtagtggtgtgatcataactcactgtaaccttgatctctcgggctcaagcagtcttacccattagcctcctgagtagctaggactacagatgcatgccaccacacccagctagatttttttgttttttgtagaggcagagttttgcagtgttgcccaagttggtctcgaactccgggcctcaagcgatcctcttgcctcctaaagtgctggaattacaggtgtgagccactgagcctggccctaaaaactgtgtggtgcctactatgaaggagaaat

SEQ ID NO: 665787 - DNA, 184 bp, Homo sapiens
gattagatactcagtatctcagcgcatcacactctcaagtaggctccctatttgcttctatagtcgaacgaaagggtcgaatgatacagacttaaacgaacttcattagctctgaagatgtcagaaactatgactatttcgcatccttatcaatcaccattcctgtgcccatctcagggcgatc

SEQ ID NO: 665788 - DNA, 1098 bp, Homo sapiens
agcagcagttgtgagtaccacgaccagcaccgtcactgccggctcacagcctttccttcttcggggcgccccaggcctctgctgccagacttcagccccggtgcatgggctccatgattccagtgtggcaaacctcctgccttgcccactaaccaccatcgagtcaccaccttcacgccatggtccctgcacactgccgtgaccaacggccaccagactagctagacgcgtgccgactttagtggtttgggcagcaccctcgccacctccgatcccggccaccgagtgagtccagtcccacttctgtactgtttcgacgtaaccacgagctacctcccttacgttcgaactattcctcgtttgagacttctaagctgcccaagtaccccgactcccgagtccatagtcccgggtgatccgaagcctccactgagcccctgcgatttggtggagtcgctgcgtgtaggggtgcaatggcaacctgcggggcccgcctcaagccagagccctttgctcccccaagcttttggcaagcctcctattcatcatttttggaatagcatctttgcgagcccccagtgcgttgcatgcatctccagcaccttgctaccctcctgtatccaatgatcaacggtacgtgccttgcgttgacgtgccgtacgacaccatcccgatctctatacttctggctggtgctcgaccgcactccgagcgtttggggttcgaacagccaacggcttcgggcgctacggcagcttgcccgccagtctacatctagccccggccctttgtgggcgcgcctcgcagcttgtcctgctctttcttctccgtgctgctaggctagcccagacttcccgggctttggggaggcccatccaacgcccagtaatcccggcccgaagtcgattcggggtgaggcaacgctcgaggcttcgccgctgcatactgggccatgctgatcctactccaacccactttctacccccctttctcccggtttatgcgcggcggcttccgggccaggccccacctgccttgggccaaggtgggcggagcctttcggcggaatccatccgtttgccctccccaagggtctcc

SEQ ID NO: 665789 - DNA, 483 bp, Homo sapiens
  misc_feature (328)..(328): n is a, c, g, or t
ctagcttccacttattttttgggatcatgaccttaagattcagaaagattttgcaggtttcttccattccagcctaccatcaaatgcaggcaaggaaaataaaagatttcaagggcacgaaaatatattttctcaaggtattttttaaaaatataggaattctctctcaaaatattaactattatttagattatattttgaaatgaacttgttggcccatctattacatctccagctgccccttgaacatgggggttaggggagctgccaattcgtgggtccccaaaattttaactccctaatagcctactattggccataacccttnctgataacataaccagtaaattaacccatattttgggtgttatatgtattatcccctatattcctccaataaagtaagctaaagaaaatgttttttagaaaatcataagaaaaagaaaatattttttcttttccttaaatggaagtgggtcccca

SEQ ID NO: 665790 - DNA, 707 bp, Homo sapiens
  misc_feature (359)..(359): n is a, c, g, or t
tgcacaactttaaaactctaaagtcctgcgttgcgccgctgattgccttgtcctaagagttgaacttgtctgtttgaacgtttgtgagtagtcacgtcttttatgccccccttgagggcctaatgccattagatcgaagctttcgtgtttgcaccatggactgttataatgtttatgtaatacaatatttctacgttcccacagtctttgcgtgttacacagtcacctgtgccgcttccgtttgccaccacgcgaagataaaaagatgggtcatatctaaacaaggtcgaaatgtgaacaagcgtgtcttgtgtgagattatgtgatgtatgacttgcacgaggttacgagtgtgacanattacttcagggcacaagactcttaggtacgttgtcactttgtgcttatgacaccaattggaggaaaatcaaattcaggtcttacttaaagcgtattcagtgtatacctgcacccaagttgttgccaaggctggacaagcttggaccttttctgtgtagtgactttttaatctatagttatttcactaacctggagatcagagctgttgctttcgcatgaatgtagtgtagtgtatcatgaactggagtttgctttgttaatagtatctgtactccttgtatttttaagagctattttgtaaacagatgatgatttcttacactggactcaatgataaaccggccctg

SEQ ID NO: 665791 - DNA, 241 bp, Homo sapiens
actagcttttctaaagggaatcatttttttaaaagtagtgcccctggcacagatgctacagtgaagattatcccttcttaggatatttattttcagtgaacattttttgcccaaaggtagtgttgccctgggacccaagccttttaacaaataaccagttgaaatcaaaccctgcctcccccccgagttttgttgtgtatttgatagtaaattgatttaaaaataaaagtggtttttgtta

SEQ ID NO: 665792 - DNA, 1869 bp, Homo sapiens
  misc_feature (1291)..(1291): n is a, c, g, or t
tccctacgagaggaggggaagagcaatcgctgagagaatggagggtgggcgatagcgagtgtgatcaccgaagttggtcttgtagtctgttactgatcgctaatggcacgtctatcatctatgcttatctttgtcttatattctggttattgtgtgttcgtctattctgcttggtgtattcgttgtttgctgtttgctctatgtacagtgtgttgcttgtgggatatctactactatcttctgcactgttctgtgacttgttggggttgttagtagtaacggaacctagctttttgtttctgcgatttgtgtcctatagttgatatgttgagtgtgttgctcttctgcttctcgggatcgttgtgttgttcgtactggctttctctctctctctccccgcttttttggtacttcgttcttgcctccccgctcccctccccctctctcttgtgctgttgggttagtgagctcgtcccgctcgcccggctgttgctgtgctttcttcccgccgtctgtggggtgcgtgtcatggtcggagagtaagctcgccctctctctgtggctcggagtttatctgtttgcgtcgtggtgtttttgtggtggcgcgcgctggtgtgtgttgggactccgccatctttcgttgtggtctcgcgccgatgtgttgttgatgctcgtgccgtttgttgtcgtcctgtttttcgtccacgggtcgacggggagtgtgtggatctctgcgttgtctctgtcgtttgttgtgtttgttttgttttgatcgtatggtttgctggcagcgactgatatagatcggccggcttgtgttttggggggcggtccgtgtggtggcgtgcgttcgtttcgctcgtcgccgtctagtttatttggttggttgtccccaggaggtgctcttttgtgtttgctgttggggcgcgccagcccacagagttggtgttgtaagggcgccccctgtgagagttgtttggttgatggatgctttctgttaggccgcccgccgcgtgtgggcggagagagagtaagattagtgtggtgtggcgccgcccccccccccactgcgctccccgcggtggatgtagtgtagtagcctacacgtcgggttttggggtttgtacgcccccccccaaggcccgcccccctcccgttgttacaataaaaggctcatcttttttgttctctccgccccgcacgacttcgtggtcctgacactactatatttataatattattatcctacgtcctcccgcggcgtctacgactacgtacttgagcgagtggncctcccctactctagaggagtatcctccttgtgacaccagaagtttcgtactccttcttcttgttaacatgaccagtagtatttttatatcagaccctcctcatccatagatatcataatctcgtcgtatcctaagacagagagatgaaaaacaatatatgtttgaactcccctctcctttactctaatggtttcaccccgcccttctactactctctcttgctccacgacacaatagttgtcgcacgacgtgcgcgacgcgagagtatatttatatgatagagagtgagatttctctctctctctgtgtgtgacacactgttcgcgcgctcattgttctctgtatgaatggcgctctgtcacacgcactctgtgcgcacgcggacgcccgcttgtgtgctccacacacaccgcggcaatgaccccgcacgccctctcttggagaggcgccggcgcgctcactgcggggtactcccacagcggtccgagagaggtttgtgagcgccaccctccgcgccccccacacgtgtggcgaacactctcccttctctctctcacacacaacaaagaacaaacaa

SEQ ID NO: 665793 - DNA, 162 bp, Homo sapiens
tgatggaatggatgacatcatcagtcaagaatcctcattggatatggaggggaattataaaaaggcacagagaaatgagagagagtctatcagacagaggttggcacttggaagcttctttgatgatgcccaggaatttataccacctgtagcaaaaggtgg

SEQ ID NO: 665794 - DNA, 607 bp, Homo sapiens
  misc_feature (27)..(27): n is a, c, g, or t
  misc_feature (80)..(80): n is a, c, g, or t
  misc_feature (86)..(86): n is a, c, g, or t
  misc_feature (98)..(98): n is a, c, g, or t
  misc_feature (107)..(107): n is a, c, g, or t
  misc_feature (154)..(154): n is a, c, g, or t
  misc_feature (180)..(180): n is a, c, g, or t
  misc_feature (233)..(233): n is a, c, g, or t
  misc_feature (237)..(237): n is a, c, g, or t
  misc_feature (244)..(249): n is a, c, g, or t
  misc_feature (319)..(319): n is a, c, g, or t
  misc_feature (348)..(348): n is a, c, g, or t
  misc_feature (362)..(363): n is a, c, g, or t
  misc_feature (370)..(370): n is a, c, g, or t
  misc_feature (374)..(374): n is a, c, g, or t
  misc_feature (394)..(394): n is a, c, g, or t
  misc_feature (411)..(411): n is a, c, g, or t
  misc_feature (425)..(425): n is a, c, g, or t
  misc_feature (442)..(442): n is a, c, g, or t
  misc_feature (455)..(455): n is a, c, g, or t
  misc_feature (462)..(462): n is a, c, g, or t
  misc_feature (479)..(479): n is a, c, g, or t
  misc_feature (492)..(492): n is a, c, g, or t
  misc_feature (496)..(496): n is a, c, g, or t
  misc_feature (542)..(542): n is a, c, g, or t
  misc_feature (546)..(546): n is a, c, g, or t
  misc_feature (549)..(549): n is a, c, g, or t
  misc_feature (573)..(573): n is a, c, g, or t
  misc_feature (599)..(599): n is a, c, g, or t
  misc_feature (605)..(605): n is a, c, g, or t
  misc_feature (607)..(607): n is a, c, g, or t
tggaggttcgctattgttcgccccaanctggcgtccactggtgtgatttcggctcactacaacctccgcctctgggttcnggcggntctcctgcctcngcctcttgngtcgctggggttccgggcgcacgccagtacgcccggctacttttttntttttagtcgggatggggtttctccntgttggtcaggctggtctcgcactccctacctcaggttatcgcacccgccttngttnctctgcnnnnnnggggttacaggcgtgggcgacagtcccggccttttttttttttttttataaaaagggggcaggggaaatnttttacagaggggaggacaggagttcggnttcccgggcccccnncggggtncccngcccggggggggcggggacnggcttcctggggtctgngcctgcgggccggngctctgggggtgggggnggttttcttgggngtgtcgncttctgtgatctctgcngaaaggtcttccncccngggctggtcccttgggagggcaactttgggtttctttttggaagcncgcngcngggtgtttggatgccgacgggtantacggcggggctctggtgttaaaaanttattntn

SEQ ID NO: 665795 - DNA, 1123 bp, Homo sapiens
gagatcacgccactgcactccagcctgggcgacagagtgatactcggtctcaaaaaaaaacaaaactaaacttttaatttaaccaaatgtgctctttctatactatctcttgtttcatttaatggtatctgtgaatacctttccatagcaaaaaatacagctcttacaacatcaactttatagactgtataaattatggtatgctattatttatttatttatttttgagacagggtctcactctgtcacctaggctgggtgacagagtggtatgatcatggttcacgatcatggctcaatgcagccttggcctctccaggcacacacaggtgatcctctcacctcagtctcctgagtagctgggactacaggcatgtgctactacacctggctagttttcgtatttttggtagggacagggttttgcaatgttgcccaggtaggtctcaaacttctgggctcaagtgatctggcctgcctcatcctcccaaagtgctgggattacaggcgtgcgccatgaccccactgatacgtcataatttaattaatcctctcttatgggatatttagtgtattctaagatctcacgtttttgacatcatccaattttgcagagagggtattcagtatcatgtaagtgcttggtaaagacttagcaataagggtagtagaaacaggagattttaaaccaaaattaaaccattaggaactggcctggtatacatggaaaggagagaggcgacgaaaacgcacgaaagtatagggcatacctcggacatgcacaggactagatcctgacacggacttgacggggccaagcgggagccagggggagacacaggctacaggaaaaaaatggggacccgcgcgtcccgcgggtgatcaacaaattccctcaaccaaggaccaacagaatggagatacaaagcacacagacgatagcaagacagtaatatatagaagagagaagaacaaagcacacgggcagcacaatcgacaaaacaaagagacacaagaaggaaatatgaaacgaacgcaaacgaagttaaacaacacacaaaatcgaggacagcgcaaatacacgacacacgaacacgagaaaaagaagagaaagcacatgagt

SEQ ID NO: 665796 - DNA, 559 bp, Homo sapiens
tgcggtcgttctacgaggatccccctgggtgggacgacgggacacccgggactacgggtgtgtggtacgcgcgggacggttgtcacatgtgcaggttgggtgacaggagcttcagtgtgtggccaggactgtgagtggcacgaagtgaactcaaggcgaggaagaaacctgatggcagatgcccagggtggggtaggcgctacatcctgttcccccagcaaacctctgggacatctgaacgggaccacctggggcccccacgactgtgacggacacacctggctacgccccctgcagacagggggccgtgaacggtcctgtgaagctcaggctctgtagccgtgagaagagagacctgggtccgatgaacacccaaaagcctccctggaaggaacaatacggcggtggggcttcagcagcttcgcaggcagctcactaggtgtcctagtttgggtgcgaacacttaagggaccgaacagttgaagggccaagatcgggccggcgcagatacgcgttctttccttggcatctaagaagtaatcctcttccccaggcgagt

SEQ ID NO: 665797 - DNA, 160 bp, Homo sapiens
  misc_feature (2)..(4): n is a, c, g, or t
  misc_feature (18)..(18): n is a, c, g, or t
  misc_feature (60)..(60): n is a, c, g, or t
  misc_feature (74)..(74): n is a, c, g, or t
annncctcttctttcggntaatttctggaggggtgggggggaggggacatgaaatcatcnttagcttaggcttnctgttctgtgaatgtctatatagtgtattgtgtgttttaacaaatgatttacactgactgttgctgtaaaagtgaatttggaaatg

SEQ ID NO: 665798 - DNA, 319 bp, Homo sapiens
tacgacctctagacgaccccccggggaaaattatggctgcactgatggcatacttacgaccctttggattactaatgaaaacaactactctctgagcagatgtccgactcctctgatatttatcctgaatgcgttactgtacatacgtattgccagaattccactgtccttccctctaggtgatctgtgaaactggttcgctattcacttgccccgtagaaccccacgaattcatgcaaatcaagaggttccaatctacgtgtccacatttaagaacactcgtgaaactgcccggtacatgcaaggtgtaccgagctcg

SEQ ID NO: 665799 - DNA, 836 bp, Homo sapiens
gaggctcggccggagccgtggatgccgcgccgctgcccaggacctgctgccctgcgcctttgtcctgccgccgcccaccgcctgtcgcccgccgcccatggagcgctgcctggccgtcgcgccgggtcccgcttcctgctgctgctgctcggctgtgcttgctgctgctggctggccggagtggacgctggatgtcctcctggatggcctgctgtgctggactggacacctggatggccactcatcagaaggactgctcgctgccatatgctactggaatccaaagaattgcaggatggtgcagtgagcagtgctgccacagccagctggacggagcttgcactgtgccacgggcatcagcactggccaacgagcaggaccgcatgtgccacgacacccacggtgacaacgcccagcctggaggccacatattgtgaagaggtgctgccattgcagtactgctgagggacggcggccattgaccagggaccagagactgcagagatacagcctcatggttggctaacagtgtggacatggtcttccgggacatgcagtgtcaagagccacagagaaccgagcagataagcatgtcagagacgggccatccaaagacaaaacgcgcaatacagcaaatccgagtatgacggcgttgcaggagaagcctgacccaaggacaggacccccaataatctggaattgacacggcgatgcccggagtgacacagtctggaacccatgagcaagcatacacacaaatgaccgagacacacacacattgcttgacctaacggattagatcctagatacagtgcactccacaaggagaaaaacaa

SEQ ID NO: 665800 - DNA, 184 bp, Homo sapiens
atggagaacagtattgaaacacctcaagcaatcccactactgggaacttatccaaaggaaagaaaagcattatattgcagagacatctgcatccccatgtttattgcaacagtgttcacaatagccaagatatggatcacctagtttccaacaacagatgaatggactttaaaatatggttata

SEQ ID NO: 665801 - DNA, 214 bp, Homo sapiens
aagaagcacatgcccaggcagaagaccaggaggcccgtgtgcacagtcatagaacccgacatacgttgctcgcgtgccgcatctgtatgggtagaagggaaaaggagaaatcaaggatgacttctacattctctagattgttttgcaagttgatgtttgccttctacaatagggaaaatgctgtggaggaaacattgggagcaccaccaataca

SEQ ID NO: 665802 - DNA, 508 bp, Homo sapiens
tcagctgtcaatcctaatgcaagaagttacttgctgattcattttttttgagatagagttcgctctgtagcccaggctggagtgcaatggcgtggtctcggctcactgcaacctctgcctcccaggttcaagtgattatcctgcctcagcctcccaagtagctgggattacaggtgcgtaccaacacgcccagctaatttttgtatttttagtagagatggggtttcaccatgttggccaggcaggtttcgaacgcctgacctcaggtgatctacccgcttcggcctcccaaagtgctgggattacaggcatgagccaccacgcccagcctgtaaattaaactttatcgtaggtatgtatgtataggagaaaacatagtatatatagggtttggtactgtctggggtttcaggcatccgctgggggtcttggaacgcatctccttcagacaaggcggggactaattgtattttcatttgatttgcgtagattgaacagcggaccctaa

SEQ ID NO: 665803 - DNA, 1049 bp, Homo sapiens
ccgctgttcggtgtggtcttgtgccgttgttgtggctagcctatgctcctcaggtggttgtgccagaggtcctgcagttttgctccggtgtggtggtgcgcgtcgtggggttgtgtatgttgatcgcgtgcagcttccgcatgcgactgcgcattgcgcttggcgtgtatgcgcggagtggccggcttttggcaatgggtgccctacgggtgagttatgcatgataagggtgccccttttggtcggtgggggcgcttgcgagctgtgggatgcaacagtggcaatatgcgtggcctattgctgtgtggtgactttacctaggtgtgttgtgttttgcatgggggttttttctgttttgtgtaggttggccggggagtcatgatttgcgcgacctgcgtctaacgtactcggtatgcaggtgactgcaagatcgctctaggtcaaaggtttccctagtggagttgcttggagaggccgagggttctggcaatttggctcgtgcgggacatgggagttgtggaagtactggtttaccgcccctttgtcaatatcatggagcagtctttgtgtgttcctggtacattgttcttaagtcagcgttgctcagagagccgcatccctagtttgtctttctggctataattcggctgtaacacggagtgccatcccttggttcgtgcatgttactctacactggtgaaaagggggactcgtctcggcttgctcctggtgccctgtgatactgtggattttgatttcgccctctttggctccagtaataggcgttgctatggagtccatcacccaggcatcagatggggccattgaaacgctttgtcatgcttcttcagtaccatggactttgaaatgaactcatccttgctgtgagcatccaggagcccttgagaagtttatatatgactatgacactggtaatgtcacacctagaattacggtcctccttattcccctgtcacctccaacagtgaacgctaatgaagtttcaagacaagccagagagctctattttaagcagcggtatgttatac

SEQ ID NO: 665804 - DNA, 287 bp, Homo sapiens
ttagatcgggtgtcctacatgtagttgcggcacggttcagtacacagagtaactgctgctatcgagtatgcacatattgaagtatgatggtttgactgtatggcagtgttgtagcacgcctctggattttattcccccatggcctcttttttaaaaaaccttatacacagctcccttgtgtgactttttcctcaggtcttcaagtgacgagacgcagtattaagaagacccttgcatatctaaatttttaactcattttacaatgacaaaattcctagtgttcagta

SEQ ID NO: 665805 - DNA, 380 bp, Homo sapiens
agtgcggtcctgccatgtacacttttgattcccccaaaacttaactgctaatagctactgttgactggtaaccttattgataacataaataattgattaatcccatacttaaactagtatctacatatattctatgcattcatgacatacctaaccttttcttgatttttttttttttatgtttctaggctacatggttcatctgctagttttttcatattgtcacaattcccaaaaaaattttccaatatgtttattgaaaaaaagccctacatataagtggacccacacagttcaaactttggttgtccgagggtcaactgaaatgaaaattaaattaatgaattttgggaattccagctattcacattgggaaatgc

SEQ ID NO: 665806 - DNA, 108 bp, Homo sapiens
ctcgcccgattctatacgcatagtgtaaactgtagagtaagaagaattgagaggatgaataccataaacacactgctgtgtaaatacatattattattattattattc

SEQ ID NO: 665807 - DNA, 550 bp, Homo sapiens
  misc_feature (230)..(230): n is a, c, g, or t
gggccaagccccaagaaggggaagggggaaatggcaaaaaatgtcccagctttcttcggccgggggtttccctcgggggttgggccggtattttttggatggttttctttacgagggtcccccaagttttgctccaggtgggcccgttgagtgaaaatgaggattcccaagggtgatttgtttggcaaacaggaacagcagcatcccaaaatacaggcccaggaggcagnggagctccttgagggccccccccaccaacccagaggggatgcccatggtgaaaattcctgagatggccaggactttggaccagatttgcagaggcacgaaggccaagcccccaaaggacacgaagctggttttgtcgatgaggatccaaatgccgaagcaaaagatcaggctgccgaggacgaaaaaaaaaaggttgaaaacgaaaaggaagtacttgatgaggctgaggcagctttcctgggctgacattttcacctagtggggtaagcggtccactccccacacaaaaaaggtgctgacagtgggggagacagggaga

SEQ ID NO: 665808 - DNA, 126 bp, Homo sapiens
tgtgtagcgccgggttaatagtacttgccgcagatagtcttaaaactaagcgaggatggtataaatacgcggcacactcattctcaaccccctgtacaaaacacattgcctaccccttccttgtac

SEQ ID NO: 665809 - DNA, 181 bp, Homo sapiens
agagctccacaatacattatcgcgaatacccagtaagaagtagagtggacactacaacatgaatcagagaagggagaaacgggttaatccagtaggatttagcaaattgcctcttaggagtagtattagtctagagtccaggatgtactgttgtcccacccttccctgaaaaagctcacct

SEQ ID NO: 665810 - DNA, 277 bp, Homo sapiens
  misc_feature (3)..(3): n is a, c, g, or t
  misc_feature (140)..(140): n is a, c, g, or t
  misc_feature (191)..(191): n is a, c, g, or t
  misc_feature (207)..(207): n is a, c, g, or t
  misc_feature (209)..(209): n is a, c, g, or t
  misc_feature (222)..(222): n is a, c, g, or t
  misc_feature (231)..(231): n is a, c, g, or t
ganaggagagccgggccgccgccgtctctgcggcccgcgggtgactgggccgttgccgccgtccgcgctcggcccccgcggagagatcgggctgaggggagctgcgcggctggctctcctctggtagtggccaattgaangtggatgacccaggttgtatcgggaggaatcgagtgtgtatcttggccaangaggtctggcggagananaggctgtatctantttcatgtnccctgtgcgtccaggcctcgagtggcctatcgttgacatttccgca

SEQ ID NO: 665811 - DNA, 315 bp, Homo sapiens
gagctcgcaggatgagtacggcttcgctgggcgtagcgttaggagaagtacgctctcaggccctgcctgcggctgcccgggcgcgtttctgtactgaaccaggaagtacccaaaggggccctggtccacctgccatgagaggcccagtgagaccgaggtcacggccgccaccgccagctcccgcaggcggttctccagcggcagaggtgtgggcaggggcgctgaaaagagcagagcaggcccatggggcaggaggcaggaccctgcgcaagggaggcagtgctctcccaggactggagtgagcatttcttagcg

SEQ ID NO: 665812 - DNA, 756 bp, Homo sapiens
  misc_feature (681)..(681): n is a, c, g, or t
  misc_feature (745)..(745): n is a, c, g, or t
tgtttatcgatcccacacgtgatgaaaattgaagcacaattcattcaccctccaaagtatctcaagctagaaatatcttcctccgcagatccccgtaccctgatatggaaagatctttagatgtactaagtgaaagatgccaagttagtgacatatatttatagcatgttccctaccctgtcaatgaaattccgtctaccctgagagcctctgtggaaaccttaaccccagctctctctctttgtgaaaggaatatatgaaatcagatatgtgggtctcccctttcagaaccggaccagccttaatttaagaagaactgtgggccgggcgcggtggcgcgtgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctataaaaaacttaaaaattagctgggtgtagtagtgaacgcctgtagtcccagctacttnggaggctgaggcaggaggatcacttgatcccggggaggttgaggctaacatgagccgagatcanaccaccgcatt

SEQ ID NO: 665813 - DNA, 310 bp, Homo sapiens
gtcgtttaaacctaggagtctgagaatcctggcaacgtaccgagaactcatctctaggaaaaataagaaaattaggccgggcgcggtggcgcgtgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaagagggggggtctcgctatgttgtccaggctggagtgcaatggtcaaacccaacgctaattt

SEQ ID NO: 665814 - DNA, 560 bp, Homo sapiens
  misc_feature (447)..(447): n is a, c, g, or t
  misc_feature (449)..(449): n is a, c, g, or t
  misc_feature (528)..(528): n is a, c, g, or t
gtcgtttaaacctaggagtctgagaatcctggcaacgtaccgagaactcatctctaggaaaaataagaaaattaggccgggcgcggtggcgcgtgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaagaggctggagtgcagtgacacaatctcagctcactgcaacctccacctcctggactcagcaatgctccaccttagccttccaggtagctgagactgcaggagtgcaccgccatgcccagctggtttttgtatttttggtagagacggggttttgccgtgttgcccaggctggtctccaactcctgggctcaggtgttncncccgcctcggcctcccaaagtgctgagattacagccgtaagccaccacacctggccctgttttgttttaatttaaaggntatctaatgcattccacattcagcatatgtgg

SEQ ID NO: 665815 - DNA, 285 bp, Homo sapiens
  misc_feature (259)..(259): n is a, c, g, or t
  misc_feature (284)..(284): n is a, c, g, or t
gtcgtttaaacctaggagtctgagaatcctggcaacgtaccgagaactcatctctaggaaaaataagaaaattaggccgggcgcggtggcgcgtgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaagtccgtagcnggtgtgccggatcctctagagcaanc

SEQ ID NO: 665816 - DNA, 1113 bp, Homo sapiens
  misc_feature (43)..(43): n is a, c, g, or t
  misc_feature (207)..(207): n is a, c, g, or t
  misc_feature (283)..(283): n is a, c, g, or t
  misc_feature (355)..(355): n is a, c, g, or t
  misc_feature (737)..(737): n is a, c, g, or t
  misc_feature (764)..(764): n is a, c, g, or t
  misc_feature (922)..(923): n is a, c, g, or t
  misc_feature (955)..(955): n is a, c, g, or t
tcaataaatagtggtcatgatcattctgattatttgcaatatncctctttttcatcttaatacatacacttacagtagcgtgcataaaaaaatttaatgtttgtcaagctcaataaaaattccagttatttcatgtaactgaatattcagacatacaatctttctaagcaagcttaaaaggacaatgacgtcttaatcggcagtccntttccacaatttggtaatatattacagaaacattggatcataaactaaatcgtctaggtgttccacctccccttcntcaaattggtacacgatggtttcaaaatctttttcccaatcgtattttttccgaccgttggacgttcgaatnggctttttaaaaagggagcgaacaaaacagtcaaaacctttaaaaagcagattctgtaaagttcgcttgatctctaataaaggaccatcgtgattcacttttaattggagcatggcctgtaagcaataggtgattagggcgatccaaatttgattgtaaacggcattttgactttttccataaaatctttttatcttaaggtgctgtttcatccatttaaagaaggtctctatcttccagcgatatcggtataaatctgcaatctcttccgcagaaagatcaaagcaattggttatgatgatcacgggattcccttcgctgtcgaccgtttcgatcaatcggagaggatgagtcattttggtatgattacggtcatttcctnaaatgacaatctgatccctataaatcnaacgttctggattgggaatccgttccgataaaacttcaatctctgcgttctttttaagccgggtaatgaatcgcaccccttctcggcataagcggtcgaactgtttgtaatcgacataccctcgatcaaacaagtacatcgcatttggatcgatttcnntgagttcgtccatctgtgtgcgatcggcatgnttcgcgggtaagataatcccttgatccggaacagtgatatccttcgttacaacaacctttaaatggagtcgaacaccagcctttgtcttacgaaaagttgcccatggatattggctccaactcatgctcatcgtggtagaatctatgaccacattaat

SEQ ID NO: 665817 - DNA, 149 bp, Homo sapiens
ccccttcgtgagatgctcttgaagggggtggtcaggcctgggtccatggttgcagctccctggccaggttgggctgagacctctgcctctcccagtgagaccaacctgccctctggacggatggaatggacactgtggagccgatgatg

SEQ ID NO: 665818 - DNA, 831 bp, Homo sapiens
cttcgatcaggtcatctccgagaactacagacgatggtgcagctggcgtgagtcccgtgcaggacggttacgtgctcattctctgtaccaaggtcgttgccggacgtggtcaccgtctgtaactcgagaagtcagtcttgtgcagtcaaatgtgacgccgatgcttattgcactcgatttgactgtaagcatgacttacatgctggcccaactcgtctcgtgttagattgcaaggacaagagttacagagtgacttcagtcacagttctacattccactagagcaggaccgcaagtacattgcttgagtgaaccagcaccttgtgcatttccttgctggtgcactatacctcatgtcaggccttatgcatccagtggtaccttccgtggaacagcacgagggaagaattacttcacagcgccctggtgagcgtcatggatgtacctgcacatgcgctccgataatgtctaaacagtaccatcccacgagtctgctaaggcaactagccggacgtcattaactgaaggtatgagctgacgttggtgtctagtcatgatccctgcaagtcaaggagcagctgcagctacatctgtagtggcgaaacttgatgtctcaggtgtgccacggacagacagtgatcggagggagccctatcaaacaggtctgtatccaagcttttctgactattatagagtctcccaaacatctgatatggatgtatcacatctggatgtcatgcaaatgccttaccgtttccgtccctctcacggttgctactaccttacactacggtaactgtgcccttagtggccagtctggcggacccctgtg

SEQ ID NO: 665819 - DNA, 596 bp, Homo sapiens
  misc_feature (254)..(254): n is a, c, g, or t
  misc_feature (256)..(256): n is a, c, g, or t
  misc_feature (260)..(261): n is a, c, g, or t
  misc_feature (264)..(264): n is a, c, g, or t
  misc_feature (267)..(268): n is a, c, g, or t
  misc_feature (272)..(272): n is a, c, g, or t
  misc_feature (286)..(286): n is a, c, g, or t
  misc_feature (288)..(288): n is a, c, g, or t
  misc_feature (296)..(296): n is a, c, g, or t
  misc_feature (314)..(314): n is a, c, g, or t
  misc_feature (317)..(319): n is a, c, g, or t
  misc_feature (488)..(488): n is a, c, g, or t
  misc_feature (555)..(555): n is a, c, g, or t
  misc_feature (589)..(589): n is a, c, g, or t
gtcgtttaaacctaggagtctgagaatcctggcaacgtaccgagaactcatctctaggaaaaataagaaaattaggccgggcgcggtggcgcgtgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaagctantncagnngcngannatantcactgcagcctcnanctcctagnctcaagtgatcctcctgnctnnnctcccaagtagctgggactacaggcgtgtgccaccatgcctggcgaattttttaattttttgtcaacactgggtgtcactatgtcacccaggctggtctcgaacttctgggctcaagcagtcctcactccttggcctcccaaacgtgttgggattacaggcatgagcanggtgctcaagcttgcttttgtttctttgcgcctggagtgcagtggtgcgatcatggctcactgcagnctcaacttcccggacccaggtgatttctcccacntcagtct

SEQ ID NO: 665820 - DNA, 435 bp, Homo sapiens
cataaaaacgactcctgtgcctgtgacaagagatctgactggtgtctggacaattgtaaggaagtaactctatgtaactgtgttgctgtactaacgcacggccaggtagagggcgcagcttccaaacccacagttctccgtccaccatctcccaccagatgctacctacagtttttatatagtattaaagtaatattgtaattttatgttgaggagacagtcttgctctgttttgcccagagcttgaagggcagtgtctacgattcttgactcacttgcaagctaattgcctccttggggttcaagcggattctcccaactacaagcctccaagccagctggtgattaccaacattaaaccaccatgcctggctaattattgtgtattaagtaaaaacggggttttgccatgttggccagattggtcccgaacac

SEQ ID NO: 665821 - DNA, 325 bp, Homo sapiens
  misc_feature (254)..(254): n is a, c, g, or t
gtcgtttaaacctaggagtctgagaatcctggcaacgtaccgagaactcatctctaggaaaaataagaaaattaggccgggcgcggtggcgcgtgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaaggagnggtgaaccgacccagtcggaaacgacagtcaactccgtgctgatcatagtgaaccctgtgatacatcatcg

SEQ ID NO: 665822 - DNA, 212 bp, Homo sapiens
gaccgaagtgaaaagcgcccaagtaagaagttgttaaaccgtccaaggcaaagattttaaaagcccccgggtccgaaattaaaaagcgagggaatccgatgttttaaatttttaaaacggaatttttgaaccaaatggcaggtctgtgtatttaaggagctgcgaggtttgttttaccggcttattctggacctgccttccaccccaagttt

SEQ ID NO: 665823 - DNA, 308 bp, Homo sapiens
gtcgtttaaacctaggagtctgagaatcctggcaacgtaccgagaactcatctctaggaaaaataagaaaattaggccgggcgcggtggcgcgtgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaagcccgcgtgaaggtccccatatctgataccggagcaagtccggactcacgttctgctct

SEQ ID NO: 665824 - DNA, 620 bp, Homo sapiens
  misc_feature (47)..(47): n is a, c, g, or t
  misc_feature (545)..(545): n is a, c, g, or t
  misc_feature (609)..(609): n is a, c, g, or t
ctggtgtagtaagcacggactcgcgccgaggtgataacaccggacanggacaaggtgaataagcatgtgttccagtgagggtgtaaaagcagacaggccaagtgcacacagcattggagtgcagtgcagcgtcagacatcgtagaggatgccgccgattgggccaaacagcaccagtgccagggcacaggtggcgcagtgccatgtagtcacgagcatacctgcgggagtgctgaggctgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctataaaaaacttaaaaattagctgggtgtagtagtgaacgcctgtagtcccagctacttnggaggctgaggcaggaggatcacttgatcccggggaggttgaggctaacatgagccgagatcanaccaccgcatt

SEQ ID NO: 665825 - DNA, 406 bp, Homo sapiens
acgttccccactggggtccccgaccatgggagtgagcctctcccccaagcctctcctcaccatctggtgtctgtattgttgtctcatacagatctgccataatcgtggctgacttaggacctccaattcacccctttccctcaccacaacattctgggaacagacaagggagtaaatcagtggctctcccaatacagtgaacagtagtcggctgccatctgggctccagctaggcagtctgacagtgccctgtagtagagtaggccacctctcacaagtccacatctgtgcctcccagactcgaaagacagctgaaggagtggtagccaggattttgctgccgtctggggaccagagcaggttggtcaccccacctcctcgaaaccagggaagggggacacaggtc

SEQ ID NO: 665826 - DNA, 518 bp, Homo sapiens
  misc_feature (443)..(443): n is a, c, g, or t
  misc_feature (507)..(507): n is a, c, g, or t
tagcaccccgctacggtcttacacagaaaaacaacagagaattggaaaagcctaagaaagtacatgtaactgaagacatgaaacacgaaaacaatgcaccggtgtgagatctcaccagcacttgggaggccaaggctgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctataaaaaacttaaaaattagctgggtgtagtagtgaacgcctgtagtcccagctacttnggaggctgaggcaggaggatcacttgatcccggggaggttgaggctaacatgagccgagatcanaccaccgcatt

SEQ ID NO: 665827 - DNA, 438 bp, Homo sapiens
  misc_feature (363)..(363): n is a, c, g, or t
  misc_feature (427)..(427): n is a, c, g, or t
aatacaagatgtagattagcatggcatgtatttgttttttttttaaactagtcggctgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctataaaaaacttaaaaattagctgggtgtagtagtgaacgcctgtagtcccagctacttnggaggctgaggcaggaggatcacttgatcccggggaggttgaggctaacatgagccgagatcanaccaccgcatt

SEQ ID NO: 665828 - DNA, 503 bp, Homo sapiens
ggagaactagtctcgagttttatttatgttatttaaggtttgagggggaatgctggaccaattgtaatgggtatggacaacctgtcctataagtaatgctagggtgagtggtaggaagttttccataggaggtgttctgagtggggccgtagcggaatcgggggtatgctggttcgaattcataagaacaggaggcttacaacgtacgggtctctgagtcgacacaacctactgtcgtgtacaacgtccaggggcacgagttgcgatcaatatgtagtacctagagaagattgtacaaggatcgagaggctgctaacaaaaacataacacatgaaccgagagagcacacaccagaaccaacagtacaagaaaataggaggagcaaaggggcggccagacaggacagaaatccagcacagcttgcaaaagcccgaaaacaacaaaaagcaacaccccgcaagacggaaaaagacacaaacagggacaacaaaagcgaaccaaca

SEQ ID NO: 665829 - DNA, 153 bp, Homo sapiens
ctgcctcagcctcctaccaccccctgctaatttttgttattgttgttgttgttagagaatggggtctggctatgttgcccaggttggatcttgacctaagggcctcaagatgatcctcccacctctagcctccataacgcactgtgcaatttc

SEQ ID NO: 665830 - DNA, 560 bp, Homo sapiens
gagaggagaagagaaaaaaaaagagtaagataggagggaagaagaaagaacaaaaaaaaggacaagagaagagaacaggaggagcaaagagaaaggagaatagattcgtaaaagagagagcagaagagaaagacggaatagaaatagaacgacagtgcagaaagatgaaagcagaagacaggatacagagatacaatataaggatataaagctagcaagagagcagcatagggagcagaaaagacagaaagagacagagaaaaacaagcagcactaaatgcacggtcaaaggaaaaagacaggcttacacggtatggagcaacgcaataagctgctatatatgtgatagagacatccagcattctgcatgagaaatgtaagtgaagtagagcattataatcgaaaatttataatccagatttaatccacaaaataacattaataatccagatcagctcctcataatatcactcggaatatcgctctgtctctctctctctctctctctctctctctctctctctctctctctctctctctctctctctctctcctcgtgc

SEQ ID NO: 665831 - DNA, 190 bp, Homo sapiens
ggcttaatcattgagaccgaattagtcacatggtcttcaagattgtcacctgtacaatctctgcaaggaagaaatgtttgactagaccactggcgtgtgacttcagaggtccgaaaggagagctgtgggctgcttttgaaccccatgtttcagcaaagtattcttcatgccagatggttgctgcggaaat

SEQ ID NO: 665832 - DNA, 1647 bp, Homo sapiens
  misc_feature (314)..(314): n is a, c, g, or t
ggggacttcgaggcccgtgttacgcggtactgggcccctcgctcccgtcctccagtcggactgcgggccttggcagcgccggccccgtgtgcgacacgtgaccgccggctgtgggcggggcgcgctccgcgcccccggggccgcttctgtaagtgtgtacgtggcacggcgtctagtcgccgaagatagacagtctcgggtctcctgcaggaccacgaggttatcttgtatggatacgcagttccggtcccgcgacgtgaattcgtgaggaagcatatcacgggctcgcacgaaggtagatgcagtatggagtncttggcgacgtgtgcccacgtggctcgcgcgatacatgagctggggatcgtacccacggccgcgcaatctggcgcgcccggggtgacgtctcgcgtctgcgcccgaggacgtcgatctctcaggggaccgccacaggaggacaccagcggttgatgtgtactgtggcttcggtcgtgcgtggcccccggtgcgctagattccgtttgccattctcacggtgggcccgacgcgttgagtccgctcagctgttcatgcactggacggaccccgtctgggatccttctctcgctgagggggggtcccaccccgggtcgcggcacccgcgggagttatgatcatgtgcagtgcgcacacacgcgcagggactggcgggtgctgcatgccgtccggggttctcttccacggccgcgctcccgcgcgtgtcagtcgtgtaacggcgcggtagttccgggagtcacagtcgatgccgacccctttcttctgagggggcgcgcccccatggccagacaggggcgccaggaagtgctcagggccactggagacccagttacctagagataacccacgaatgaccgggcgagcgcgtcatcagccgcgtcccatgggcgctggggacggcattggaaccaacagggtggccgcctgcacgcgacatgggacggggcccgcctgtgtcgccgaaccgagggccgacgagacagcaaccgtgccaatgcgcccccggggggctcaacccatggaccgcaccgtggccaaagggaaggatcagccgagggcactaggggcacaccccggcagggggagctataacggaattcctcccaaacgggtccaaccagggcggaagcgggaggggggaacccagggacacgagacgcggcggcgaagaacgcaaccatagcccaggccacacactatacgcagcggccggcccaccgcctcacacaactcaccgaaggcggaacacccgaagcagtcaacacgggcccgtcgtacggctcgctaagggtcgaacacattccagaccagacatggtgacacacaatacttgacgacttgttactcgccattacaccagacacaggccgcttgtcaggcactccggcgcatatccagtcagcacaggaccgcggcaaacaaggcaaccaccaggagcagcggaaccaacaccacatacggtagccagggcgaccccccgcgatgacaaacctcgtgcacccagaccacaatatagtcggagcacatgggcacaaaccgaagagcgagtcgtccatcctaagcagcagagcaacactaagagatcgtcgctagtcaactcacagaccccagtaa

SEQ ID NO: 665833 - DNA, 121 bp, Homo sapiens
attaattgctcgtgaatgtcataaaagcaaaatgtatatctaaaaaaaaagggagcggcgccctttttttcctggatatctgtgtattttcaaatgttactatatattaaagcagaaatat

SEQ ID NO: 665834 - DNA, 516 bp, Homo sapiens
acgccgagttcggagtatgtgagatccaaaggaaatgctatatgtaaatcttgttgtaaactgaaaaaagttatgcactcgattattatatttgatgatggcaccttgtagggatctggttaatgcctcatattcactgagtgcttgactttatctatattaacacatctcatctttatgacaatctgtgagaagtaggtactgtgcattcatattttacagaggaaagtacagcttatatatggtagacccaggatttgaattcatagagtctacttcgtagaaggtgtgttcttagactccagatgctcatgcgtgtctatattggtttccgtgtgtgacttctccttcctttccttctcccctcccttccttccttccttcctttccttctttttttttttttttttttttttttttttggggaggggggcccacctttttcccccggggggggggggcgcaccttggcaattcccccggggacccttgacccccggggccaagggagccccc

SEQ ID NO: 665835 - DNA, 104 bp, Homo sapiens
catatcaatccaccccggcgggacgcatcggaatacagacctgagtggaaatttctttgagaaacctcgaggttctacgtcagacgcgtatggacggacatcct

SEQ ID NO: 665836 - DNA, 1074 bp, Homo sapiens
tgatcactatgcgaatccgttgccttggagacactggatttctgagtgaacgggtgtcataaatgtgaacaagggaaaatgcgatgggtcctgccattcttgcgttgtgtaccctccatgatatctgaatgaagatccacggagtggagatccagacaaggatgctgatacatggatcgcacaaactcgcgattacaagttcgggtccatgaggtgtcatctcgtatcttagtacgagagttgtgtgcacagaagcgtggacaggtcacatgattaccggacagtactgggactgcaatcatggtgtcacgcgcagttcgtttgccgttcagtgacgtcgaagtgatcatcggttatcattagagttggactcatatgctcttccttgcaggaggataatccgggggcatcgtacgtcaactgaaaaactcatgatgaattcttagtatataagataagcatttgaaaagaacagtaaaggacaaactaagacaaaatcaggcatctgctagagccggtcaggcccagcatgaaagcatagaacacctcaccacagaaggcgcgagccggaccgcggataaaggcaacgcggaacatgacagtccagaaagaccgcacgaaactgcgggcggttccccgactgaaacgcccggggaaaccgtccgcaaaacccaagaagtgacccgggtacagggaatacaaaggcgcaagaggcggacaagacccgcccaggtctgaacgaacaccagcacacaacggatgacagaaacccgtacaacagtgcacaacacagcagaacagccacacgattaaaccacaacaaaagaactcataaccggcacaacaactcaaagtggcaaaacaaagaaaaggaaggcggcagccgagccggacgacagcgacgcaacacatcagcaccacacgagcctgaggaaagagacgcggcacgaaggccaagcaaaacccagaccagaacgaggaaggcagacacaacgccacgccccggcaaacgcacaacctaaagagagaccagagaaccacgacagcacggaagacagacaacagaggaaagcc

SEQ ID NO: 665837 - DNA, 103 bp, Homo sapiens
cagaatactgaactccagtttagagtcattgcagctgcccaggttggcaactttgcattttccaggccacagttgctcgcgattgagatggggcagctgctgg

SEQ ID NO: 665838 - DNA, 228 bp, Homo sapiens
ggtctatttgttagtaaataacagggaaatcattttcacttttttttaaaaataaggtatttacaagcataccttgtagttattgtgggttcagtttcagaccactgcaataaagtgaatatctcaataaagtgagtcacatgaagttttttggttttcccctgcatataaaagttacatttacaccatcctgtagtctattaagtgtgcagtagcattatggctaaa

SEQ ID NO: 665839 - DNA, 284 bp, Homo sapiens
caatgcggtagctgctatcatgcttcatagcgcctaacaggaagaactgcatcgaatcgaacagtttgtcgaactgcccggtgacgggtgccagcggggcagatgtaagccctgggagggagtcgagcccttctacatcagccacaggctggtcaactgattcctggtcaaactgaggcacgagaagctgagacatccgcatggcctgacagttgattctcgacagctttgggtagagtgcccaggccgccaagagccgggccttgtaagccaaccggtcccta

SEQ ID NO: 665840 - DNA, 134 bp, Homo sapiens
tgatctagaggatcccattggaagatgtgctgggatgtgggagtgccagaaagccacgagagacaaagaggaggagtaggggaggtcaggaagggagcaggcgggcagttaccctacacagcacatcttccaat

SEQ ID NO: 665841 - DNA, 350 bp, Homo sapiens
gcttatcaggaaagaatttttgtaaggctggtcctttgtccaatcagagctatagtggtttggattgtaaatcaggtttggtaaggttctgacaattttcccaatagctcctatttttagcaaatttagcaagattgtgttttttcttgtagccttaggaatttgcgaagttcccatgccaaccaagccctgaaccctccacccataggtaactttcgttttcttaactttagggttcttcttagttgataaaggagcatccattttggtcttccagataacagaacacaatctgacagggcaattatgtggctaaaataatgaaatattaaaaactgaattttccccag

SEQ ID NO: 665842 - DNA, 132 bp, Homo sapiens
tgagagaggaggaggtatcttggaatcacgactacagcttggtaatacatggacacctggtcagattcttattccttcactttaggggaaaatctctggtttttaaaaagtgataaatttggtgttaggtca

SEQ ID NO: 665843 - DNA, 240 bp, Homo sapiens
tctaaggatcccccaggtttatcgtaaacactctgtgctagaggaatattgtatacacaggatttcataaagttcgaaatgaccggcatttatagtttgttctttttgcatatgtcttaataaatattcgtcctacaatttcttttcatactaagagttttgttatgattgccaaatttctcaagccaagaacaggcccaggaaaactttgaaagtgccatatcagaaacacatttataa

SEQ ID NO: 665844 - DNA, 120 bp, Homo sapiens
gtcacaacccaaaataaatgtcatagtcaagatttgtagataattaaattactattctgcagttgggagttaaatgtgatagcacatacgctgacattatgcatttagagatgttattaa

SEQ ID NO: 665845 - DNA, 1128 bp, Homo sapiens
gctgtgatggacaagaactgggccgtgctctatgacctcttgtgcggcaactagacgtgaattgattcggcatccgcaatgtgcttcagacgtatcctgatccctctaactaattgctagatcgtaacaacccttcagtgtgatcctgtccgaagatatcactgaacccaccaaggatcagtctatcaagagaaaaaggtgggagtaggaacacgatcatcgaaaccatctccatcgtaacttgtagctgtgcgagtgaacatttcgcaccttggcaggagacattggagtgaaatcctataaatacatgttgaagcacttgtcctatggtaatcgacgagggatagcttatgccatcataggatggggaacagtagagtgagagctcagggactcttcgacctactagtcactatcttgagccatgtatacactgcgagtcctgtgtgcgtggcgccaaagaagtaattgtggatggtgggtagaccatgcgccgaagagagaacccgagtctgctctatgcaagcggcagcctcaacaagttaatatgggtggcgatggatcattactatcgggacagctctactcgtgtatgtgatgaccgggatgtactggggggaccctttctggaaatgggtgctggaaaatttgccctggtatagtcaacatggcgacggacttagggagctggtcgaaagaggcctactttgggcattggaagtaacctgttaccaggagtcctggggcatggagtcctgggatttctgctcgttccgttgtggtcctggtgcgcctctgtggaccccatcgcgatgcgcagggaattagccccccacgtaatgtatttaacatgtggcgcggactggtccaacgaggggcttgcaataaggccgaagctttgcgctcttggcgggccccgtcctggacaacgtgcggaacacattttggtaaggtcgtctatccaccagaatattcaaccccgagaaattatcgcccccaaccttgtctgagaagcgccccaaaaacaccgagcggaggggcgcaccaaaatagtcgcggcacgcaggacacacccaaccccaccgcctttgattcagcaccaccatgaggggcgagcagaaactcaca

SEQ ID NO: 665846 - DNA, 221 bp, Homo sapiens
tttattggaatagagaatacagacagcaggaatcacgcttggtgatgtcacctgcaggtcccctgcccccacgggctctcccacttgtctggatcaggggagacctccactttgaagaacaatatgggctgggagcctccaatgtgcattctgttcccagcttcacgattagcagcatgatcccatcagcaacagcaacagcaacagcaacagctacagca

SEQ ID NO: 665847 - DNA, 483 bp, Homo sapiens
  misc_feature (354)..(354): n is a, c, g, or t
  misc_feature (394)..(394): n is a, c, g, or t
  misc_feature (418)..(418): n is a, c, g, or t
  misc_feature (425)..(425): n is a, c, g, or t
  misc_feature (437)..(437): n is a, c, g, or t
  misc_feature (441)..(441): n is a, c, g, or t
  misc_feature (447)..(447): n is a, c, g, or t
  misc_feature (449)..(449): n is a, c, g, or t
  misc_feature (452)..(452): n is a, c, g, or t
  misc_feature (469)..(469): n is a, c, g, or t
cagtatggaaccccagctggggtccctattgagtgccgactccccccacgccagcagctgctcctccagccacacccctcctgtccccacctagcccttgagcctaggtggcctgacccgctcacaggcaccagatgggtcctgagaccctccccaggctgttaagctcattctgctgggggtacaatgaggggagggcagtaagttaacacgctccggactagcaagtagaacgcctggggggatgcgtgtgcctcagtttcctcctccacaactgaatatagtggctgaaaactggggagatacttgatggcgcgaatgtccgttttctctcccttcccacctctgcaggangcaggacggggcaggcagcacctggtaggcacagtgcttngcccctcctccccttccttctggnagtcttngggccttagtgntttnaacaancngtncttgggcaaataaaagnctaggttgtttact

SEQ ID NO: 665848 - DNA, 247 bp, Homo sapiens
  misc_feature (91)..(91): n is a, c, g, or t
  misc_feature (148)..(148): n is a, c, g, or t
  misc_feature (187)..(187): n is a, c, g, or t
  misc_feature (203)..(203): n is a, c, g, or t
  misc_feature (232)..(232): n is a, c, g, or t
  misc_feature (242)..(242): n is a, c, g, or t
cgacagcaagaaccggtcgccgatcgtctccggcaagcagctgaaggaagacgacgtctataacggcgatcacgggccggggaacgacatntactacaaggccgccaacgtgctgcacacgctgcgggcgctgatcggcgacgaggcnttcttcaagatcacccgtatcgccgtctatggccgcccngaccccaagcccggcnacttcaccacccgctatctgggcaccaangactatatcnagatc

SEQ ID NO: 665849 - DNA, 698 bp, Homo sapiens
  misc_feature (36)..(36): n is a, c, g, or t
  misc_feature (82)..(82): n is a, c, g, or t
  misc_feature (97)..(99): n is a, c, g, or t
  misc_feature (104)..(104): n is a, c, g, or t
  misc_feature (112)..(112): n is a, c, g, or t
  misc_feature (119)..(120): n is a, c, g, or t
  misc_feature (123)..(123): n is a, c, g, or t
  misc_feature (125)..(125): n is a, c, g, or t
  misc_feature (142)..(142): n is a, c, g, or t
  misc_feature (144)..(144): n is a, c, g, or t
  misc_feature (153)..(153): n is a, c, g, or t
  misc_feature (159)..(159): n is a, c, g, or t
  misc_feature (183)..(183): n is a, c, g, or t
  misc_feature (188)..(188): n is a, c, g, or t
  misc_feature (193)..(193): n is a, c, g, or t
  misc_feature (207)..(207): n is a, c, g, or t
  misc_feature (219)..(219): n is a, c, g, or t
  misc_feature (221)..(221): n is a, c, g, or t
  misc_feature (236)..(236): n is a, c, g, or t
  misc_feature (259)..(259): n is a, c, g, or t
  misc_feature (267)..(267): n is a, c, g, or t
  misc_feature (276)..(278): n is a, c, g, or t
  misc_feature (280)..(280): n is a, c, g, or t
  misc_feature (300)..(300): n is a, c, g, or t
  misc_feature (302)..(304): n is a, c, g, or t
  misc_feature (307)..(309): n is a, c, g, or t
  misc_feature (314)..(314): n is a, c, g, or t
  misc_feature (318)..(318): n is a, c, g, or t
  misc_feature (335)..(335): n is a, c, g, or t
  misc_feature (346)..(346): n is a, c, g, or t
  misc_feature (356)..(357): n is a, c, g, or t
  misc_feature (411)..(411): n is a, c, g, or t
  misc_feature (415)..(415): n is a, c, g, or t
  misc_feature (448)..(448): n is a, c, g, or t
  misc_feature (482)..(482): n is a, c, g, or t
  misc_feature (495)..(495): n is a, c, g, or t
  misc_feature (504)..(504): n is a, c, g, or t
  misc_feature (517)..(517): n is a, c, g, or t
  misc_feature (581)..(581): n is a, c, g, or t
  misc_feature (664)..(664): n is a, c, g, or t
ttccaggcgaagtgcaatactttgattccatgtttnaggaatgacacggataaacctggaaatcctcggggggttgaacaanttcttcacacgtccnnnggtantagtaccnccttcannccncncgtccaccatggcggancnccgcctgtncggccnccattccactccctgctcactgtngtggntggtntagctctttacatncatttcagaggncngagacttgcagcccngtgttataattgccgttatcttnttgatctngagtagatnnntntctagccgctgcttgttgtngnnngcnnnggctngccnggcattcacacgtcccngggcattcagncgggcacggnngggttcccagtaatctccccaccaagatttcttaaacgaagaagctgttatttncttnttttctatctttccattttccatacccaggggngtggaacatccatttacctcacaaccttgcagtnccaatcgaagggnaggtctgtnataggctcgagtnggagagatcctaatatatctagccacaataggtgggtcaaactgattctcttttattgtagatncatctgaattgccattaaaatacatcacattccttgtgctgttccctttgaagatctgccagttgatcttgttggaactgtangctacatagaactctgtggtatagcaggacttca

SEQ ID NO: 665850 - DNA, 719 bp, Homo sapiens
  misc_feature (203)..(203): n is a, c, g, or t
  misc_feature (210)..(210): n is a, c, g, or t
  misc_feature (606)..(606): n is a, c, g, or t
  misc_feature (608)..(608): n is a, c, g, or t
  misc_feature (687)..(687): n is a, c, g, or t
cgcacgatggcgcgtccttggtcactgtaacctccacctcccgggttcaagtgattcttctgcctcagcctcccgagtagctgggaccacaggcatgcgccaccatgcccggataattttgtatttttagtagagacagggtttctccatgttggtcaggctgttctcaaactcccaatctcaggtgatctacctgcctcggnctcccanagtgctaggattacaggtgcgaaccaccacgcccagcccgaaacacattttttgtttgttcattgttttgttttcgagacagggtctcgctcttttgcccatgctggaatgcagtgcgctatgccgatcgggtgtccgcactaagttcggcatcaatatggtgacctcccgggagcgggggaccaccaggttgcctaagaggctggagtgcagtgacacaatctcagctcactgcaacctccacctcctggactcagcaatgctccaccttagccttccaggtagctgagactgcaggagtgcaccgccatgcccagctggtttttgtatttttggtagagacggggttttgccgtgttgcccaggctggtctccaactcctgggctcaggtgttncncccgcctcggcctcccaaagtgctgagattacagccgtaagccaccacacctggccctgttttgttttaatttaaaggntatctaatgcattccacattcagcatatgtgg

SEQ ID NO: 665851 - DNA, 316 bp, Homo sapiens
gtcgtttaaacctaggagtctgagaatcctggcaacgtaccgagaactcatctctaggaaaaataagaaaattaggccgggcgcggtggcgcgtgcctgtagtcccagctactcgggaggctgaggctgggaggatcgcttgagcccaggagttctgggctgtagtgcgctatgccgatcgggtgtccgcactaagttcggcatcaatatagtgttcttcccatatcatggaacttagattaaacctatgcatttgtgtgccggcccaggtcggatccggagcaggtcaaagcatcccgtgcatgatcagtagtgg

SEQ ID NO: 665852 - DNA, 615 bp, Homo sapiens
  misc_feature (254)..(255): n is a, c, g, or t
  misc_feature (269)..(269): n is a, c, g, or t
  misc_feature (288)..(288): n is a, c, g, or t
agcggggcggctggcgtggggctgcttagatgcgccacggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacatttcnnctcatatcaagaangaatttgacaagaagtacnatcccacctggcattgatcgtgggaggaacttcggtagttatgtgacacatgaaaccaagacacttcatcgtacttctaccgtgggtcaagtggcctattcttcatgtgcaacatctggttaatagaggcgatggactgtgccatacacccagtgatccagtccaaaaacaaggactgcagcctagattccataataccagagactgaaattgtcatgccttgctaagggaacatcgtcgatgtttgaagccttagtgtgatccgtacagggcattcgtctgtactagtttgtcgtggttatgaagacaattagcagaatagtctac

SEQ ID NO: 665853 - DNA, 558 bp, Homo sapiens
  misc_feature (166)..(166): n is a, c, g, or t
  misc_feature (262)..(262): n is a, c, g, or t
  misc_feature (544)..(544): n is a, c, g, or t
gagacttgatggctggcgatggcttgacctgactgacagctacccctgcgcatggtgcacaatagtcactcgtcgaccatcttctctcgagttcgaatgtccatcattcgcttacagaccggggcgctgggtaatcaattggacctacctgcaagtctatcgtggnacccatgttccgagaatgagaccgtaagtcggagacaggctcgacgagattgagcgttccaccggagacgatagattaggaatacttgactgggantaaggacagaaatgctgaccaacactgagttatcctcatatgtggctcgctcgctcgtttcagacaggaccacctggtgacctaaaatgttctggatgaattcaaagaagcaagtggttatacgtaatatgtacgtaaggagtatatgtgccactacgaagccctttgtctccagcttccctttaacaataccatggcatgttcgtgctggtcatgcatagagcaaacgctctcgagtgtaatcccatgaccatatacaccagtggagtagaggtaattgantccccgtcggacga

SEQ ID NO: 665854 - DNA, 859 bp, Homo sapiens
ggcgcgcgcgaaacaataataagatcgtgtttgaggtcgctgcccgagaaggaattcggagcatgacgcgaggcccgggctcgcgcggggcctgggagtccgggagggagaccggcagcggccggcatgaggcagggcgacggcgggacgcttgggtgagcaggcgcgctcggccggccagcccggcggtccgggtcgaccgagagaacctttggttggcggacaccgggaaacgcgggtcataagtgggccgcaaatcaggcgccgggggggctttcccggttcctccggtgggccgggggcctccgcgggaattatgggcgcgagggtgccatgttgcttaggcggccccgctctgggggtgtaaaggcgcccctttgtgagctctgtccagtcgccgcgccgggccaattggcgagtggattcccaccacattcctgttccggtgaagattgggccgtgggattcgtcaccgcggccacggtggcgtcttggaatgggccctttacaggtgggtccctgcgctctctggcgcccgtattctatccttgtttggcgcccgggctggtggggggggcggggacggaggactcttcccccggggcgcattattaagtcgggcggggagcgtgcctcccactagggggcacgtgttttcttctaccggcgggagcgtggcggcgactagccggtctggtggctcaatcatttggaccgcccggtctcggggcggcggcccacgcgtggccagtatgttcgagaagggtgcggtgggacagggaccccgggtggtcttctccgggccagacgtaggcacttctacgtggtgctacccagtggcttgttggtggccgttcat

SEQ ID NO: 665855 - DNA, 285 bp, Homo sapiens
tggtctctgcattaactgtgagaaaacatcatagtctgaatctgcctaatttcaaatgccaagctgtgcccacattcagcccacaactgaacctgaatactcaatatatccttagcattgctactgttgtcatcatggtggatgttaagtacaggtttgcccaagctatgatgtttaattgttgccttactgcttctgtatttcttctgtttccctgaccctttgggacaccaggggcatggaatttaaaagtagtaaaaaggtaaaaatgggaaaaaaaaaaaa

SEQ ID NO: 665856 - DNA, 320 bp, Homo sapiens
  misc_feature (32)..(32): n is a, c, g, or t
  misc_feature (64)..(64): n is a, c, g, or t
aaagaatggatcatggtctggcacaacgtggnatgagctgaagccattatccttatgaactcanccagaacagaaaaccaaaatccacatgtttcacttatagtagaagctaaacattgagtacacatggatacaaagaagggaaccgcagacactggggcctacctgaggtcggagcatggaaggagggtgaggatcaaaaaactacctatctggtactatgctttttatctggatgatgaaataatctgtacaacaaaccctggtgacatgcaatttacctatatagcaagcctacacatgtgcccctgaacctaaaa

SEQ ID NO: 665857 - DNA, 353 bp, Homo sapiens
  misc_feature (353)..(353): n is a, c, g, or t
ggcacgaggagccgcggacgcgctacagctgagaaggggacccaagaagtcggccgcggccaaggccgctaggaccgccgcctcagctcacgctgccgacggcagctatagacattctgcgtgagggccgcgctcctggacttcgcctttcccgagccctggaggtggcgagaatcgcagccctgccgagcgcggtggctcacgcctataccgtaatcacagcactgtgggaggccggatggcgatgtggtatacgagagtgagaggagacctatagagagatagctgtgtagatgagatggtcattatctggatatatagctgtagaagatgtgttccactaggttcagagn

SEQ ID NO: 665858 - DNA, 180 bp, Homo sapiens
ccctccataatgtgtgcccattctctttatggcgtttcaactttttcttctctttaagtctttacatctttgctttgtatttggttttttctttctttctttgtgggtttttaggaagaaacggagtctttgtctttcgcccagcccgaactgcaggggcgctggccacacattcggggg

SEQ ID NO: 665859 - DNA, 299 bp, Homo sapiens
tttttttttttaagggccaaaagccagtggtggttttcatgttccaagtttgagagcaccagcccctcttcttttgggccgggaagggttccctgtcattgagcagcccagcctgagggggggcctttgtcacccctttttccccggccttatttgacagggggttacatggggctccccttacggcccggggattaaatcagttacgggccagggtttccttggggggccgggaattttgggtcctcctatgacccttgggggcctaaatgaaatttttaaaatccccgagggaccca

SEQ ID NO: 665860 - DNA, 553 bp, Homo sapiens
catcgatgctgtccgaataatacaatgggaaagaagtgctcctccagagcctccccctaggagtcacatgttctctacacttctgctaatgagagcattatcataagtgctgcaaagtgccaaagagaatcgttttaataaacagggtttgtatgctcttaaaaaacttgaagacaagcacttgattctattagctaaagtacactgcagctatcaaaggatcacggtggaatggagccacatactgctgtctccaaactgacatcatcggcacttaaaagattgaattcttaaacacattcggctccaggtaagcgctcccagactaattagagttatccatgcaaagttctagaactataagtgtgcttcaaatattttgtactgcatggtatgattgtgtttctcaactgggggaggccactcaatgtaaaccataattactattgcagattacctgggaagaaaaacagtatgcattacaggcttcagtaacagccagctttaaagcacagacagtgaccaggactgtcagatgacttccctaggggac

SEQ ID NO: 665861 - DNA, 549 bp, Homo sapiens
tctcttcttgtctgcatgtcttatttcagtaaggcagtcttcatcttttctgaatgtcttatttcagtaaggtggtcttcacactctgatatcctttcttccacttggtcaattcagctgttgatacttgtgtgtgcttcatgaagttctcatgctgtgtttttcaggtccaccaggtcatttgtgttcttctctaaactggttattctagttagcaattccttttgtagcaggaggagccacagacaaaactcctcagacaccgggttaaagagggaaggagctttattcagctgggaacttcagcagacttgcgtctcaaaagccaagctccctgagtgagcaattccgtcccttttaagggctcacaactctaagggggtctgcgtgagaaggtcgtgattgattgagcaagcacggggtatgtgactgggggctgcatgcactggtaattaaaacggaacctatcaagacagggatttttacagtgcttttttattcaacggcttaaattctattgataaccctacccggtctcgtctagggtct

SEQ ID NO: 665862 - DNA, 137 bp, Homo sapiens
taattcttttctccatctcttgtcccactgcatgagcatatcccacagcatgtggaggggcaggccacccttcataatcccagcgtgctcagaaggctgaagcaggagaatcgcttgaacccaagagatggaggttg

SEQ ID NO: 665863 - DNA, 1538 bp, Homo sapiens
  misc_feature (357)..(357): n is a, c, g, or t
tgggtttaaatctggtgtttggaaatttttttcaaatgtggaaagatattacagaatagaaaacacatcattctagggtttcaaaactcaccaagagtcaggtgagaaaaaagtgtacatttcatttaaagtggtaactcattggtaaataaagaaatctggaaagaggcgtgacacgattctcaactccacaattgtgaagaaatgtgactctagaattttccaattaatctctttttataaactaaagtggagttaagtgtgtagaatatataggtggtcacgtatcacaagttgtgcgacatctcgtggactctcattctcaaacaatatagtgtcaacattccgcttgtgtgngcgtgtggggtatgtgtggatgtgtgtttccagaagaacttacaaaatttatcatatagcccattctcatataaccatatagtatatttttctcaggtataacaagagcaattatatattagaagccacagtgaaacaacactcgagaacagaagtggtctctcgagagagagaggcctttatatataaatctctctctatagagattattcacgaccaccattttttatttaacgcgtggccatttatattgtgtcttataaagaggaaacaccaaaatgttttttagagtctagagtgcgccataaattctataaagcccaaaagtggggaaagaaagaaaacactgtgtcttatttccaagagatttatttacgagattcttccgcgattttaccaggcagctttaaaaagaggggcgctaaatttattttcaacaacacaaatttaggcgtgtgtttaaggccccaaaaaaaaggtttggccgctataatattggggacatgaaccgggggttacttcaatgtcttccttgtggaaagggccacgaagaaggcctatccaaagaataagggggtgctttatttaaaacaggacttccagcgttgttgtgtggaaccctttccttcccattttttacaaagagattcccttggtaataaacaattccctataaaaggtcttggagagttttccaaaatttccccaggaaaagatggcggggggagggcgcacaaatataatttcggagaaaattctccaggggggcggagactataatcagcgcttaccacacgtagtagaccgggcgtccacaaggtgttttcccccaaaaaaaccgggaaaagaacacaccgcgggcgtcttattcccccaaaagtgacgcgttgggttcgataagacccacagagggatctcaaacaaaggatggaaaccaccccagttgtatggaacgactataggtggtacgcacgacgaaaacagaggagtaagatactaaacaaggaaggcagcgaaatatctcaagccacattatcaacggggtggactaaccgcaacaacagaggcgccactagtagagaagaagacgaccgcaaaaagacgaacagagccactgaacaaaaagggagagggaacaaagaaagaaacaagaagcaggcgacatatatactaacaatgcc

SEQ ID NO: 665864 - DNA, 318 bp, Homo sapiens
  misc_feature (166)..(166): n is a, c, g, or t
  misc_feature (197)..(197): n is a, c, g, or t
  misc_feature (301)..(302): n is a, c, g, or t
  misc_feature (311)..(311): n is a, c, g, or t
tgccaaagcgtagtacccaactatcaggaagctgaagggggaggatcgtttgagctcagggggtggaggttgcggtaagcctagatcaagccactgcactccagcctctgtgacagaaccaggccctgtctcaaagagaggaagagagaacagagacattctgganacattctttttctttctttctttctctttcntttccttccttccttcctttccttccttttcttcctttccgtttctttctttccttccttccttccttttcttcctttccctttctttttttttttcttttttnngggtcacgnttgggca

SEQ ID NO: 665865 - DNA, 150 bp, Homo sapiens
ctgtcgtctagaggatcccgtcttaccacctcaatgaaccaagcttggaggattaaaaggcatttagcttaaatacaaaaataaatttcgttgaaaaaacgtgtaaatatttttttcttttaatttagacacacgcattcatacttctcc

SEQ ID NO: 665866 - DNA, 477 bp, Homo sapiens
  misc_feature (365)..(365): n is a, c, g, or t
  misc_feature (395)..(395): n is a, c, g, or t
agcaattctcctgtctcagcctcccaagtagctgggactacaggcatgcaccaccacgcccagttgtatttttagtagagatgggtttcaccatactggtcaggctggtctcaaactcctgaccttaggagatccacccgccttggcctccaaagtgctgggattacaggcatgagccaccgcacccggcccatgctctctcttacacacatgcagaccacatcctttctctctcaccagatataccagtctacacacacacacacacatacacacacactctattaagatactttcacttttatatatacacactcacatctagatttctgcctggatggcataatttgggtcctctcagtganaactatttaccaaccctagatatcatacantgccactctactctgggactttgatggttgggggatgagagggaggtcttgtgtttcaaggggggggggggggggggaattc

SEQ ID NO: 665867 - DNA, 335 bp, Homo sapiens
  misc_feature (81)..(81): n is a, c, g, or t
  misc_feature (112)..(112): n is a, c, g, or t
  misc_feature (303)..(303): n is a, c, g, or t
gggccccctggggaattgggtctgctactgatggatgactgtctgagaggcttgcatatgcatgggcaatgaactccaggntggagggcactgtactgagatttagcagganctgactccaaatcaatgacatccccacactgatccctttccaattttagcttgctgccagttgaaccagtgggcccacctagaattacctggagcttccatctttctccgggtgtcatgacgccccttctagccatgccagccctgggccctccatggtgtctttgtccctgcaactctctcatccagggnaccacaggcaagaagctcccttctctactctg

SEQ ID NO: 665868 - DNA, 545 bp, Homo sapiens
ttggggctcattcagggattcgggaatggtatgggtggtacattctttggtgtctattcggttggtcaagtgagtcaagactggctttggtccatttggattggtgtgtattagtctgagtctgggtccgtttggaggtatgagcaaagtttggcgggattagaagttaacctttagggaaatcccttatttgggtatgtggcaaggctaatagatccactgaagatctggaaaattccaggaacttttcacctgagcctttcttctgagaaaggctgcagtcagaggggtgtgcgggtaaagtattgggggggcagctgccatcagggtcatggccttcatataacatgcttcgggctcagggtcatggccttcatataacatgcttcgtgccatcatgatcctggccttcatataacaaacatgcttcgtcagaggtgtgggggttgcaaaaggagctgcatgcttcacgggagtcgagggcctctctccggtactgactttaagccagaacttgtggctgggacatggaagctgtgactcct

SEQ ID NO: 665869 - DNA, 295 bp, Homo sapiens
ggctgcccctgcctcagggtcattttcctgccaggcgagggccctccccctttgccttttgggtcctcccccctcaggccagcccgggaccttttagagctggagcaggccctgggggccaaagtgccagatgaccgtcagaggggcaggggccctcctccccccccccccccctgtaactccagctgcccctccatctccagctgctttcaatggcttcccggtgtgttgttcgggggcagccccccccttgagtctggccaagggggtgatttaacagctccgcttctcccca

SEQ ID NO: 665870 - DNA, 135 bp, Homo sapiens
tggggacagcggtcacccggacactaggtgggctgtctctccacctcctcacattatgctaacaggaacgcagacacattcagatgcctttgcagaaagagatgccagaggctcttgcctcaggatctccgatcc

SEQ ID NO: 665871 - DNA, 456 bp, Homo sapiens
  misc_feature (46)..(46): n is a, c, g, or t
  misc_feature (74)..(74): n is a, c, g, or t
gaggagaatctgatttccagagttaccacattataatactattcanatgtcacattttagcaaagattacatgncaaggaaaaaccagaaaagtatggcccatacacaggtaaaaaaagaaattaatagaaactaccccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaagg

SEQ ID NO: 665872 - DNA, 189 bp, Homo sapiens
  misc_feature (56)..(56): n is a, c, g, or t
  misc_feature (82)..(82): n is a, c, g, or t
  misc_feature (116)..(116): n is a, c, g, or t
  misc_feature (125)..(125): n is a, c, g, or t
  misc_feature (142)..(142): n is a, c, g, or t
  misc_feature (168)..(168): n is a, c, g, or t
tagtagagatggagtttcaccatgttggtcaggtgggtctcaaactcctgacctcnagtgatccgcccatctcctcccaaantgctggattgcaggcatgagcgcctaccaggaanctatctttncttgagttatgaaactnttgcaacagttgttcaaattggtgtntgtccttcctatagctttcat

SEQ ID NO: 665873 - DNA, 408 bp, Homo sapiens
accagccaagtgggcccgtgtagtctctctcacaggcccccacaggggccacacagtccctcagtgcacatctcgttctccggcacatgtcctcgtgtgcttaatgtcacactcctggttgaatataacgttcagcaaggccacatttaggattgggtcattaccggtacctttggtctcaccccagcttgcattctcacacttggtccctgaagcgcaccacatatcattcaggcgacagccagctcaggcccacacgttggttcagggtcacagatctctccagcttgagcagcacaatctggagagcctgagggcccacacagcatcttggctactgggacccgctgtaggcctggctctacatggtgtgggttctggcacagtgtgcacaaacacctcgcgtgc

SEQ ID NO: 665874 - DNA, 301 bp, Homo sapiens
gtgagctgccctcctttttataaagaaaatttgactcctcgtaatcactactttatgtgaagaaaaaaggcattgttaacaatggctcaaaactgtttcttgcaacacgtgaggcagcctcagtccgcgcttctagcacggcgaaggccttgcacggcatcctcacttgcctctggtacctatctacttcccatggtgtgacacgggatgtaccaggtacttaatacatgtgcttgatttgcctcttcatcgtgatacagacagagcatgatgaggggcagctccctggcgggcgatcctc

SEQ ID NO: 665875 - DNA, 131 bp, Homo sapiens
gggaaaatcactgggaagtgatgttaagtgatggttaagtgatggttaagtgatggttaagtgatggttaagtgatggttaagtgatggttaagtgatggttaagtgatggttaagtgatggttccccgct

SEQ ID NO: 665876 - DNA, 272 bp, Homo sapiens
  misc_feature (153)..(153): n is a, c, g, or t
tgcagaattcatggtgattcaaacctatctctacgatgtcagcatgatctaaggagctctgacggtcgcatcgtcttgtgcgaccttgtatgggaaagccggcacgcaatgctttcgcgatagctcacccagtgataagtggccgaccatagntatcagccgaccatctatcatttccgggtagtgttcgccggtgcttgacttgagctgagcctttttcttgtccagccactcaaccaagtaaaggcgcaggctctgcttatctaaatcta

SEQ ID NO: 665877 - DNA, 143 bp, Homo sapiens
tggcatagggcatgcatctttctttgagtgacgtctgtgcaggccctgtagtccgccacagagctctgagctgcacagggcacgagtgctggcatctgtgtggacagcggcaccactccctctctaattccacagtgcccatg

SEQ ID NO: 665878 - DNA, 145 bp, Homo sapiens
ggaatgttttttttttccccttaaaaattgtaattcctgaaaaactggtgctttaaaaagtccccctgtcagattatattatttaacaattgaaaattgtaaaaaaacttgttttccctctcaaaaaaaggggacttttttttta

SEQ ID NO: 665879 - DNA, 488 bp, Homo sapiens
  misc_feature (13)..(13): n is a, c, g, or t
  misc_feature (35)..(35): n is a, c, g, or t
  misc_feature (116)..(116): n is a, c, g, or t
gggaaacgcgatnccatgttttctccagtattacnctcaacgagcagggagatcgagtctatacgctgaagaaatttgacccgatggtggacaaaaccaagggaaaccccttggcnttccaagggcccccaaattccctgcctcccgggttcttcccccaagaattgaccaaaattacctttctcgaccaccggaatcaccatcaagaaacgcttcaaggtgctcatgacccagcaaaccgcgccccctgtcctccttgaaggggggttcccctttaaaaacttggattgtcttttctgcccgttcttggtttaacccccccatccggcaaggacttccggtaacacaaaactcttacggactggtggagcccctggattggccttttttttggcccaaggcccaattactcttttttggggcaatccagtctctcgtggcgattgatcaatgctttgttggttgaaggggcaaatcatggtggcatc

SEQ ID NO: 665880 - DNA, 795 bp, Homo sapiens
tcacaaaccagtctgatttaattaggaagtaaaataggtggaggggggggggagggggatcatcaaaaggctgactggggaccgcgggattgggcaaccataccagtggtgaggttgtggcaaggggaagcaaccccctttcaagaacaaggtcacaaactttttgtggcaaggaagagattgaggggtgtgggaccctcactgtggtcaagtgggactgtgcctcaggtgaggccagtgtgggtttacatgtgcaacagggaggactcatctcgaggcacactctcagccattatagaggctgtgggcgactctgtggtgaagggctgagaggcctcagggcgtgttctcctcagaaggcttgtggtgatctcacctgtgggaagatgcttcacgcccgtggtgagtctctttctccaccacttcctctgtggcaggcgaggttaaactgtgcttccagtacttctccccgagttcaccttgggcttgccccctgtggtctccccctggcctgttgggaccccagtggtgatctttatgggctgaatgtcaggggcaccactggatctcctctgccaccgggggcagcttctctagcagctttgtccagttgagcagcctctggtgtcacgctgggaaggttctggccttctgggccatctgtcagcctcggctcgggctcgggcctttggcaagggcctcagttccccagctccgcaagacgcggtttgctccgctgattaataggggactctctgccggtaggcccattgaggcccgtccggggtccgcccg

SEQ ID NO: 665881 - DNA, 219 bp, Homo sapiens
tccgtctcagaaacaaaccaaaacccccaaaacaaacacattgtacagccgtacaaaaatattttctatcttcatatgcctattctataagcttaaaaaaatttgttttaaaaaaaaactttcccagcactttgggaggccaaggcaggtggatcacaaggacaggagttcgacaccagcctggccaacatggtgaaacctcatctctactaaaaatac

SEQ ID NO: 665882 - DNA, 218 bp, Homo sapiens
  misc_feature (12)..(12): n is a, c, g, or t
ggatttccaagntcatgcctgtaatcctatgactttgggaggtcgaggcaggattgtttgagcccaggagttcaagaccagcctaggcaatatagcaagaccccatctctattatttaaaataataaaaatattaaaaatttattataaacaaaacaaatatcaggatacatctgtattcacagaaaaatgtactgataaggtaggctgctgtagttg

SEQ ID NO: 665883 - DNA, 616 bp, Homo sapiens
ttggtgggaccagcgaccggcatggccaggaagttgctggctctatgagctctgtgatgtctacttggatgccgtgaacctgtgctgaatggggtgcaccacgtggcctgatgtgcccgccaacctgtacattgcctggacttgttggccgtgcgcgcgtgctctcgccgcttcatgccgcgttctgttgacggaggagctgttccatgaggcttgccccggggggatgcctgcaagctccccgctagcctctgtgtgaccccctaccccgggggccctcgaggagttgctccgtgggagagggacccccgagggctagcaagcccgggcacttggaggctgtgctgctaccgccacttcacccctgcgatgagccaggtgcgcttcccccttgcagcgtgcccgaacataacggaaagctcaaccccggtgaagtcccgggcccatgagctgggtcgtccagtgcagcatcgttgcgagcgcagattcgacgagcccaactgggcgagccccccccttgggcccttcagcgcgggagagatcgggacctccgtttgcgatgcgcactatgggccaagctccgacaggttgttggctgggatgttcctggtccctg

SEQ ID NO: 665884 - DNA, 1886 bp, Homo sapiens
  misc_feature (195)..(195): n is a, c, g, or t
  misc_feature (221)..(221): n is a, c, g, or t
  misc_feature (398)..(398): n is a, c, g, or t
  misc_feature (449)..(449): n is a, c, g, or t
ccacgcgtctgcgtggtacatgctaatttgtgatacgcctcgctcaaacctccgattaagtcttagtggcatggggtgatagtaaacaacgtgtctatacactcctctctcctctctgttgcatgcgctaccgcccatgcggtgattgtggcgatgccatcgtcgatctctatcctccatctaagaatggttctngtagcctatcatagtcactcgatcantcgtcgcgcaatgtctcttgcttctgaaagacaccctcctagtacgtcacatcctgtttgcgttgtagggcagatgtcatccttcgatacctctacacaagtagttctgactctggtaccatgggagtaacccatccgcgcttgtcataatcctcggtctcgtcccactacctctantatcaccgctctcaaatcaacattgtgagagacctgtctcgtctaccttgntgtagatcgacccgagtttgtaaatacccctactactacagaactcatagactgacgcgtgagagataggtacatccaggagccacccgaggtgtattcgcgatcgtacagaaagctctatgggtgtgctcgtaagtgaatgaatggtaggggttgtgcttgcccagaccgtgggccctctcccctgtgtggttaccgttgcgtgacccaaccattctccttctcgttttcaattggggcctagtgtaattggccacgccacacgggtgtcctgggtctattaatcacacattacattttcccaacccatttggttcaaacctaacgttgcattttcttacacacaaaacgggggtaagttaacttttacacttgccacattaacattcgccaaaccaatgtgcacacttggttgcgacacaacttctgattggacacagagagcccgcgtctcaggcttcacccacaagatctataatataccggccaaccgtggcgaagagagacgcaccgccttttgggattttaagccgacgggaaattctccacagttcacacctggctggaattgaagtccaccttaagggtggacgccaccccgaaagctcttaggccgagacgtggtgggtgaacaattttacaacactgctccaaccgtgggctccaaagtgccaggcagtcgaacaaacactttgaccacacttaagtgccttttgcgatacgtgggcgagttgtaaaatcaaccccatttggcaactggggctggggcgacataaccaccgcatttggtgttgccacagcggcggcaatgtctttctaaccccggacgacgaactgtgcggggggcgtgccccattccagaggggggctaatttaccccaaccactacagatcagagaaacttatacacatgacgacgcgtcttctcccaacgtgtcggacaactctaatatacagccttcacttatcacccgccgctgcgcgatctagtggcgtcgacgagcagctgtcaccctgtggaccaaatatcgcaccagcactgccgtgcaaacacacaaccacggcgctcaagacgggggaccccatactcctcggcgacactatcacatgtccataccgcacgcgccactctactatcacatctcgctgactctaccaccagcctcatatcctgcaactacatccaccaccaacttctctgtgtgccacaccactcactctcgctaccaccactcacacacacatctgtccctcgcggcacaacacccccccaccacgccctaccaacttaccaccactatcctacccccccccgcacccaccccacccaccacacccactacaccccacccccacatcccatacacacccaccacattccacccccatcacccacatcctcaccccccgctccccctcccactctactacactccc

SEQ ID NO: 665885 - DNA, 515 bp, Homo sapiens
gatcttactcagacacgtgacgtgaggtataatgacttgtggttgacttgtagatatgggcgtgaatgtcagttcagtgttttaatctgacgcaggcttatgcggaggagaatgtctgcatgttacttatactaacattagttcttctatagggtgatagattggtccagtggggtgtgagagagttcagttctctgtttgggatttgtcaggtagtgggtgtagagcacgaacgctttcttaattggtggctgcttacaggcctcactcatgggtgttaaatttctcactctctctcacacaggttttctcctagtgtccaaagcagctgtccgtcttcggcactaacagttaaatttcacaaggggatttagcagggttcggtgggcccaatttaaagttgaactaagattctatctatggacaaccagctatcaccaggctcggtaggttggtcgccactacctataaatcctccaactatttagcgaccggtcaagttgtctggagtccca

SEQ ID NO: 665886 - DNA, 257 bp, Homo sapiens
gcggacgctactagtactaaattcgaggccgtcagacggtgtgcgtatgtggtgtgtggtagatggattgtgtggagtgtatggtgtgtggttgtgtggagtgtgtggagtgtgtggtgtgtggagtgtgtggactctgtggtgtgtgtggtgtgtgtggtgtgtgtgtggagtgtgtggtgtgtgtggagtgtgtggtgtctgtgctgcgtgtggtgtgtgtggagtgtgtggtgtgtgtgtggagtgtgtggtgt

SEQ ID NO: 665887 - DNA, 283 bp, Homo sapiens; identical to SEQ ID NO: 524208

SEQ ID NO: 665888 - DNA, 704 bp, Homo sapiens
gggagacgccgggtgcgatgcggcggcagcacgaggggataaagagtctgacctggagaccaaagtcagtcgggagacagtgggtctgtgagagaccgattagaggggcatgtggcgtcctacgatgcgccattgcacacatggcatacgcgtggaagaatactgaaaaactagagcagaagtacacgcgaccataggatgacattgatcttgatgccttggtctgcagaaaattataaagtgggttgggtgctggccaaagacccggagcttgcagataagtccaaacatggggagtactgaagaagagaatgaagataagcagcgactttgatgaagatgatttccttgagagaactggaaggaatgtgtcttgtgtgaagcttctaaggcattaaagttgatagataaactgttgcacgtgaatgccaagtaagaagaacaaatgaattgattggaattcatctcaacatggattaaatagaagggattctggtaagtggctaataaacaagagttgttgatgataatgtatagcgaagaattcggtaaggataagaggattcatgttcattactgactggcaagaaacgatcatgtggccaaatgtactctgggagtgatgatgatgatgattttataaatactttcctatgaagggctaaagggaaaggtcgaatatcctgtaagaggtgggatggggt

SEQ ID NO: 665889 - DNA, 849 bp, Homo sapiens
tcctttgggtatcagctggaggcactggtgtcctgcatcctggtgctggcctcaaactccacacccaaaggaggcactggtgtcctgcatcctggtgctggcctcaaactccacacccacctgcagctggtcactggctttgtggtaatacgtcgcatgcatgcctgcctggcccagcgttactgtagccaaccagttgttcagtgtgtatttcccagctagagacatgacagtgccctcctctcctggccgccggtggtagacgagctctccacccaggccagacacggtgtgatgctctggaggtagtgggccacgaggattcctgaacccaccaagacatctgggttgcccaggtgacagcagctgtgaagtcagaaccacggtactcgccatccacctgccagttcacgaacttggactgctgggtctggatggccattttggacctgaggcctgggctcagctggtggatgacctgtgcattgaggctgccactattgtccatgtcacccaccagcacggggaacgcctctgtgggactcagctgcttcgtccccacgtatgtgaccccaaagtggtagttggactccccaattgtgccgagggctactgtgtgggtcacctggaaacggttgctcaaccctttgttgactgtaagtttgacaccttcatctgaactggaaacagctctgcactccggtgggactctcgaacgtcccgggtggggcaggcatccgagtcccatcttcggggcgcgaggccgtgcgagccggagtcgttccacacgcaggttgacccgggccgcggcgccagggggattgaccgggggagggggggggggggcca

SEQ ID NO: 665890 - DNA, 153 bp, Homo sapiens
cctgcctcagtgcacccacatgggagctgtggttaccagtctgcaggcagctctcgggagaggctgacagagtgggcccccatgtggaagaaagaagctccaaaatgaatcacaactggcgggtctgacttcgggcctttgcagatgctgttc

SEQ ID NO: 665891 - DNA, 416 bp, Homo sapiens
gagctgcatgtagaatgagatcacatgcttttatatgtgaaatattggttttagcaattaacagaaggcatactgtcctattagtatgacataattttagaataacctgaatgattaagttttaacggtcttgtagttgtatgtatacatttaatggcactgtggaacgtgagctgtcagtattattgttttcttattcaatgatctcataactgtggtgcttgtggcataactctcatggtatatagttcagtatctttggtccgttttcgcgataactatatgtatttctagtgttgctagtaagtgtttcatagccacatgcataacctcacatgttcgttatgtgtttcttctgttatgtatgtcttgtatagaactgtccttatcattagtcttaccgcacacattttaaa

SEQ ID NO: 665892 - DNA, 736 bp, Homo sapiens
cttcgaatgctgcgcgagctggaggcggaggtagctgtggaggtccgagccgatgtgaccaggccggacatcgctcgccatcttcctctctcgctgccgcgcatccgtgtctcgaaaataacttttttagatctaaagaaagaaagacaaaagtagtcgtccgcccctcacgccctctcttgcctctcagccttccgccggtgaggaagcccggggtggctgctccgccgtcggggccgcgccgccgagcccacggctacgccccgggacagacacccgcaaccacgaggaccccaatgcatcccttcatacacccggtgccgccactcactgaatagggcgagaaataagacactacagagcgatgatcctttagactcctcccaaagatattcatccggaaacaaaaggtgacttcacacaccagaacgacacacatctgcagcacacatacacaggacaagacgccctgacacggcacaccgctatgcacaacaacacacgtcactaaacaccaacaccaggggatcccaacaaagagaccaacgcaagggggctcgaggtaaaccgcggtatacgccactcaacccatccacactggatcccgtcaagactggccccagacaaggcacacaccggacagcaactggagcccgcaaaaagcaggaaaagagacacccacccaagtggaacacacccaacgggcaggcacctaagaagcggcacaccacaagca

SEQ ID NO: 665893 - DNA, 254 bp, Homo sapiens
aacattatactctttttaaatattaacttcatttttaatatcggtggcgtatgtagtaggcctgaatattcatggggtacatgctgcgtgttcgatacacggcgtgcatagtcgtaaaaatcacatcaagtaaatgtgttgttcatcccctcaagcatttatcctttgtgttgcaaagcatccagttctactcttccagtaactaataaatatacaatgattttgacacttggtaccctgtttgtgctatcaaa

SEQ ID NO: 665894 - DNA, 812 bp, Homo sapiens
ggagtcagttccgtggtagaggtgacctggactctctgaggctcattttgcaggtggtgaaatagtggccgcagtttttaatcatgtctgagatgaatcaggagtgcttgtgactggagcagactggtcaagattgcgatattcacatgcgtgtagcaggtattggaaagtggatgctgtcttgtggaaaagatcagcctagtaattctagtggctgttgagatatcagccccatgatgggtgtccatggatggtgtcctaatggaagctgcaaagatggtggcgccttcgccctcctgaaagatgtcgatcgcaacaggataaagaagacgtaggcttcagaaggacctggactgtggccattctatgtgggctccatgccaagaagggaaggcatggacgagacaaaggatgtagctgagaaggcaacatgtgaacaatcttcagaatcccaggggtgcacgccttagagtaggatacgccagagaagtcagttaaggttatagtgcgggtaatccaagcctagatagacaactgcctgagcttgcttccaagtcaggctccaatgccagtcccctaaggagaacttcagttgcttgacctcgtttggatcacaaccgagctaaagctcaaatttgctcttcacatttgggtgttgactgcttcatgatgtacagaatggtcattatctgcgggacaacccattcctcgaactcaataatcccgatgtcaaccattgcaaggtgaaacttgccagcgaagggcagtcggcgttcactcagcttcgcgacacgcatgccgctggctcaagc

SEQ ID NO: 665895 - DNA, 124 bp, Homo sapiens
ggctaatttgcgagctggcggatgtagaggaaggcgtgtgataggccacacccggctccaggccagcagctccgtcaaggtccactgcatgaaactcatgaaggggagcgcaccaggcgaggtg

SEQ ID NO: 665896 - DNA, 1006 bp, Homo sapiens
ggataggtacgattcgtaggcgcccgggactcgaacgacgtacgtgcgcactggttgtagctgtagctccagcgcatcgtggtcgtgattgcctgcgtagtatcctcacaaactctcaattgtcccgggcgcggacaagagcgatttcctggaacgaatccaggatgagcagttcgtgaggagtcaataaccggggtctatcaacaagcgtagtccaggaagagcgtcgaacatcgaagtggaggccaccgccccggagaaggaagccctcgttgctctggggagaacggccgttggccggcccaatgggcacgggagggggccaaacccagggttggaacgaattccagtgggtgggtggccccaattgggttccaacaaagttgggttgccaagtgtgttgttatcaaagagaggagacatttttgggcccttttggattgaacaggggattgcttggagacggtgggcacagggtcaacggagggatgggacaaaaggaaaaagaagattcctcttgttgtggagacaacgagggagggttcagagcggcgaatatttcaactttaattctggccttgtagggaggaaaaaaaaagaacccaacaagaggggtgttccatcaaaggagggtcaaaacagtttggagtgcccacacaatcattgtggccggagccaccacaggtgggaatttgctcagaagccgtttcggcagggatagtggattccgacccaaaggggggattcgagaagtggatgtgtggtggaaactgttttgggccagtgggtaccaggaacagggttagaaaagtgccttttcagatctcacattcgtggtagagatcctaggagaggaacgagaggtataactgccacaagttgggggaacggtctactggttgtgaggggccggcgtgaaggagagtttatggggaggttgtgagaaaaaatgaataccaggtgaaggcctgtacatgaggttggttaaaagtggagagacgcgttt

SEQ ID NO: 665897 - DNA, 238 bp, Homo sapiens
aaaggggggtgacgtgtgcagatctctgctcagcttcccttgcgtgtaagggcctgccctagccagggctccctctggcttccagtaccctctcagggcataggctgcacaccagcagagggcagctagatggacctttccccggctcggaagggtgggcctgccgggcgggggcggtcagtcacccttgaatagtaagccaaaaaaaacaaacaaacaaaaaaacacacacaacaac

SEQ ID NO: 665898 - DNA, 1329 bp, Homo sapiens
agcaacttttaaaagaacaaaagaggccaggagtggtgactcacgcctgtaatcccagcgctttgggaggccaaggcaggtggatcacaaggtcaggagttcgagaccagcctgaccaacatggtgaaaccccatctctactaaaaatataaaaattagccgggcgtggtggcacgcgcctgtaatcccagctactcaggaggctgaggcaggagaattgcttgaacccaggaggcagaggttgcagtgagctgagatcacgccactgcattccagcctggccgacagagcgagactccgtctcaaaaaaaaaaaaaaaaaagagaaacaaaagaaaattactttaattacttgtggtaagcccgtgacagccgagaatttggggcaataaagcaaaattataagttaccatagtgtgcagaatatcttactagaacctctttcaagttactacatgtgaaattttatctcattcaaccatttattcattcattattcatatactcagtatttaagcttggcattgggtggtatctgggacacctattacgaggagtggccagattgatatacagggtagggcatttggcccttgaaagggtttttcccctccagctggtgggggaatgggataccaacatttaactacgggatatacgggaaagagtatattccgtgaggtgccctgatggagatgagagatcgacaaaatattgggtcccaagtcctggttatacgtggtcccaaacgaggaaacttccaattgtccacagtgggacattcccccatggccgagcatatagtgctccatcgggacccacagaatgcttcgggacaacccccacaccatcttggcaacgggctaacacgcggggaaccccgagaccgtacaacagggcagagggccgtaccgaccgggacaaacgctcccaacacagagagtgtgtcgagacaggggcaaactatgccccttagcgggcccccgagggaaataaacgaccacgaggacacccccaataaaacaccacggcgcggcgagacaatgctaccacagcggcgcccaaagcacttacacacaacccccacaacaaaggtgggcggaaccaaagaacgctacatacgcagcgcgcgacacacacaccgcaccgaaaacagaacgcgacggcgagaaaaaacagggcgggcggagaactcgaagcgcggcacacaccacgtaaagcgacgtagagtaaacaaccagcgcaaccgacgaggcgcagagaagagctcggggagacacaagctgacgaatgactgcaacaaaatcagagcagcgacagccaacgcgcc

SEQ ID NO: 665899 - DNA, 273 bp, Homo sapiens
  misc_feature (147)..(147): n is a, c, g, or t
tactgccagattctccatactacgaaaaatcctgtccacgaattttctagacaattgtttactattccatgttaataaccttgttaccaccagaggcaaagctatataagttatacttgtttctagtctagactattcaccttaatnaactcataaagttgtagagaaaaattaattgattagaaagtatttttatctgatctgtcagccaaaaataaattactatttctctatattaatgagaaaactcaaccataatatgtctgtttatgc

SEQ ID NO: 665900 - DNA, 340 bp, Homo sapiens
agcatatgcagtgcaagagtagctgacagtacacagaaaaccggtcctcagagtcagaatattactctacatactctcgtaatgttcacgatgtctcctgatactgtgccacatgctcctagatattttaaagcaggatatacctctttaggaagtatatcctgagttactctatccaactatccgtcaggcatcactaccactcctttttcttcatactttgattctcatttttccttttcccttcacgacctgtctcactttgctgtaagttctctataaactagtattggtcaacatactgatactctcctccaaaatacattagcatcatctcttc

SEQ ID NO: 665901 - DNA, 1656 bp, Homo sapiens
  misc_feature (1367)..(1367): n is a, c, g, or t
cctcgtcagaaccgagagccacgtagtggtgggctgcacgttcatcggcaggtagtgaggccgcggtcggttgcgtcggagatgcgcggacccggaggcagcaatcaagttgttgcgtccatgggatcgtcgggtgaaccgcagcgaagttgttcagatccttgtcccatcgctgtacaagggcgtatgaatcaggtcaattaaaggtcgcggcaaaaccgctggggattccaacacgcatctagggttcggtacagatccctggccttgcacaccaataatacaatcatggaaatgtcgcttctataactacgtgttcggagtcctctgagctacggattgcacattaaatatgcaacggataacgtgaaggaagtagcataccaatactcgtgtggatggtgcgctgccaaggtgagtgaccaggacagtcgtaggccctggtttcaccttaccgcgtgggaaccacgcagaggtactgaaggcgatgcgctgcattgggtcatgccagctatcagggttcattcccatagaggttgcttcagagctataatgccgtgactgttgacgcagacttccgacggcagaagaacagcactgacatgtacggctggatggtgactgtccggccgaaggtgatagggaaaaggagtttacgctactaggatacggaggagcttgggaacattggttgatttgaagcttgcatctggggatataagtccccgcagagttggtggaagacggtgttttggagataccatttagagttgatgtggaatttaatgcccaggatggccaacgttggttaggaaccagggggaggggggctaagggggtcctgctggaagagaacagggggggtttgggttaagggttcggaatggaacagcggctatcaacagaaagagagcgccaccaagggacgagtgttggagaaggcggttcggcacccctgctgggccagatcccccgggagtgggagacccacaccacgtgggcggggtaaaacccccaccaagagtgtgggagagacaacagcgagtggcgcgcgacaagcaggcttacacagggcgggaggagagacaccaccagcatagagagagccactcaggagaaggtgcggggagcatcttccccaccaagatatcgagaagagaggcagggctctccccatccggtgtaacaaaagagcaggcggcaacacgacccatcattcggccagagcaaccatgggcacagaagacaggctaggattatgtagtaactgatcctccttcttttttcttgtgcgtcgtcttcgttttcgtttgtctgcgtctgccgtgtcggttaagccggaaggacacggagcacaagcaacgcgnagcggggagcgagcagaaccgaagccgcgtgagccatgcgacaggaggcgcgggcagcagaaggaggcggagaggcaggacgagcacggacgcaagggcagggcagcaggcgcagacgacgaaggagcagcgaggaacgacagatagcgaggcgcgcggaaacgagcagcaggaccggagcaacgccacggcgcacgggacaccagggcagccaagtcgagaagcaggaaaggcggacagcagcgaaggacacgaaggagaccaacgacgcacacgcagccacgcacag

SEQ ID NO: 665902 - DNA, 147 bp, Homo sapiens
catgcctatccccaaggcagggcgtgtcacaccttctggacatttggcacctccatatcagttctgtgatggctatgatgcgcggacgactggaagtggccgctcagggcccaataacattccctttgtgtccccgttatgaatcga

SEQ ID NO: 665903 - DNA, 420 bp, Homo sapiens
ccccaaggggcccaaggaagtggagggggggtaacccccccccctgggggtctccccggaagggtttccaaagcggggcaccaaggggggccccctcagcccccgggggcccctttggttggggaaagcggatttcgagaaacccaaagttttcgcctggggggtccccccccgggggctggggttccccgtcccaaaaagttttccccggggggggggtttaagggggaggggccccccccttttccccgggttcaggcgggacccccccccctcttttgggctttggcccttttttcccggggggccccccccctttgggggcccccgggtttttttttccccccccccccccccccccccggggtttttttttgtttatgggggggggggatgaataaaaaaaggggttttttgcca

SEQ ID NO: 665904 - DNA, 433 bp, Homo sapiens
  misc_feature (102)..(102): n is a, c, g, or t
  misc_feature (144)..(144): n is a, c, g, or t
  misc_feature (168)..(168): n is a, c, g, or t
  misc_feature (186)..(186): n is a, c, g, or t
  misc_feature (192)..(192): n is a, c, g, or t
  misc_feature (212)..(213): n is a, c, g, or t
  misc_feature (245)..(246): n is a, c, g, or t
  misc_feature (300)..(300): n is a, c, g, or t
  misc_feature (409)..(409): n is a, c, g, or t
  misc_feature (420)..(420): n is a, c, g, or t
gagatctccgtgcgctcagtcaccacgtcactgtatcaattcatccttcctgcaaatcagtctgtgtaggcagacatgtttgtcaccattcatccacagagnacactgggttactttcactttttgggtattatgaatgatgtngctgtgaacactcaggtgtacatnttggtgtggacaagtgtnttcatntatcttaggtatagacctgnnggaggaatggctgggtcatacggtaactctannggtttaacttttcgaggaaagtgccagactatcttcccaagtggctgcagcagnagtgtctacgtgcctcaccaacacttgccacgaccgtccaagaagcacgtgcggtgggggctcaagggtgatctgcatttccctaaaaagtaatgacattaggcatctnttcatgtattntactggcattttt

SEQ ID NO: 665905 - DNA, 100 bp, Homo sapiens
gcgttatcaacccagaagctaaaaggatgatgaggttgctcagctcaagaaaaagtgcagatacccctgtgggacatcccagaaggacctaaaagacctg

SEQ ID NO: 665906 - DNA, 480 bp, Homo sapiens
  misc_feature (33)..(33): n is a, c, g, or t
  misc_feature (105)..(105): n is a, c, g, or t
  misc_feature (307)..(307): n is a, c, g, or t
ggcgaccccgccactttcacccaacccgtgganaaagttgcccggaagggttttttggacaccctgggggttttgccccgggccgggggggggttgaaaggggcnaaatcctggggccttttgcccggggacctggctgaggagtggggcctttcggatttggccggggaccgggggggggttggggggggccccaaaggcggtaaccaggcccgcataaatgccggggagggtcccccaaaaatccccgattgaaaaaaccaaagggggtttgggaaccccccggaaatttagattatcagtcccngggggtcctacggggccccaatggccccccccccaaccccccccggttttggggtttttttttaaaaaaaaggggttttaaaaaggtccccccttttaagggaaaaaaaggccttcccccccccccggaaagggccctttaaatctttttttaaaattttttttaaaaaggga

SEQ ID NO: 665907 - DNA, 198 bp, Homo sapiens
tttgagaaacatttaataactgtaatgtgtttgtggtacaggctgagtacacgatgcacaggaggccataggggtttaggcaaactgggagcacaaacagttgaatgatgcaggcactggccatcaacagctgtggcggcttcagcgccaagcaacagagagctgacggaagccacaagggtacgacatatttctgca

SEQ ID NO: 665908 - DNA, 1006 bp, Homo sapiens
cgatggtttttcatatcatggtcgtggttgtagtccgtgcgagaataccaaaaaaaaaaaaaaaaaaaaaaaaaaaaaattggggggcggctcgtcggccccgtgaaaaagatctgctggaaaaccaatcggttgggggcgcggggacccaatagaggttcaatggtgaacacgtgtcgtccactagcggtctcccaaaggaaaaaccggggaccaggaactaagggcggggattcctacaccaaaataacaaaacgccgggggcgacacccagaacggtttcgagaaacaaaacacccgagaagggagctccgaaaggcacaaacgcggggatctcatccaacaagagagagctcaacgggaggccgaattaacaaaattaagcccccggcggtggggacccaacagaaaacacaacagagtgtcaacacacgacgaaagtcacaaccaaccaacacccaccgtacgccccaacgctgcagccatacaagcgcaccaccacacccccagcccaccgcgccggccacgctcctcggagccagcagcgccacgataccacgctcacacacagacacgcaaacaacgaaactatcacgccacgaccacacaagccatcactccacctcgtgccaagccaccagctccgcaacaggacgtagtcccgacggtgcagtcaggtgtggtgtaacagcgtggtttaggttgcgtgaagggggagcgaggggagcgtgggctggcaacgcatcatgcgcgagacgagtgaaacacaaggatcggctgaggttgcaattggatcgggaggcgcttgataagacatagggctcagtaaatcgcggccgtccgagggaagcagatgcaaactacacacgcagaccataggaggctcatcatgcaatgtgcggaggggtgcacgcaggttatgtccgcgtctcctcgcgcaagcacgcccatgcacggcaccacgaccccactagtcgccacccccgatgcacttcgcgctcagcgc

SEQ ID NO: 665909 - DNA, 896 bp, Homo sapiens
  misc_feature (896)..(896): n is a, c, g, or t
tataaaatttatagtataaaaggggacataggtaggattagcgtggtaagggcgatgagtgtggggaggaaggggggtgggtaatggtatgtacaaacttgtcatttaatttatcacgttgtcaaatatggggagctaggtgtgattgcaggtggcagatagataaggcgtaggtaaacaagtagaggtaaaggagggctgatggtgcgtaatgaatggtggggactagaatcgacgcgctaatacggtacaaaacggtaagaatacactaccagactaaaatgggccccaattgggcgcaacacaacgcccgcgaaaagcagacgagcacaagagccctcccaaagggaaagaagggaccgcgtaggaaccgagcacataaacgggcgtcgcacagcgaacaagcgtaacgcacacgtacaccaagagtagccaaaaaaaaaaataagataagggtaccgcaggagagactacgaaaataccaccaagcagcgcactacaccacaggacactcgcaggccaagcacgctaaacgagcaaacacaagcaaaaacacagcacacacaatctcacgaacatagaatccaaccacacaacagccatagaccagagacaccacaccacagccacataaaaaacaagccacaaaaagaatagcacacacaactaaaagaacagaacaaaaccgcaacaaaagaacaaaaagaggaaccaaaagagcagaacacaaaaacaaaaagcccaaccccacaaaaagacgaagacgctgaacaaagagacaaagcaaaacaagcaaacaagaacaacaaacacgaacagaagcagaaaaaaccaaagcaatcaaacgactaaaccaccaaaacacagcacacaaaccacacacaacgagccacacn

SEQ ID NO: 665910 - DNA, 350 bp, Homo sapiens
aacttaatctataattaaaaaaaaaaaaaaagaaaaagaaacagcccaaggtcagctttcagagcattttagttagctgtgaaaactagcatctttccttgcctgggagaccagtgttagaagcgacctcctggaactcttaaatctctgtcaggatatttgcctgcctgaacttgataggagggaataaaaattgtgcttcctttcaggctaattgacatgttcactgggtccccatgtatgcttttctgtaatccacctccaagcacagagattgaatctgaaacctggaaatcaacttggatattcgtaacgaagttgacatgagcaatgtcagataggcctcgtgc

SEQ ID NO: 665911 - DNA, 1905 bp, Homo sapiens
  misc_feature (13)..(13): n is a, c, g, or t
  misc_feature (16)..(16): n is a, c, g, or t
agcgggcgtctgngcngctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccgtcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaactggtgctggctcctggggagagggacggggagatgcctgtgttaggaggtatctggccgggcgtggtggctcacacgtgtaatcccaactactcaggaggttgaggcagaaggatcacttgagcccaggagttcaagaccagcctgggcaacaaagcaagaccctgactctac

SEQ ID NO: 665912 - DNA, 240 bp, Homo sapiens
aggtggaggtcgtctggctttctcagctaagcgagagtctattcatgtggaaacgaggctaggtgattaagagagcaaaagggagagtcttaaaacaggattagtgaaaacaaggttgggcattacaacacaaggaacaaaataatgcttaggatcaagaggaaaaagatataggagcaagcgtcatggaaccaggttagagggagcaaggaagacaaaaggcatcttggactgggtcag

SEQ ID NO: 665913 - DNA, 1247 bp, Homo sapiens
  misc_feature (13)..(13): n is a, c, g, or t
  misc_feature (16)..(16): n is a, c, g, or t
  misc_feature (661)..(661): n is a, c, g, or t
  misc_feature (694)..(694): n is a, c, g, or t
agcgggcgtctgngcngctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcaggtgagggccttcggagtccccatgcctatgttcctgggnagagctgccaagcaggtattagagcagaaaaanggagatatggggtatggcttggagagcctggctttggctggccataaccccagagaatttgaggtgccatcttctgcatccctgccgcctcaggcagcacccccaccccagcctcatgccaggacctttgcaatggttaaatagctgctctctacttcccactgttcctatgcattcagtccagctgttacactcgcacctgagtaattatctttcagcacaagcccgatctattctctctcttgcttagaaatcctaaatagctccctcatgtcactagggaaaaacatctaaatttaaattgaacatataataacctctgcgatctggccctatcctgggaggcagcattctcccatggcttccgcccccccaggagctttctaatgctttaaagggtgaaacgagtgaaatgcttaattcaaagtgaaatctcacagacagcagggcacactcccaagtcacaacagggtaggggatacatagagaacccaccgtgctagcgctccaattttgtggacccctataggggttctgaaggagcagagccttg

SEQ ID NO: 665914 - DNA, 1465 bp, Homo sapiens
  misc_feature (13)..(13): n is a, c, g, or t
  misc_feature (16)..(16): n is a, c, g, or t
  misc_feature (1450)..(1450): n is a, c, g, or t
agcgggcgtctgngcngctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccgtcccaaccccattgctaacaacatggtacattccggccccaccactcagagccttccgaagccaacacttgtccccacctcccgccaacaccncaccagcgtgcgcag

SEQ ID NO: 665915 - DNA, 1807 bp, Homo sapiens
gtaagccgatcggtctggaccaaacaatagagaacgtctgaagataattgtgaaacaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccgtcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaactggtgctggctcctggggagagggacggggagatgcctgtgttaggaggtatctggccgggcgtggtggctcacacgtgtaatcccaactactcaggaggttgaggcagaaggatcacttgagcccaggagttcaagaccagcctgggcaacaaagcaagaccctgactctac

SEQ ID NO: 665916 - DNA, 681 bp, Homo sapiens
  misc_feature (7)..(7): n is a, c, g, or t
  misc_feature (87)..(87): n is a, c, g, or t
  misc_feature (204)..(204): n is a, c, g, or t
  misc_feature (270)..(270): n is a, c, g, or t
  misc_feature (313)..(313): n is a, c, g, or t
  misc_feature (319)..(320): n is a, c, g, or t
  misc_feature (323)..(323): n is a, c, g, or t
  misc_feature (332)..(332): n is a, c, g, or t
  misc_feature (338)..(338): n is a, c, g, or t
  misc_feature (361)..(361): n is a, c, g, or t
  misc_feature (401)..(401): n is a, c, g, or t
  misc_feature (450)..(450): n is a, c, g, or t
  misc_feature (483)..(483): n is a, c, g, or t
  misc_feature (493)..(493): n is a, c, g, or t
  misc_feature (499)..(499): n is a, c, g, or t
  misc_feature (505)..(505): n is a, c, g, or t
  misc_feature (572)..(572): n is a, c, g, or t
  misc_feature (583)..(583): n is a, c, g, or t
  misc_feature (587)..(587): n is a, c, g, or t
  misc_feature (593)..(593): n is a, c, g, or t
  misc_feature (617)..(617): n is a, c, g, or t
  misc_feature (660)..(660): n is a, c, g, or t
gggcaancccagaaagacggctgggggcaggggtgctgcgtactgttcaatgggggccataatgtggctgtaactgtcttcctcatnttgcaagaacactgctggcagatccagctcctcatttagcgccttcacccgggccactttctcagcctccttctgcccgtgtttttccttcagggtctggtgctgttctggggtggnccgttgcggacactgaaccaccagccagctgcgtttgttgtcctgggtgtcggtgccagttttgcnggtcgcgctggggtcccccagggggtcggggtggtcttcctgnttctgnnagnactcccccntctccngcggggtcttcttggacgttggnagtgctccttctcgccatcagttcctgccgtgtgcatggntgcagctttgggggggtagagggggtgggaagctgtcttgtgcttgacngtgggtttgtgcctgggtagggggggggggganctcctcgggngggcantgcgcntcctgggccctccctcgctgtccaggcatggttgcgcgctgtccctcacctcccctcacctcttttnagtgaatctgncaanatccanattgccctggggggctgtaaggangtccaaggtctgcccaatctcagtctgaaaagaactctaagcnagaaaaaggcggtccatgagc

SEQ ID NO: 665917 - DNA, 2287 bp, Homo sapiens
  misc_feature (13)..(13): n is a, c, g, or t
  misc_feature (16)..(16): n is a, c, g, or t
agcgggcgtctgngcngctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaaggaactggcagagtcctcccccttgaggtcagtactgttgtgagctccattttacagatgaggaggtcgggacaccaagaggtgaagtaacttgcctagtgtcacccagttaaaaaatggggacaccaggacccccggggaggtggcctggctcccggtccctcactggagctgctgtgctgtgctgtgctgggatttgctcagcgcatgtggcttcccttctgagacccgtttagcctggccccaggggtggaggaggctctctgttgagcaccaaagccctgggcaggagcagaggactgggaatgcatccaggcccgtcttctgggggtacagagggaggggtgccaactgcgctgaggcctcctggtcccctggtccccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccgtcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaactggtgctggctcctggggagagggacggggagatgcctgtgttaggaggtatctggccgggcgtggtggctcacacgtgtaatcccaactactcaggaggttgaggcagaaggatcacttgagcccaggagttcaagaccagcctgggcaacaaagcaagaccctgactctac

SEQ ID NO: 665918 - DNA, 2501 bp, Homo sapiens
  misc_feature (13)..(13): n is a, c, g, or t
  misc_feature (16)..(16): n is a, c, g, or t
agcgggcgtctgngcngctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagtccagggcatactccggtttctccagttgttccagaaatgtgtttttacagctggttcatcaaaccagggtccagtctagatcttcacgttgcatctggttatctgcaagttaacaatggaaagcatgactttgcggatagtttcatgtaataatgttgaagagatgataagagttataggtattctgtggcacgaatgtgattgctggttcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaaggaactggcagagtcctcccccttgaggtcagtactgttgtgagctccattttacagatgaggaggtcgggacaccaagaggtgaagtaacttgcctagtgtcacccagttaaaaaatggggacaccaggacccccggggaggtggcctggctcccggtccctcactggagctgctgtgctgtgctgtgctgggatttgctcagcgcatgtggcttcccttctgagacccgtttagcctggccccaggggtggaggaggctctctgttgagcaccaaagccctgggcaggagcagaggactgggaatgcatccaggcccgtcttctgggggtacagagggaggggtgccaactgcgctgaggcctcctggtcccctggtccccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccgtcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaactggtgctggctcctggggagagggacggggagatgcctgtgttaggaggtatctggccgggcgtggtggctcacacgtgtaatcccaactactcaggaggttgaggcagaaggatcacttgagcccaggagttcaagaccagcctgggcaacaaagcaagaccctgactctac

SEQ ID NO: 665919 - DNA, 2119 bp, Homo sapiens
  misc_feature (13)..(13): n is a, c, g, or t
  misc_feature (16)..(16): n is a, c, g, or t
agcgggcgtctgngcngctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagtccagggcatactccggtttctccagttgttccagaaatgtgtttttacagctggttcatcaaaccagggtccagtctagatcttcacgttgcatctggttatctgcaagttaacaatggaaagcatgactttgcggatagtttcatgtaataatgttgaagagatgataagagttataggtattctgtggcacgaatgtgattgctggttcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccgtcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaactggtgctggctcctggggagagggacggggagatgcctgtgttaggaggtatctggccgggcgtggtggctcacacgtgtaatcccaactactcaggaggttgaggcagaaggatcacttgagcccaggagttcaagaccagcctgggcaacaaagcaagaccctgactctac

SEQ ID NO: 665920 - DNA, 521 bp, Homo sapiens
tccggtgtcttatcatctattttaacagaagtatcaaaaagtgatatatattatttaatttatttttgagacagagtctcactctgttgctcaggctggagtgcaggggtgcgatctcggtcactgaacttccacctacctgggtacaagcaattcttgtgcctcagcctcccaagtagctgggttacaggcgtgtgtcaccacacccagctaattttggtatttaagtagagatggggttcaccatgttggctggggtgctcttgaactcctgacctcaggtgatctgcctgactcggccatccgaaagtgctgagattacagccgtagagccacgcggcccggccctatgaacaaggacataggagactccaccatattataggtctgtaccacataattatccggccactatattcagataagtaatacgcgatatactaaacttggcttacaattggtataatatttcaatatacattctgtaagtgagcaactgaattacctctctctcataatta

SEQ ID NO: 665921 - DNA, 217 bp, Homo sapiens
cgccagtactattgacccaccgatgggggcttcgacatgggcttaggcgatgtcataagtggagtccgtagacgaggtatctttactatcacaagctacttgtgtcagctagtcatattaatgttgttggctcaggagtttgatagttctcgggcagtgagagtgagtagtaaaatgtttagtgagcctagggtgttgccatcttgagcctgtgtct

SEQ ID NO: 665922 - DNA, 909 bp, Homo sapiens
aaatttgcccccacacccactccacaccagtaataaaaagccaccacacactaaaaaaaaaaaaaaaaaaaaaaaaaaaaaaaaaaaaaaaaaaaaaaaaaaaaaaaaaaaagctggtgcggcggccgcacggcggccgccgaagaacaactctccacaccacacggcggggggcgcgcgcggcggcccccagaagaaaaagagcacacggggcacagagggacccacaagaacagaaaaatcggcgcggcgacgaagaacagagcggcggcggaggatctctccacgcacaccacaaagaaacacgcgccgcgcgcggggagcacgagcgaggcaggtgtcgtcaacagcaaacccccaaagaggaggaatacgaacggagagcacaacccgcggggagaacaatacaaaagaagacaagagagacacaccagaacaagcaacacaaacaacaaaaaacataagaacccccgtacggtgaggggcgaaaaaaaaaaagaaagaaagaaaacaaacaaaacaaaaacaaaaacaaagcaaaaaagaaggaacgagggagggaaaagcaggcgggacagaagagacagaaaaacgaaggcacacacgcgagacgggaagaagcgagaggacgcacacagaggcgcgaaaagagacgaaggagagaacaacgaccgcgagcaagcgaggagaaaggaacaagagagacgagggaaagcgacagaaaggagaggacaagagaaaagagaaacggtagagaggcgaagaaagaacaagagagacagcgagggaggaagaaaaaggcagagaaagacagagagaagagaaagaacagacgaggaaggaaagacaagaaagagagaggaaaggcgaaaaagaagaaggaacaaaaggagagaaaagaaaagaaca

SEQ ID NO: 665923 - DNA, 1931 bp, Homo sapiens
cactacattagaaaaaagccacacctagaaatctctgcaagtggccaggcacaggataaccagtaaggacattcttgctccaaagcaggggagccgggcgtggtagcgtgtgcctgtcatccccagctactcaggaggctgaggcaggagaattgctttaacccgggaggtggaggttgcagtgagccgagatggcgccattgcactccagcctgggcaacaagcgaaactctgtctcaaaaaaagaaaaagaaaactgataacacaaaaggcaggatgtagaggaggctgttttagccaggggggctggggagggctggcctgaggaggcactgtgtgacctgcgatctgaatggcatgacggacacgccacgctgacagctgagcaaagaagcatcccgggcaggggcacagccagtggccggggcaggcacaagctggatgtgtgaagcagcaaggtgtccgtgggaccaagggcccagcaagcaaagggagagtggcagagaggctggcggacttggagcctgcagagccctgcgggaccactgaggagtctggagttgtccccaaccagcttttgaaggcttttaagtgggggagtacgtggcctttggttgtgctgttaaccaccttccgcttcttccccagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccgtcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaactggtgctggctcctggggagagggacggggagatgcctgtgttaggaggtatctggccgggcgtggtggctcacacgtgtaatcccaactactcaggaggttgaggcagaaggatcacttgagcccaggagttcaagaccagcctgggcaacaaagcaagaccctgactctac

SEQ ID NO: 665924 - DNA, 730 bp, Homo sapiens
  misc_feature (18)..(18): n is a, c, g, or t
  misc_feature (71)..(71): n is a, c, g, or t
  misc_feature (94)..(94): n is a, c, g, or t
  misc_feature (110)..(110): n is a, c, g, or t
  misc_feature (134)..(134): n is a, c, g, or t
  misc_feature (303)..(303): n is a, c, g, or t
  misc_feature (314)..(314): n is a, c, g, or t
  misc_feature (351)..(351): n is a, c, g, or t
  misc_feature (413)..(413): n is a, c, g, or t
  misc_feature (420)..(420): n is a, c, g, or t
  misc_feature (437)..(437): n is a, c, g, or t
  misc_feature (448)..(448): n is a, c, g, or t
  misc_feature (502)..(502): n is a, c, g, or t
  misc_feature (521)..(521): n is a, c, g, or t
  misc_feature (588)..(588): n is a, c, g, or t
  misc_feature (597)..(597): n is a, c, g, or t
  misc_feature (612)..(612): n is a, c, g, or t
  misc_feature (644)..(644): n is a, c, g, or t
  misc_feature (652)..(652): n is a, c, g, or t
  misc_feature (697)..(697): n is a, c, g, or t
acgcccagcagttgtgantgctccccactccttttctgagtttattagcattgtttggttttcttcttgtngcttttaaatcctcgagcggcancctgaccaaagcaganggtagagggtattctatgtttgtngatccgccttttacctgccggtgcaggggaggctgcaacaggctcagagcagatttccatggcctccccttctgaccgctctccactgtaccctggggcttctgctgaggctgggcttctgcttttctttggcttatcaaaccggaagttcgcggggtaaaggtgcatnctcaccatgtnatccttccggtctctgctggtcttgaacttctctgtncagctttctaccaagcactgatacatgttctgcctcttagataggatctggaagagcgaatngtgccantacaggatgtgggcgtncagcaggtgtncggaagggaaggcccgcttgcaaaaggagcaaacatttccgtgcagcgtgtagnagtagtgctcgtagtcgtncagggcatcgaacacctggaagcagcgggccacctggcaggcaaacgcgggcaccctggggcttctnaggcacgtnggccacctgcatgancacgtcctcggaggtagaggtggcgctgcacnttcccatnctcgaagaactggttgctcccgcgggaagcgcacgggggcgcgcnaagaagcgaaaaggcgcggccccagccggggga

SEQ ID NO: 665925 - DNA, 1719 bp, Homo sapiens
  misc_feature (87)..(87): n is a, c, g, or t
  misc_feature (89)..(89): n is a, c, g, or t
ccaaggcgagggccacggccacacggggggcctacaagaacatctgtgcctgctcgcagattcggcttcgcctcttacccctgacgntntaggcaggtcctttctgcttctcagcttcagctcagtcatcagtaaatgggtttgggtgaggacaaagtgatagtggcgagcctatcccaagtgctctcattctaggaactggcagagtcctcccccttgaggtcagtactgttgtgagctccattttacagatgaggaggtcgggacaccaagaggtgaagtaacttgcctagtgtcacccagttaaaaaatggggacaccaggacccccggggaggtggcctggctcccggtccctcactggagctgctgtgctgtgctgtgctgggatttgctcagcgcatgtggcttcccttctgagacccgtttagcctggccccaggggtggaggaggctctctgttgagcaccaaagccctgggcaggagcagaggactgggaatgcatccaggcccgtcttctgggggtacagagggaggggtgccaactgcgctgaggcctcctggtcccctggtccccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccgtcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaactggtgctggctcctggggagagggacggggagatgcctgtgttaggaggtatctggccgggcgtggtggctcacacgtgtaatcccaactactcaggaggttgaggcagaaggatcacttgagcccaggagttcaagaccagcctgggcaacaaagcaagaccctgactctac

SEQ ID NO: 665926 - DNA, 120 bp, Homo sapiens
actggtgttatcccaacacaacgaggcagtcagcatgactggcagtggctgaagatctcagttctgatctagataattaaaacattgattcaattaactttggttaccggggtgtggtta

SEQ ID NO: 665927 - DNA, 1296 bp, Homo sapiens
taacctcctgaggacagaactcttgtttgttcactgctatttttgcagtgcctagaacaatacctggtgcagtgcactcactcagtatttgtcaaatgaaaaaatataccaagaggctaggcagggaaggagatgaaggagagaaaacaaataattctgcctgcctgacttcagagctgagccttgaagtatgactttgctgagtaaaggagtggcagagaggccaggccaggcccaaggacctgactgcagggctaggaggtgtgttggtgcaggggccctaggcagggggatggccctgcgtgactgcaccagaaggaaggagctggggccggctggcaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccgtcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaactggtgctggctcctggggagagggacggggagatgcctgtgttaggaggtatctggccgggcgtggtggctcacacgtgtaatcccaactactcaggaggttgaggcagaaggatcacttgagcccaggagttcaagaccagcctgggcaacaaagcaagaccctgactctac

SEQ ID NO: 665928 - DNA, 560 bp, Homo sapiens
  misc_feature (167)..(167): n is a, c, g, or t
gtattgttagtatatctattctaatcattttatcttaaatgctgctcttgggagtgaatattcaagtgtgcatcaattttttgaatacttaccctggaagatataaactgggcaagtattttgtgctctgtgtatttttttactgcattagacattgaatagtaatntgcgttaagatacgcttaaaggctctttgtgaccatgtttccctttgtagcaataaatgttttttacgaaacctttctccctggattagcagtttaaatgaaacagagttcatcaatgaaatgagtatttaaaattaaaatttgccttaatgtatcagttcagctccccagtattttaagaaggttgagaaggcctggattaaagaaaaaaaaaattttccatccttttttttaaaaattaggcttaaattggtttttaaacccctttccaaaaaaaggggggttggaccggccctaattaaacttcttttaaggttggtccctttccccgggcctggggccaattttccagttctggctgaaaaaccttttgatccaaagttaaaaaaaaaa

SEQ ID NO: 665929 - DNA, 1885 bp, Homo sapiens
  misc_feature (94)..(94): n is a, c, g, or t
  misc_feature (118)..(118): n is a, c, g, or t
gcctttctaactccgttgcgccatggtcctgtgaaaaagcttgtggtgaaggggggtaaaaaaaagaagcaagttctgaagttcactcttgatngcacccaccctgtagaagatggantcatggatgctgccaattttgagcagtttttgcaagagaggatcaaaagtgaacggaaaagctgggaaccttggttggaggggtggtgaccatcgaaagggagcaaggagcaagatcaccgtgacatccgaggtgcctttctccaaaagggtattggaaatatctcagcaaaaaatattggaagaagaataatctaggtgactggttgcgcgtagtttgctaacagaaaagagagttacgaactcacgttacttccagattaaccaggacgaagaagaggaggaagacgaggattaaattcatttatctggaaaatttgtcatgagttcttgaataaaattgggaccaaaatgggggttaatcgtggtatctctgcagtgtcggttcggaccagaccatttggaatcatagtcaaagggctccctttggtccgcactcatttatttggacttgacctctttttccctggttaaaattcagtctccggggtataccacgctacaggacgggggctaccgactgaagccttggaccacatccgtcttgaatggcagagaacacggcctcaacagtcgccacgcaggtttatgggcccagaccaggcacggccactaaaaaacggcttatctcgagccaggtactcgctcggaacgaaaatcccttgttcgctgggtgctgtactgtcaactatgtcttcttatagtgacgcccaactacccacaccaactcgtgatcacactaactacacatctactaccgcataacgatcgatcgatcacagacgtgatcaatctacgactcaagacacctacagagacccagactaacgatcagtactgtagcacgtcgaagacagagagaacaacgaggaccaccgaagcacagagccagcgagacaaagaccggagagcgcacgcaagcacaaaacagaagcaggacggaacacggaagcgagagaaccagacgacacccaccaggagaagaacgacagagaagcagagaaccgaactgcagaccgagaccagacgacaacagacgcacaccgcacacacacaaccacacgaaaggcagagagccacgcagacagcccgaacgaaccaagatgcggacacacacagagaccacacaagcacacaccacacgcaacgagagaaacagaacggggagagaacacagcagggatgaacagccataaacactcgcgagccgcacgcgggacggagacgacagaagcgaagaccgagagaccacgagacgaccagcccaaaggagaagacacgaacgccgcgaagcgcacggcggacgcagcagccacaccgcgcacacaccgaggagacgagagactgcacgacgaggaggacaagcgaagaacacgagaagcgaccgcccgaccagagacaacgcagagcaggcaaacgacgaagagagcgcagagcgcacgcaggcacgaggacagaagaggcacagcgagacagacagaacgagacgcagcagaacagcagacaagaaggaaccaagcgcaagcccgagaagcgacgcgaagacagaccaagacgacacaggcacgaaacagacaccgagaacgcccaaccgacgacaccagaccgacatagaatcggacgacacacagcaacaagagccgaaagcagagaaacatcaccggcaacagagaccacggagcgagacgaaaagagcacgcgcagcaaagagacagaagagagcagacacgcacacgacgaaagaccgcaccaacgaacagtgcgaaga

SEQ ID NO: 665930 - DNA, 943 bp, Homo sapiens
gccgggcacggaatctgttgcaaacactattgctgtatctcaatgtcagtatctcagcttatctgcaacctgtcacttcttgggtttcaggcaattctccagcctcagcctcctgagtagctggggaatatgaggtgcaatcaccacaatgcctggctaatacatgtacttttcagtagaagtcagagggttcaccatataggccagattaggtctcgaactcctgacctcaagtgatcggccatgcctctagcctcccagaagtgctcgggattacatcgcgtgagccaccacatcccagcctccatctttaaactatgttaaatgtgaaatttctatcatgtaccgttagcctcacaagatatttctattccgatcatctcgacatggtgcctgtgtccccgtattaggagcagacgaaacgctactgctcgttacgttatggtgtcttagtgatgtgacacaaatgtccaagaagattaggagaaagaggaatatttatgatattcgttggatgcttttggttacccaagtagtgacacctaaacttaagcgtttagtaaggagatctgacattctttgcaccgtcccttccctttactcatcgccgaatactactcaaactgggacattattgtgcttattggatcttaaaagtgtaattgatattatactttggttttatctaaacaagtaaaatgtaatttgccgtcttgacaaaagactgacacaagagcaaataagctggaataatacgggtgttatgtgctttcctccatttttgagcatatgatccaaaatggtctgtataatataaatgagaatgatgcagcttaagtaagccttgtgtataccatgtgtgatggacccctgtcataaagccatttcttggtttgtttgggaaagaggcatatgggatttatacacattcgcttgtaaatgg

SEQ ID NO: 665931 - DNA, 218 bp, Homo sapiens
agctgggattacaggcacgcgccaccacacccggccaattttgtattcttagtagagatggggtttctccatgttggtcagggtgatcttgaactcctgaccttaggtgatccgcccgcctcggccccccacaatgctgggattacaggcgtgagccaccgcgcccggccatcctgccagcgttttcttctgtgcactttgggcgctcgtgccgggta

SEQ ID NO: 665932 - DNA, 869 bp, Homo sapiens
cacgatggctcacgcctgtaatcccagcactctgggatgccaaggcgggcagatcacctgaggttaagagtttgggaccagcctggccaacatggtgaaaccccgtctctaccaaaaaatacaaaatacaaaaatttagccaggcttggtggcattgcacctgtaatcccagttacccaggaggctgaggcagaagaactcacgtggaccctgggaggtcagaggcttgcagcgagccaagaatccaacctgtgggcgacagaagcaagaactcgtgatctcaaaacaaaaaaaaaaaaaatctcgggacattctcctttatagcgattatttggcccattctccagatagaagagagttctcctaaacagcgcatcaacaaggtgggaacaccgaggcaacagaacgtggccacaccgccgcggtttatcccccgagacagctgtgagggaaggcgccaaagggaaaaggggcgggacctcacagagaggcacacaagagagaagctgtggaacaccagcaccgtgggcgccccaaaatgagtggagtaaaaacaccgcgcggatcaatatacacaataaacacattcccagagcaaaaatcaacccgagagaccagagagaggggccgccaagcaaaaacaccggtaaatggaccccagagcagatatatcaaggcgaggaagcgacagaaaggcgaagggaaaaaacgtgcggcagtgaaaacccaagagggagcaggtaggaaagggagcgccaatggagaacgccaacaagcaacacgggcaccacccagggcgcgaccccaacgtcatgggggaaaccagcagtaagccaaagaaactcaccaatgacacacaaaaaaccaaa

SEQ ID NO: 665933 - DNA, 1206 bp, Homo sapiens
gatcgcaatggcattcctaatgcttaccgaacgaaaaatatctaggcatatataccactacgcacaggcaccacaacgtatgtaggcaccctacgggactactacacaaccttcgactgacgccactaaaacatcttcaccgaaagagccccataaaacccagacacatctacacatcagccctcatacatcacacgacaccgaccctttagactcatcacccatacgctcattcataactattgacaccacccccatccacacaataacaccaagccaccacatggatccatcaacccatcccaaacatcagcgcccatcacgctaatacctcatatccttacaacacaaacccataccataaacacattagtcccagaactatcacttccaaaatacaccacttacctgcacattacacagcggatctgacaagaccaactccacaacatcccttcagcacaagtcttaaccgacacgccatgacattaccgagaccgcatacactgggacgcaacggccaagaccaaggccgcacaaaccaccaccacgtacatcacctaacctggacaaggaacgaaagcaccattacagcccagcacatgcgcagctcagaccgtcaccatacacttactacaaaacaacagcattttaacaccataaaaacataaaagaatcgaggactataccctcatataaccaacccatactacttcaccaaacccacccattcaaactacaaccaacaaacaaacaccacaacagaactcacaacacactcccatccccttaccacattcaccacatcacaccatatcaccacaactcagaaaatagacaccaccaccaatcaaccacccacccaacacttcacacacttaacctgtccacaatataaaaacaataccgactcccccaacaagcaaaccagtataacacaccacgacaaacgaaaacacaccagaactgcacgacagaaagaaaggccacacagcacatatataacgaaaccaaacacaatgacacccagaaaacacgaagagaaacgatcacagcaaaagacaaccaagagatctaccaaaagaacacatagacacacgaaacatcgacaaaaaatacaaacgacccacaccaaacggcccaccccaatcgacatcacaccgcacaacatatcacacactacaaactaacgagccaccgcaaaca

SEQ ID NO: 665934 - DNA, 133 bp, Homo sapiens
taagacaccgtgttacatgaaagagaaccgactttaactttacttttcccctcaagcttggcctgctctcatgcaaacgcggatgcctcagaaagaagatgtctactggagtcactaacaacgcttttgatta

SEQ ID NO: 665935 - DNA, 1382 bp, Homo sapiens
ggagattccggtcctggtagctcctcaggtgctcgcgtgtcacattatggtggcaggttcatggagaatagcttgaggtgacgatgacagcagacacgacagtgggtctctgggatctgcactgtgactgttgtgggagagtcgccttccagaagccctgagtcacgcagccttcagaggcaccatagtggctacgtagaagcactagtactcgtgcctgagtgctctcagtagcttggtcccgttttatccccgagcaagcgaggaccttgtggaccttgtgagctgctgcgatctcgaattaaccagtggtgacacggtcaggcaccaggcctagccagtcccacttacggttgaggactcttgccttggaggtctcttggcgtgattggtttccgaatacactggaagactgcagagagctcctccagcgcttgggagacgtgcgttgggctgaaaagcctggtggtcttaacgtcccacgctgggtatcgtatcgcttgtaacacttatgtattccagaagaagtgcgtgttgccttgcacccccctggttgacatcaagcgagggctcccgtggttgctagcaatgcactgcgcaccgaacttgcggggaaggggttggggcccatcaggaattgttgggcacgttgttctatcgctgtgaaaaccgccggggttcgtattgatcccccttgtgggtggccttggtgttggccattttccgtcctaaacataactagcagtatactcccatttcggggttaatcacaccgtttctaaccaatcaagagttgtgcttgaacaagaacgaagggataccgatttagccaccgcgtcctttcaattgatcgatttgctgaaccgttagggacccggtggagtcatctcccattcctattcgtccctgggcgcctgtgttcgccacggtgcgggccatcggggatacagcgatagcgataaccaagggcacaagaaatggggtccgcgtttgctatgggttggcgtaggaggacgtttggagaccccgagaataagcgttcaaggaaaggaaggttgggatcccaagcaggagctccagtggcaggaactggggcggccattcgaaccggtggggccttttgtcaccccaaacttggtgaggccatcccctaggtatatttgttccacccggtctatcggcgttggtaacacacaaagagtgaccagaaagttccccttcagtctttgcccctcatttaccaccgttgacaacatcactgtacatgtgaatccttcaaggcgcttttcaagacaacctgtcgcgtgcggcaccttggctccggtgggtgtcccaccccactataggccagggggggcactcaacaagtgtttccacctagc

SEQ ID NO: 665936 - DNA, 179 bp, Homo sapiens
tgtttttaaaaaaaacagggcccataaccagtgggcaactttaggaaggatggggatctgtttccgatttaggcataacctgttaatcacaggtgtccaaacttttggcttccctgggccacatttgaaaaaaaattttcttgggccccataaaataccctttcgatagctgatgagct

SEQ ID NO: 665937 - DNA, 136 bp, Homo sapiens
tttttggagtctgatcttatttatttgttactcaaagaatcttatttctggctggactcagacttagaagtaggagctcgcagagaggaaagtgtgcgtctcttcacaatttgttcctggcgcttctcctcagcct

SEQ ID NO: 665938 - DNA, 233 bp, Homo sapiens
aattttcctgcctcagcctcccgagtagctgggagtacaggcacacaccaccacacccagctaatttttgtatttttagtagagatagggtttcaccatgtctcccaggctggtctcaaactcctaacctcaagtgattcgcctgcctcggcctccaaagtgctgggattgacaaggtgggagccactaccagctggcccagcagctctgtttctgataaaaggtggttgggg

SEQ ID NO: 665939 - DNA, 959 bp, Homo sapiens
tacagcggcgtgatcacggctcactgcagccccaacctcctgcgcttgggtgatcctctcacctcagcatcctgggtggctgggactgcaggcatgcgcaccacatcttgctatttttttttttttttttgggtatttttaattaagaaagacgagagggtctcacccggttgttccccagggctgggtctcggagcctccttggggcttaggtgtagactcccacctgtgtttgggcgcctcccaaggtggctggggttttatagggcgctttggcccacttttgtggtcacgaccctagttttattttttcgtggtggaggacaaaaggggcctcactttttgttcgcccatgtgttgggtccttaaacctcgtgtgtccttaaggtgactcctctccactttggcccctgcaaagtgtgagtggcgttggcgggcctaggttcaccagtgctgggccctatatttttggcttaacaccggttttaggcacactcagcctcgtgtatatcaagttaccttgagggggccccgggtgcctagacccccattgaaaagactccaggtttgccacattgacgctttggcccaggatatgcgggtcccgggcactgggggtgggacctctttctaccaagacggggtcgccttcgggcttggtaggactagccgcgccgggcggacacaatcagcttcgggcgggcgccggcaaagagttccttccgttaatcccccacagaggggggccctatccggtggttcttcccacccttcactaagcgtcccagggttgggacacttggtctggccccaacgcggggtctctctgttcccgatattttggacgccgctcgaggtttccgggtgtgtgcccgggcccaccccccgttggggggccggccggatgtggacgccggcctgctgtcactcacctcggccgcgtggccctctttctagcg

SEQ ID NO: 665940 - DNA, 175 bp, Homo sapiens
ccccttttttttttttatttcccccccgcgcccgcacccaaaagaagaggggagaggattttgtgttgccccctctttaacaaatttttgttaaatgcacgctagtgcgctccctcccaccctgtgtttttcccttgttgttgggttggcaaaataattttttttgtgcccccca

SEQ ID NO: 665941 - DNA, 137 bp, Homo sapiens
aacacagaggaggaaagcaagacgctgagcctggtgtcgcgggatgccaagcccctggaggtgtacagcgtggacttcatggtggacaatgcccagctgggttttctggtgtctgaccgcgaccgcaacctcctctg

SEQ ID NO: 665942 - DNA, 549 bp, Homo sapiens
tcacatgatgtaggaggtgggatttcagctggatcttaaatgttgggtttggagtggcagagttctaggagacagaaaatgagttgtgggtaagaacagacaggaggggtgaggacagtaataaagaacaggggtggtctggagctaaaggtctttgtacttgagacactgaaggagccaaaaaataattaatatactgttagcaacttattatagtcctcttagatgctaaattatgatgtagacattttgaaaaatggtctcggccaggcgcagtggctcatgcctctaatcccagcactttgggaggctgagatgggcagatcacctgaggtcgggagttcaagaccaacctgaccaacatggagaaaccccgtctttactaaaaatacagaattagccaggtgtggtggcgcatgcctctaatcccagctactcaggaggctgaggcaggagaatctctcgaacccgggaggcagaggttgcagtgagccaagatcacatcgttgcactccagcctggacaataagagtgaaactctgtctcaaa

SEQ ID NO: 665943 - DNA, 459 bp, Homo sapiens
  misc_feature (41)..(41): n is a, c, g, or t
  misc_feature (66)..(66): n is a, c, g, or t
  misc_feature (97)..(97): n is a, c, g, or t
  misc_feature (182)..(182): n is a, c, g, or t
  misc_feature (197)..(197): n is a, c, g, or t
  misc_feature (333)..(333): n is a, c, g, or t
  misc_feature (392)..(392): n is a, c, g, or t
  misc_feature (441)..(441): n is a, c, g, or t
ttaaaagtttgtttaatgggaaaaaaatttattttagagtngggagggatgtagaaggtggagtangaaggggagggagaggaaagagggtgatggnaagaggataaatatgattttttattggtttgtggggttttgggaaagagttttggctttaaattgggttatttttttaaagggtntttatttggtaaatnagggaaggaattagcataaggaaaaggttggatatttttttagtgttatgaagtattgatatggtagttaaaaagctgagggatgtttttaaataaagtgttttatattaggaactctgggctacaatatagtttnagggaaaagttccaatctgagcctctttgcacctgcaataagcaaataccttttctttnctgaggatcatttgcttaaagcactgaagagtgagctgctagctgcagnagtggtggtaaagaatga

SEQ ID NO: 665944 - DNA, 361 bp, Homo sapiens
cgggtgtaattataagggtctggcgagctctaccacgggtgtatagtgggcctccaaggaacacagagctctgtaagtacaacgtaacgcagtgttattcgcaggacacgagttggatcctctagtacggtgctcactcaccgtgccagttgtgctgcaccgactatagccacctcagaaagtagatctccgcctgatggagagtgtgctcttgtcacccacacggcgtccgttacaattatcaccagagaaacaaaatgtaggagacgtgagaccataagtctgggctaaaagatctgaaatctctccacatataatatgcatctcttttcaaaatgtgcagtgagtctatacattttct

SEQ ID NO: 665945 - DNA, 859 bp, Homo sapiens
gggacagagtgcggctgctgagagccgagccagctatcccgatcctctgagtcgtgaagaagggaggcagcaagggggttggggttggggcctgaggctaagcccccaggctccgtcttgccacagggacaggagccatggctcagaagatatgggactgtggtgcagaggctctcctcggcattccaggtctgtaggcctccgctagaagacacgtcgccttgtcttatgcaccgacctgtgatggagagccatccagatctcgagaggactccacctactaaaccagggccaccggaggctgctagtccccagatgttcagcagcccccgcaagctgccaatgatagtgtggctgacagttcaggtttcacgacaggtgaccgctaatggcctaaggtcatggcttataaagtccagaatgccaccacaaaaggcccaaatggtgtctatgatttctctcaggctcataatgccaaggatgtgcccaacacgcagcccagaggcagcctttacgtgccacatatgtaccccaaagggtccacatgctgactatgatttttcccaggcagcaaccaactggtgacgttagctgctaacaagtctgagatggcttcaagggcccaggaatgccactacttaaagtggggcccaaatgccaagcctacaagttcctctccagtctctcaatgccaatgactcttgcgcccaaagcaggggctttagacccctttccacaggcctcggaatgataccaatagggcaccaacaaggcttataacccagaacccagaatgtaacatcaagccaacatgggcctttccaggttggcttaaagcggacccagttcttctgactga

SEQ ID NO: 665946 - DNA, 210 bp, Homo sapiens
aaagtgaaaagaggacatcaggacaggcttgcaggttcaccccgggaagtccatccacttttagctgagtgttgaatcttttaaataggtaccagaggtcttccaaaaactcatagatgtaggtcatgatgtcctctttttgtgcctgtgactcagaaacaggtttaatcatggacaggtatacccaactggttctccccggaagttcca

SEQ ID NO: 665947 - DNA, 252 bp, Homo sapiens
ttgggccagccaggcaaccttctaggtaacgacacacctacaacgttatcgtcacagcccatgcatttaattatagtaatacccatcataatctggaggctttggcaactgactacgttccccgtaataatacggtgcccccgactattggcgttcccccgcattaaacaacataaagctttctgactcattacctccactctctctctactcctgtctcgcaatctggatataagtgggagggccgggagc

SEQ ID NO: 665948 - DNA, 1380 bp, Homo sapiens
ggtattgtagagcgcagcggctgacgggcctggatcgccttcgccggcgtcccggcccgcaaaccattcggtgcccggtgccgttacttcgtccggtgacctaaccgcgtacgacgtagtgctggagctgaatgagagtgagcaacggatccggcatccagggagacgagataccaagtgacaaacagacttctagcaagggaacgccgtgtcggcatggaccttgaggacacgtgatgcatcggcgcggcgggacgcgcattaggcgatagtaaacgcgagcacatggtgaccagacaacgcatccgatccgtcatcgaaggacactacacagatcacacaggcccgcaacaacttgctgaagccacttcattctcctatacgtagacgaacaaagccagacaatacccaaccctaacgagcgaccacagccacagccggccctagggaacgctacacaggacccaacgaaggacccccacgggagacaccgacgccaacagcagaaagcacccacagcgtgaaaagacgcgctaagaacgacaaccaagaagcacacaaagagcgctaacacaacacccaaaaacaacaaggccaaacaccaagaggaacacccagaacaggacaacacgcgaacaccgcaacacgacaaacgatccccgaaagacgacaagacaaaaacgcaccaggtacccaaccacacataaaagacgcacagaacagagacatgacacaacggaagtgacaacaaaaggcacagcagaagcgcgaaaccccagaacagggaaacccgcaccagaacacaccctgacagacacacaccaaaaacacacgccaagcacaaaaccaggaaacacaggaccccaccaaacaaaatctgcaacaccaaaggaaagagaacccaagaaaaaggcacagaaaagaggcatacccacaaatatgagacaaggccagacgaaagcaatgataccacgaacccaactgacgcacaaaaggaacccggacatcacatcgaacaagaaacccgacagccgaccaacagaaatagacacaacacaaaagagatgcaacaaccacgcaaggagaaacccttagagacacaccataagacaacagagaccggacaaccacacaaaccacacgacacaacacccatcaaaccaacactgcaacacacagtacgacccaaaacacagcggaaagacacaacaacacacaaacacgaaccaacaacatgggaacacaacaagaaacaacaccagaccaacaaacacaaccacatgcaaagaccagccaccacactacactacgacaccgacacgatacacccacacacacaccaaaacacacacgaaaacacagacaacacaacgcaacccc

SEQ ID NO: 665949 - DNA, 461 bp, Homo sapiens
  misc_feature (100)..(100): n is a, c, g, or t
  misc_feature (102)..(103): n is a, c, g, or t
  misc_feature (136)..(136): n is a, c, g, or t
gttaaaaaaaaaaaaaaaaaaaaaggtaactatgctcattattttcaaccaagttctatggaggtggtaccttcacaggagtccccaaaggggtttggtngnnaacaacttggggcgggtttttttaaacccttcntttaaaacacattcttttttctgggaacctaatgttagcagacacagttgctagtttgaacaggaatgcagatgaatggatgaaagtgggctccctaccacccagaaatatgaatgtgcctccttaccaatatgctacaaatcagacctctgaattagaagatgccatcatgcaactaacttactatctggagatgtgtattttgttaacctaggcaaagaataacaatttctgcttattccagtaggtgtgacaagctcagagaagtgagcgacaagctagagaagtaataattaccaataaagtaaattccaaagccgaaaaa

SEQ ID NO: 665950 - DNA, 106 bp, Homo sapiens
taacaaagcgatggtgtactatgggaatggcaacagttgctgaggcctgagtctgcagtctagcaacaatgtccttccgagctttcatgacagcatccagctttcc

SEQ ID NO: 665951 - DNA, 725 bp, Homo sapiens
ctattcctccccccacgtggttcaaggacgtcgcccccccccccttgctgcctcccaccccccgttcctttttgggtaaccccccccgcggccgttgtttctggctccccccacagggtgggtgccccccccccttcggctgtgtaatcactttgggcgaggcacacccaatcttggcggctccccccccccccccctattgtaggcgcgtgctctactcaggccaaggcgcgcgcccccatcccttgatgcgccgccctaacctctaccttgctgggcgccaacacataatcttagcggacccgcagcggggcttccagcaccaccagcccccgggaaactcgccagtaggttgggttccacaacagcgcgcgcgcgcccaagccctcacacaacataggagagaatatatatacggaggacaacagactatctgcgggaagaaggactcaggtcgccccgagagaacttgccgcggtgtaccaccccactccctggggcggtgagccccaccccctctgcgaccccccgagcgcttggcatcgacacgagatgcacccacacactcatcgtcattgtcgggcagaacgcaggagccacacccgtgcggccggcaagcgagggacggatgccaccctggcctcaccccacgaagaaatctagcagccagcagagcctccccaaaaaaaaccaaaacatgtgtatttctcgcgacatcaaaacac

SEQ ID NO: 665952 - DNA, 342 bp, Homo sapiens
ttttttcccccccccgggggaccgggggcttgggttttttttgtgccttccactggggccgggccccggggcccttcttgggttggggccggggtttttttaaggccccagggcccccacccccccctccgggggggttcgttggggccttgaaattatttatggggggggcccttccccttggcccccaaacccccccccttttttggcccccaaagtttgttttttgaccctctgggggggctttaaggggggggttttgtttgggtttttttttttttttttttccgttttttttgacttttttttttttaaaccatttatcccttttttcccggggta

SEQ ID NO: 665953 - DNA, 250 bp, Homo sapiens
ggaaaggattggatattgtacttaaatgtgcatgatgaagacagggatgatcaaacaagatgtaatgttttgatcttagatggagacctatatcacaaaggccttcttaaaaattcacttgatgccgtatctcttaaggatactctagttatgccttggttgttgacaatgtcaaagaccttggacttcttttgattctttaacaggaaattggcaagtgtttgttagtgaacaatgttgacaaacgtta

SEQ ID NO: 665954 - DNA, 123 bp, Homo sapiens
tatgcccaaagagacagaaactatatgaatcaacttacataagctcatctaacaacagtgctgattctgaaatagaaagcaattgtatgggcaaagcgcgcagaaaacagaaatacatgggtt

SEQ ID NO: 665955 - DNA, 305 bp, Homo sapiens
ggggggaaaaacatcccccccaaaaaagaagttttggcccccgaccggggggagaggaagaaaaaccccccgttttttttaacccccctttgggccccaaaaaataattttgggggggggggccacaaaaaaaattgttttttaaaaaatttttccgaaattaaaaggggggaaaaaaaaaagggttggcccccggggaatcgggtttttccctcccaaattgggaaaaggcccccctttttttggggataaaattcaaagttttggaaaaaaatttttggttcccaactgatccatggtgccta

SEQ ID NO: 665956 - DNA, 94 bp, Homo sapiens
  misc_feature (93)..(93): n is a, c, g, or t
ttagtttttaaatctctttactgtttaagacatttttagtggaagtatttatctttggcatccaataagacctttaaggatttgcagttttcna

SEQ ID NO: 665957 - DNA, 1129 bp, Homo sapiens
  misc_feature (504)..(504): n is a, c, g, or t
aggccaaaaatagatgaggctgttgttcaagtagcgcaaaaaaaggttttaaaacaaattttgtgggtttctcctttgagagccgggtatgtgggtgtaaagtgttttttgaagaagttgtttaaaaaaacccggtcgtctttaggggaatgccaccccaacgagcgccctgttcccctcctcttggggggacccccacagtttgagcacaatctgtctccgacgccaccctggggatttcagcgggagggcacccccccttccaaatgggaagaataatcccttcggacacgtgggaatatatgagatcacaggcctttgggaatgaattgttagtgacggttaaggtgatatcccttatagaggggataccataatgggagtattttcaaacgcgggtttacaccgtttgcccccatgtagaaagaagtataattggaaccccttgcctggaaaattttatgcaccagggagtacacatccggaactcgctacccctccctngtcccgccccgtgtagaagggaaatccccaggcaccatgtttagagaattccgcaagatgtattggaattcccctccttcttataaaattgggaaagcccctcttccaaaccttccccttgtattcccctttaacccgccccgtgtatcccgaagatttaaagattgttgctccaatcttgccccgcccattaaccctggagagaagttagcccccgctggagatgtttaatgatagcagcttctcctcgggcccccgaagggagaatccaagggagaaaaaataaagactcgggagaataattaaaaaccactgtctgaaaaaacacgctccacgaccacacggaaccgagagcgaaaggaaaaagaaatattccaaagcgtattgaaaaataaaaagagaaaggagaaaccggaggaaaactggcttgaaaagagccacgtgtagatcaagcagggaaatacagccaaaccgtagcttcggagaagtttaaacagctgacccaaactggccaagcttcccttcataaaggatgaaggtaaagaccaggccctttaagtcctcttcaagcatttttttttaaattaccagatcacagttaaaaagccaatccatgatgccaaga

SEQ ID NO: 665958 - DNA, 129 bp, Homo sapiens
agtgtattgtcaggctcggcttggtgaaaagatttgcactcgttcatcatcttctccaacgagttcagattgggtaaaattctattatttactaaggtgtatactgtagtgtttgtcacaagagaatct

SEQ ID NO: 665959 - DNA, 256 bp, Homo sapiens
gcggcacacctccgcttctggggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagacttgcgcccggccagccctgttgtctttcaaagaacctcggccca

SEQ ID NO: 665960 - DNA, 114 bp, Homo sapiens
tgtgcggccttaggggtagtgcgggaaggcacaccagaggatagaagattctcctctggcctcttggtcagcaccctccccccagactaaaagatgtttcggggaactccaggg

SEQ ID NO: 665961 - DNA, 967 bp, Homo sapiens
tgtgccctgctaatatttgtatttttggtagagacgaggtttcgccatgttggccaggctggtcttgaactcctgacctcaggtgatccacctgcctcggcctcccaaagtgctgagattaaaggcatgagccaccatgcctggcctcattgtagtttcgatttgcatttctctgatgatcagtgaagttaagcatctttttatatgcctgttgagatttaaatgtcttattttataaaatgtctgttctgggctgggtgtggtggctcacgcatgtaatcccagcacttggagaggctgaagtgggtgtatcatctgaggtcaggtgttcgagaccagcctggacaatatggtgaaaccccatctctgctaaaaatacaaaaattggctgggcatggtggtgggcgcctgtaatcccagctactcaggaggctgaggcatgagaattgcttgaacccaggaggcggaggttgcagtgagctgagatcgcatcactgcactccagcccgggtgatagattgagactctctctcagaaaaaacaaaacaaaacgttgtttttgggacgggcgcggttggctcacgccctgtaatcccagcactttgggaggcaaggcgggccgatcccctggagtcaagagtccgagacagccaggttaaccactgggaaagcctgtctctataccaatccaaaaattaggccggctctgtatgtccacagcccgcactgttccgattctgcgcctaatacattactcgatggctacgctttcatgttgttgactaaagcagtaacgctaaaagcacggacgccctcaggatcggcgggagggcacacacatcaaccggggaaccccacagagcatttaacagcctgccacagacccagaacacgagagatagcccagagatgcccgcatcagaatggccttactccctcataatatggcgtagctcaaagtgtactt

SEQ ID NO: 665962 - DNA, 164 bp, Homo sapiens
ggtgtgcgatctctcagttttcctttctgttgggcactttaaactttgttgatctttgtaaattttctcatggcatgcctcttgtggagaagtatttggaaagacataccgtgtctgaatttctctggactctcccattatttctactgttcagaccgcgggct

SEQ ID NO: 665963 - DNA, 607 bp, Homo sapiens
  misc_feature (111)..(111): n is a, c, g, or t
  misc_feature (123)..(123): n is a, c, g, or t
  misc_feature (127)..(127): n is a, c, g, or t
  misc_feature (187)..(187): n is a, c, g, or t
  misc_feature (193)..(193): n is a, c, g, or t
  misc_feature (203)..(203): n is a, c, g, or t
  misc_feature (288)..(288): n is a, c, g, or t
  misc_feature (295)..(295): n is a, c, g, or t
tacttttcacaggggtgttgccccaatgtggctctatgtaccacagtacctgggcttggggtactgcatgttcccccgctagccagccccacccatcataaacactacagnccagccaggggncggntgtgctgtgggtcttacagcatcctttttcaaagcttgccatgttgcctcacagacatcngccatnggaccccagntctccagccatgtccagttctctgcagatactgaatgtatgtgccaaggcaagccatctgcagctgctgttggaagggcagtgcngatccancagatggaaacttggtcacctcagcgtaggtgtgggcccagtccaaatgcagttagagcatgttaacctacagttgaaatgacagagcaggtacaggtactaacagaggtaaatcatatccctcaggcaaaatacaggctaatctttcatccctggataacaatgcagccaccaagggcttttgctctgggtgatggtaccacacctcaactccccatggttcctttgagtcctgtatctgtgccaaagtcacaggagagctcataataggccaaacagacagtgcacatgtcccccagaggagagttcctt

SEQ ID NO: 665964 - DNA, 266 bp, Homo sapiens
  misc_feature (1)..(1): n is a, c, g, or t
  misc_feature (165)..(165): n is a, c, g, or t
  misc_feature (214)..(214): n is a, c, g, or t
  misc_feature (249)..(249): n is a, c, g, or t
  misc_feature (253)..(253): n is a, c, g, or t
ntactctgatgcatatagttgtcttctgacttgcttcttttctacctcacccttttttccttccatatctttggtccatctttaatcatataactcttttcttaatttatgctcttgttcttctgacctcattgtttctgggtttccttattgtgaagctgattngccctgtgtttacttaagttactctgaaatgttgccaaatccatgcagngctctttttatttagtgtccatcacttgttttctncctngttccatatgata

SEQ ID NO: 665965 - DNA, 209 bp, Homo sapiens
  misc_feature (193)..(193): n is a, c, g, or t
cttcggcacgagcattctataaagcttgggcctttatttttatatacattcagttaaaaggcacactacagtcatcactaggcactctgctttctaggcagttgtattgaaacagagaatctctgtgtggacttggatatgacccaagctgagtattatctaaacaggtggtggatgaatgcgcatgtacctnattatgctgacatact

SEQ ID NO: 665966 - DNA, 524 bp, Homo sapiens
atcgcagcttgatagccattctctccgtacgagccccttaagttacacgccatgtaccagcccttccttgagatgatacacgaggctcagcatgccatggacatccacttccacagcccggacttccagcacccgacaacagaattcatacgagaaggcgacgatgaccggactgtgtgccgggagatacgccacaactccacgggctgcctgcggatgaagtaccagtgtgacaagtgccgggagactcttgtatgtggactgttccaccaacaagccctcccaggctaagctgcgacgggagctcgccgaatccctccaggtcgctgaagaggttgaacaggaaatacaacgagatggtaaagtactaccagtggaagatagctcaaacactcctcctatgatggagcagctgaacgagcagtttaactgggtgtccccggcttgcaaacctcacgcaaggcgaagaccagaacatctgagggtaccaacgggggtaccacacttctgactcgcacgtcctt

SEQ ID NO: 665967 - DNA, 486 bp, Homo sapiens
  misc_feature (27)..(27): n is a, c, g, or t
  misc_feature (65)..(65): n is a, c, g, or t
  misc_feature (67)..(67): n is a, c, g, or t
  misc_feature (74)..(77): n is a, c, g, or t
  misc_feature (79)..(79): n is a, c, g, or t
  misc_feature (81)..(81): n is a, c, g, or t
  misc_feature (146)..(146): n is a, c, g, or t
  misc_feature (168)..(168): n is a, c, g, or t
  misc_feature (173)..(173): n is a, c, g, or t
  misc_feature (196)..(196): n is a, c, g, or t
  misc_feature (204)..(204): n is a, c, g, or t
  misc_feature (212)..(213): n is a, c, g, or t
  misc_feature (216)..(217): n is a, c, g, or t
  misc_feature (222)..(224): n is a, c, g, or t
  misc_feature (235)..(235): n is a, c, g, or t
  misc_feature (249)..(249): n is a, c, g, or t
  misc_feature (265)..(265): n is a, c, g, or t
  misc_feature (267)..(267): n is a, c, g, or t
  misc_feature (269)..(269): n is a, c, g, or t
  misc_feature (272)..(272): n is a, c, g, or t
  misc_feature (285)..(285): n is a, c, g, or t
  misc_feature (293)..(293): n is a, c, g, or t
  misc_feature (302)..(302): n is a, c, g, or t
  misc_feature (325)..(325): n is a, c, g, or t
  misc_feature (332)..(335): n is a, c, g, or t
  misc_feature (351)..(351): n is a, c, g, or t
  misc_feature (361)..(361): n is a, c, g, or t
  misc_feature (367)..(367): n is a, c, g, or t
  misc_feature (372)..(372): n is a, c, g, or t
  misc_feature (381)..(381): n is a, c, g, or t
  misc_feature (386)..(387): n is a, c, g, or t
  misc_feature (389)..(389): n is a, c, g, or t
  misc_feature (395)..(395): n is a, c, g, or t
  misc_feature (397)..(397): n is a, c, g, or t
  misc_feature (403)..(404): n is a, c, g, or t
  misc_feature (409)..(411): n is a, c, g, or t
  misc_feature (415)..(415): n is a, c, g, or t
  misc_feature (420)..(420): n is a, c, g, or t
  misc_feature (483)..(483): n is a, c, g, or t
gaagcaagacaaaaataaaatagatanttcattaaatagaaaccacaaagaaaaactacaagtanantaggtannnntngngagtccagagttgctctcaaagaagtatgtaaccaaataaaactttgttctggtagaaagttacncaaatatatatacctcattttngagcntattcttaccaaacacatttgantaccagtncagcgggnnttnnacttnnngtatcactgangccccttaaaattnttcaaatactttctanananacnaacactgcctganttattttncttcctgantctcactcccactcccccgcctntttcctnnnngggggggggggggggngagggggagnctcgcnctggngggcagggnggggnngngggggntnatcttnnttcannntaanttctncccccttttttcactccattccccatccccatcccccctctaatcttttacaacataatcccncca

SEQ ID NO: 665968 - DNA, 218 bp, Homo sapiens
ggatccccgtggtcctatttgcaagggagggcaaatgatttggtgaatgtacctttgggctaaagatcagacgaaaattcccatataagcggtcggaggtgctgatgtacatcatcaaagaatggctgatgtgtaccccggagatcattgaacagatgcaggctatgctttggagaaggtagtggggattcagttgaaggaagttgatgcccggggaa

SEQ ID NO: 665969 - DNA, 241 bp, Homo sapiens
gcctagaggacccgtcatttctacacatgataatataatacgtatatggttgaagttattttattttttactaatgaattattttaatattccttattgaataaatgctgtaacttgttttgctactggcaacttattctataaacgttctacgttaaaacataactttttccacagtgcagtgacacaatatgtattaactcagagtgtgtagaacattgaagcgggtaccgagtctcga

SEQ ID NO: 665970 - DNA, 884 bp, Homo sapiens
  misc_feature (683)..(683): n is a, c, g, or t
  misc_feature (749)..(749): n is a, c, g, or t
  misc_feature (816)..(816): n is a, c, g, or t
  misc_feature (838)..(838): n is a, c, g, or t
  misc_feature (874)..(874): n is a, c, g, or t
tcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccacccttcttcaaaagcgaaatcctttccttccagggctagcangcttctttagaatatggatttccaactttgcccttctagctcatcccctctatgaagtgggcaaangcccttccaatgaacccctaaaccccttacataacatacttcccagctttcacaaacttccaactgntcttggcactgggtaagttcgnccttactggaatttccaacctttactcttatactgntgaagctgag

SEQ ID NO: 665971 - DNA, 147 bp, Homo sapiens
accgcaggcagttgcacccaccacatccatcatctgcacagcatgcatatgcttttcccctgcttgcccagctgatctgcacacatgttttcgctggccccattcaatccatcagcatccaagcaaagcattgcatgtgcacttcag

SEQ ID NO: 665972 - DNA, 1052 bp, Homo sapiens
  misc_feature (1052)..(1052): n is a, c, g, or t
gcctctgcgtccaattgctccggtagcgaggctcgtgagtgtgtggcggccagtgacgaaccggctccgagggcccgataacgtgacggcccgcacatgccagaccgggctagtcgtgagggtctcgcttgatttgagaatggctagctgtcgaatatgaatcagtggctgaaataggtgtcgtgtgcctatgggacaggtgtacgacgggcccgtgatcccacacacgtgggcacacatttgtgggcctcaagatgtgtgagacgtccaccgactggagagaaggacggctggacggagcgccatgcaccaattgttctaccagtgcagtgaagagttgggttatactgaaggcgattgtaggtatttctgacgtcagtcccaagtggtaagtgcgagtctgagtggagcagtctggagcgcagcatcctcgaacctgaacgggagatcagaggtgacccaggggggttcgagcatgtagaccagggacctaaggacgatatcgtggatcagggggacccccagacagggcttgccagccgagaccggatccagaggactgtgagtgcggcctacgtttctaagaggccatagatatccgttgaatgccgatgtgcatcggttcaccgagatctgaagccagagaacattctggtgacacgtggtggaacagtcaagctgggtgactttggctggcagaatctacaggtaccagatgggcacttacatccgtggttgttgcactctggtaccgagctcccgaagttcttctgcagtcagcatatgcagcacctgtggacctgtggagtgtgggtgtatttgcgagaggttcggcgacaggccctctttggggacctgagcaccgtggacaacttgcctatgggggctccaagctagtgggcgagagttccggccgggggctttcccagaggcctcggggttcacgggagcgcccgggtgaacgtttccccagagtctcgctcgcactcgggaccgcgaggcggcacatctccggcgcttgtggtcctcctctgctcgcgtcttctcctttn

SEQ ID NO: 665973 - DNA, 441 bp, Homo sapiens
catcccagcagacacagacttcaccagcaaagacgatttatttacttcaagagttaagagtggcagtttggggatagcaccaggagatatcagctgtgatggcttggaaaaacagtgtaaaccggcagtgtaaacaagagcagggcatgtatgagtagttgagaatggtgaataggagtatgaccagacagaaaaatagtagggatgacaatttttttttttttctttgaaggccacagtctaagtgggtctggtgtctggcaatgagacactggggcctcaataaaacggagcgtctatacaggcagcttaaatgggctgtcaccctgtagcattctgaggataggcctgaattctgagaagggaaagtggtaaaagtattgtccagtcctttttaagttggtggctgagcttggtgaggtgtgtttttaaaagcacctt

SEQ ID NO: 665974 - DNA, 756 bp, Homo sapiens
  misc_feature (197)..(197): n is a, c, g, or t
  misc_feature (319)..(319): n is a, c, g, or t
  misc_feature (333)..(333): n is a, c, g, or t
  misc_feature (646)..(646): n is a, c, g, or t
  misc_feature (662)..(662): n is a, c, g, or t
  misc_feature (687)..(687): n is a, c, g, or t
  misc_feature (716)..(716): n is a, c, g, or t
  misc_feature (749)..(749): n is a, c, g, or t
  misc_feature (753)..(753): n is a, c, g, or t
gagacgtgcatgctggatgcggtggctcatgcctgtaatctcagcactttgggaggccagggtgggaggatcgcttgaactcaggagtttgagaccagcctgggcaacatggtgaaaacctgtctctataaaaaattaaaaaataataataataactggtgtggtgttgtgcacctagagttccaactgctggggangctgagatgagaggataccttgagctggggactggggaggcttgggttacggtgggctgggattgtgccactgcactccagcttggacaaaagagcctgatcctgtctcaaaaaaaaagaangatacccagggcangttaagttcggagaggcacagagctcccatgccctctgttgaacatgcgaccctcccagcatctcctgtgtccagcaaccctgaaagctctgcaaacccctttcagggtgtttatggaggctttattatgcaagcatgattgataaaacctttggctgttggtgattaagtcagtctccagcccctcttccccctggagttcagtgcatgaggctgaaagttccaagcctcttaccatgtggttgcatggtaatcagccctcctcttgaagaaatttaggagcttgcagtcacccagtcatctcaacaacatncccaaatgcattcttnccatgctggagatccaaagtcttanagctcttgtgttaaaaacctgggaccaanaccaattttaaacaaaaatgctcctgtcacatntttnatt

SEQ ID NO: 665975 - DNA, 357 bp, Homo sapiens
ctacggcccgggccgtcggcattgtcgaaggctccctcccctcccctccctggcatgagaatgaatccgtcgaacctaggacgaggaggatgcagggatgctacaccacaccattgcactctagcctgggcagcaagagcaaaactccgtctccaaaataaatacatacatacatagatgcatacatacatacagggagtaaaaaaggatactactgacacctgagcagacagattgatccaagaagcgaaagataaattccagaagatgacctgaacacagagacacacacaaacacacacacacacacacagacagacacaaaggcgtgaaagactccatgaccctaaaggaata

SEQ ID NO: 665976 - DNA, 435 bp, Homo sapiens
ctgcaacagtgtgatgtcacagcatgttacactcttgcgactggttgggtgtgagcacctgcagtcgtgtgatgtcagaggatgttacacgtcgtgctgactggttggggtgagtacctgcagtagtgtgatgtcagaggatgttacactcttgctgactggttgggacatgagcacctgcagtagtgtgatgtcagaggatgttacgctcttgctggctggttggggtgtgagcacctgcagtggtgtgatgtcagaggatgttactctcctgctgacgggttgggatgtgagcacctgcagtagtgtgatgtcagaggatgttacgctcttgctgactggttggggtgtgagcacctgcagtagtgtgatgtcagaggatgttactctcttgctggctggttggggtgtgagcacctgcagtggtgtgatgtc

SEQ ID NO: 665977 - DNA, 139 bp, Homo sapiens
accccctccttgccccaggcttgagtgaatcacagccctattcaggcaggagctgatctactggggtattagcgatccacttaaaggatgaggcagacttggtgaaaagattggtctgagcagtgcttccagagccaaa

SEQ ID NO: 665978 - DNA, 287 bp, Homo sapiens
  misc_feature (95)..(95): n is a, c, g, or t
gggccatcagggctcactgtaacctccgactccctgggttcaagtgaccctcccacctcagcctctcaagtagctgggactacaggtgcaccacnacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgtttta

SEQ ID NO: 665979 - DNA, 85 bp, Homo sapiens
gctggtcagcggctgcatctcgagtgcgcggtgggcactggaacggtcgatcggtccatcatggtgcggcgggcgagcgggcagg

SEQ ID NO: 665980 - DNA, 187 bp, Homo sapiens
tatacgttatatagaacagacagcatggatggaaatggtagctttaaggttgtaaatagatttctaaaacaaagaaactaaaattacagtgttctggaagtctgtaagttgatgttttgaaaattaagaatctgtttttccaaggaagtcttttcgtgtaacataagccgttttggcctgactttct

SEQ ID NO: 665981 - DNA, 1197 bp, Homo sapiens
gatggccacacgcgttgcggtaccagtaagtgctccgtccgggcacgccgaatcctagtcccggtggggggcctgcagcctcatgttcctagcgaccgaagcgcgcatcacgcgggtgcttggctccggttccgtgctgcggttccagcctcgatcctcagaccgcgtgcgggaggggcggggcgtgcaagcttgcgggtcctggccggagcctggactctgctgcaggctccagcgcagaccccatgatgctcgatctgcctggtcctgctctgtcctggggccttctgcggcggccggcggtggatcagggctgtgagcccagatcagttttatggtcctccattgttggacatgtctacgagaagaacgctaatgagggttgtctgcccgaggttatcgggtagccctgatagtggaatctgtcgaccataacactcagctggcaggtcacccgaaatggggcctttgttcaggtgcctgtgaacaagatgccgatccactacatgatgtaagctgtgacttgattcgacgagtgtgaactttgcctaagcaattattgtattggaactgcactacggaatacagggttctcatcgcagacctgagcctgcatcgtgggcatggataccgcctagggagccatggaaactttcaccgaggaatccatcctcctttgttggcgttaggattcaatggaaggttagcttagctggcccagaggaaggactcgcacaaattcctcccaataccaagggcttcgactttgttgggcaccgccaacacggtacttccgcaggacaaatcgcggcaccgacagatttgaagaaccattcaaacaagttcgggtcaccgattcaggccccgcgttaataaattgggcggagttggcacaattgaaagaaggggagacccccaataggggagcacgtttgaatccgctcacagacggcacttcgttagacaccctgtgaaaactataccagccgtaacattacgcaagcacttggaatagtcgcgattccgggcagttttggacacctggattccatgacacccaacccttggctttatataccccacagaagaatgaagttgaagtagggactctcacatgtcgagcttgcagatgacaaggtctcggacaggggagacgatccacgtttcggacattccaggcatcgccctggaggtcgc

SEQ ID NO: 665982 - DNA, 682 bp, Homo sapiens
ggaatgcggtcgcccccttgggagaagtacatatctgggagtaagcaggcggttccgtgctcgcgctcccgctcctccgcccgaccgcgcgctcgccccgccgctcctgtctgcagcgcccagggcccctcgccgtctgccaccatggactgcctatcaaggaagaagatgcagatgctgaatgctcgacaaggagaacgccttggatcggagctgagcaggcggaggccgcactaagaaggcggcggcaagacaggagcaagcagctggaagatgagctggtgtcactgcaaaagaaactcaagggcaccgaagtatgaactggacaatatactctgaggctctcaaagatgccctaggagaagctggaagctgcgcagtagtaagaataggccaccgatgctgaagccgagcgtagcttctctgaacagacgcatccagctggctctggaggaagacgttggatctgtgcccaggagcgtctggccaacgagcctttgcagaagctggaggagagctgagaaggcagtcagatgagagtgagagaggcgtgaatagtcattgagagtctgagcccaatgaagatgaagaaaaaatggaagattcaggagagtccaatctgaaaagtaggcagagtgagattgctgaattatgccgagcggaaatatgaagaggtgggccg

SEQ ID NO: 665983 - DNA, 952 bp, Homo sapiens
cggcgggcattgtctaccggccgcggcaaaggcgagcttggggacccagcgtgcgcggggcccgacgtggctcgaggccgggatgacctgtggctgcagccatgtgacgaacagatgggtagagccctgacggaatgcatcagtcaaacacacgtggctgtgcatgaatgagaacaattcatgagctttgatctactctcctgaatgcagatgctgctgaacgtggatggcgaactcggcgacaggttgcatgaggacctcgaagccagagttccagtccctcttctcccgtcctggaggagctgaatacgaaggctaggtgcttactgcacacgtacttaaaatcagtgcacctgtgcctagccgcacggctacgagctgcaggaaccagcatggctgcgctgctagctgcagggccctggagagctccgagggagcttctggagacaggcaagcagactctgcaggccatggtacagtcgtaggtactttcctcaggcatgccgatcgaaatcagaagatggagtgaccatgggcccatgccttccggctatcattgaaagcgagggtcagtgacaaatcatgtagtcacctcgatggtggacgttcgcgcaagagcggcagatgcgtacaggcattcaagttcctgcctgtgcccagagcacccgtgatcgatgctggtctgggttccctggtggccggataactgtgtgacccgtggctgtggggcatgcccgtactgagggacagcaaggattgacctagaaacgtgactggaagtagcgcgcggaaccagaccttgcgacgtggcccggcccccgtcctccaaggaaggaacctagacccgtggatgggtgcaatcgaagggacatcccggagatcaccagaatgttacaccccatgcacaggagtcgtcaaggtatggagacttgaagattacagtgaacttccg

SEQ ID NO: 665984 - DNA, 317 bp, Homo sapiens
  misc_feature (29)..(29): n is a, c, g, or t
  misc_feature (38)..(38): n is a, c, g, or t
  misc_feature (166)..(166): n is a, c, g, or t
  misc_feature (271)..(271): n is a, c, g, or t
cctggtgttatcatgcaggctgaacctgnccctgggtnactccctgctctctgccagcccctttctcaccccttggttccccatggcccctggtctctcccctctgctagaatctcgctgagggattggtggggagggggtggtcacgcactgggtggagatctgntgccccctggatggccggacaggaagggccagggcggacaaggtctttgagaactcggtggcatcccgctcctgatggcctgggtcccaccgcccctcccccagncttcctgacagcagaggagattgatgtggcttgcgctgaaacggga

SEQ ID NO: 665985 - DNA, 303 bp, Homo sapiens
agctctctctgtggggccacgccttcggtgggctcacagcagtttttccactcaactcagacacccacactcacagatacacacagacacatgcacagatacacacgcacaccctcactgacacagacataacacagagacacacacacagtcacatacacacgatccctggaacccttcctaaacttcagccacagacggacatgcccctcagaccccctttctccggtgctccccatctaccctgtgctcggggggtggggacccctcatcagctgcaggacacccccacagagagagcgt

SEQ ID NO: 665986 - DNA, 175 bp, Homo sapiens
gtcggtaccgtgttagtagctggaactgaattgttttgatgactctgagatcaatgtgagtcagtctgaatgctgctggtgctgatcgagttagatagagcccatgacatatgccatgcttttttgatagaagcctttggtgctcctgaaaccccagtgtttgtctgccattgtg

SEQ ID NO: 665987 - DNA, 163 bp, Homo sapiens
ctgtgcacgctggcatccttaacccactgagcaaggccaggatcaaacccgcatcttcatggatgctagtcgggcgccttaacaactgagccacaaggggaactcctatttcctctttttatgtgggtgtaactcataccctgtgatgatcttaatgcttccc

SEQ ID NO: 665988 - DNA, 494 bp, Homo sapiens
ggcactcagtcccactcgaacccgggtgaataaacagcctgtgttgctcacactatagcctgatcaaggtggtctctctacaatgagatgctcgcataacattctggtgccgaaaagcccggaggactaggcgtgaacgtcctccggataggatgctctccatcgtatcgcatccacggatagccatcgtattcgtccacattgggaagagacttccttgcgtccactcagggacctcagatacagctcacgctagaaaacgtcccgggctctccgggcctgaatggtaggttatgctactaaacaaacagggactagcgcaatggttgaagtggtccatcgtgaaggcagtggcgggggttcgatgggtgcacagcccattcgctgacccacttggtggagttccacacaggtacacgatctcacgaaaggtctcctggaagccaggaaagagtctgggggacgatctggaagaagcacgaatgaagtagaac

SEQ ID NO: 665989 - DNA, 781 bp, Homo sapiens
agcgggacggcgtcgatccgcccgctccgctagcggcgttcgccccatatccggtccctctggcccggcctaggacccggctctggcttgttcgggctcatggcggcgcgaggtcgcaggtcccgatgcgaaatcatatttatgtagaatacttgcgttgacatctgcctgatagactctccaagaattacagaagcactccccacatactaatgcttttgaagacagccggtaggttcccggcggcgagagggcggaaaacacgcgagctgctttccctgatcttgcgagctctggctcggaatgcctaatggatgtcacgtaggacatcgaatatgccaggggtcatgactgcacatgacaagatggagtattgacccataatattgtgaaggaagagcgagagaatgaacgaagaaagacgatcctggtggactataaaggactattaacatagggatgtagtccatgcgatgtgagagcagcagtgggtgctgattgcctttgatcccgaggtagtaccagtaacatttgcttgatctacaaggaatctggagggtggccttcaatgaagcacagtgaccagtcttggcttctgctgcctagaaggtatctcattacaggttgcataggacttgatattaagcttaacttgacctctggaaaggctgttcagagactattggactcagataacccagctccaattctgctcacgtgcttgatggggctcgagattcgtcttatccatgctaacatgttccgatcccatccccgtaca

SEQ ID NO: 665990 - DNA, 352 bp, Homo sapiens
gaacccggaaattcggccattatggccgggaagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccgggaaaaacacctatgggcccggcggaaagggcagggaacattgggcataaggtaagcgggaaaggggtaacaggccaaattgccccgaaattgcccaa

SEQ ID NO: 665991 - DNA, 169 bp, Homo sapiens
cgcgggcgatctagaggatcccaacgtcagcacctcctgggataaagtcttaaacctcccactttgtctgtacatactggcctctgtgattacatagatcagccattaaaataaacaagccttatctgccttatttgccgtgattacatagatcagcccatttaagtta

SEQ ID NO: 665992 - DNA, 351 bp, Homo sapiens
  misc_feature (26)..(26): n is a, c, g, or t
  misc_feature (37)..(37): n is a, c, g, or t
  misc_feature (129)..(129): n is a, c, g, or t
  misc_feature (167)..(167): n is a, c, g, or t
  misc_feature (182)..(182): n is a, c, g, or t
  misc_feature (247)..(247): n is a, c, g, or t
ttctcatactattaatcttctgtctngaaaaattgtnattctgcattctaagtttagattagcttccaacattttatctttgcattttcaatcttgtgaactattctcaggaattctttaatacaaagngtatcagcaacacttcctgtggacctcttcaccctttngtcacagccactttnatctcttaacattaatcaattcataaaatgatgaaaccagaatttactggctgaataaggttttnatttagtctctttgtaattatcattttctttcaacaagacaaccaacttcaacacttcacccgaatgctagccagactgattggggaaaaaatttgaagtttat

SEQ ID NO: 665993 - DNA, 341 bp, Homo sapiens
atatatggttgtatagtttattaggcggaatgaattggggtggtatttcaattgcatgaatcaacaggtttaatgttcgtcaatgatatgcgtatgcctttgcggatgtctttagttcgtaaagaagatatggggaaatacaaaatatctaccgatgaagttcctggatttatgggacacggtacgcccacaatttgcaggcccgtacgctggagtaacacattgatattcatgcaatcagcattaggggtaccttgtaatcgaccaactttcggtacgatgtctgcgattgatttaaaaaccacaaaagttggtatggcaagtaccaatgggaacagctg

SEQ ID NO: 665994 - DNA, 181 bp, Homo sapiens
atgcggatgatatctctataccaggcagatacccgagagagatatataaggtggagacgagctagtacacttacttaagaaataccaaatactagactatactagatccaaagcaaagtgtatatcttgatttgacactggatatggcactgggaaagaagaaaaacgtggagccatgtac

SEQ ID NO: 665995 - DNA, 100 bp, Homo sapiens
ccccttttatctatctctatagcttgtagttcattgaatgaatcatagaggaaattagaaatgcagctatttacagtttgagaaaatctacgaacacact

SEQ ID NO: 665996 - DNA, 900 bp, Homo sapiens
agaggctcctgtgtttgcccccgctctttgtccgccgcgctgttgcacccgaggattggttgcactgtcccccgccattcgagaggacgttgtgagcgcgccggtacctcctgcgagtagtagttgctccccttggcggcagccttttacaccattacgatgttgggacatcgaacgctcctgaacatccacagggcacatttgccgcgaggcgtatgcctggacattttaagttacctcacatgcttggtatccgacacggcagtgtgttctgtgctgaaacaggtgtgcgcgcccggttgtcatagagaatttctatctcggcccaactctcaggggccaccacgtcgtcagaccaacagacgagaggtcagcttttacaactgtgaggtaatactctagcatcctttctctccaacagacctgcctcatccacgggacaaggtcttttctgttccccgacgagcccccccacaaaattcgggggggacaattcttctcgtgaggggataccctcataaatagggtggcaaaacaacacgcccaaagttcttctgtcactgttgttttggttcggccttcatgccaccgtcgactagtttcctcacctcactgtattggtgaatgccagtgtgtgtcgtagtcggataaaaaacagactctccgggcgggccgtgcgaaaccacggcgcggctgtttgcggcatctctacatctccccccgcgcccccttattgccgtcgagactccgtcgcgcacgctactcctttcgcctcgtcttgaagaccccccgccagagcaacatctagcgaatgatttctcccgccacttgtggttctctatgctgcaagatgaagaagtacaagtgctcacccttgaggctcaccccccaacatgacga

SEQ ID NO: 665997 - DNA, 279 bp, Homo sapiens
gagcagcatttcatatccgcagtcgtccagcccagggcgctgcctctccaacgggcactgggtagcacaggaaaagcgcttctactaggggctctgtctcagacttggtccctgtcttcggtcgctctgtaaaacagggatcctggttaggtggctctgtgtgataatgatgagattaggaatgcaaagcacctagtatggtgcctggcacatggcaggctctcatcagaggtcgattcccttcacttggtacctatttccccacagtaacaaggctgc

SEQ ID NO: 665998 - DNA, 108 bp, Homo sapiens
  misc_feature (8)..(8): n is a, c, g, or t
  misc_feature (63)..(63): n is a, c, g, or t
  misc_feature (85)..(85): n is a, c, g, or t
  misc_feature (87)..(87): n is a, c, g, or t
  misc_feature (89)..(89): n is a, c, g, or t
  misc_feature (91)..(91): n is a, c, g, or t
tcggcccncgttatcatcggcacggggttggtgtaaaataggcgtagtagaagtagaggttanggagggtgatggtgccgatgantngngnggtgccgatgaatagcg

SEQ ID NO: 665999 - DNA, 801 bp, Homo sapiens
  misc_feature (19)..(20): n is a, c, g, or t
  misc_feature (34)..(34): n is a, c, g, or t
  misc_feature (41)..(41): n is a, c, g, or t
  misc_feature (64)..(64): n is a, c, g, or t
  misc_feature (68)..(68): n is a, c, g, or t
  misc_feature (72)..(72): n is a, c, g, or t
  misc_feature (76)..(76): n is a, c, g, or t
  misc_feature (80)..(80): n is a, c, g, or t
  misc_feature (82)..(83): n is a, c, g, or t
  misc_feature (85)..(85): n is a, c, g, or t
  misc_feature (88)..(88): n is a, c, g, or t
  misc_feature (93)..(94): n is a, c, g, or t
  misc_feature (104)..(104): n is a, c, g, or t
  misc_feature (107)..(107): n is a, c, g, or t
  misc_feature (111)..(111): n is a, c, g, or t
  misc_feature (114)..(114): n is a, c, g, or t
  misc_feature (119)..(120): n is a, c, g, or t
  misc_feature (127)..(127): n is a, c, g, or t
  misc_feature (149)..(149): n is a, c, g, or t
  misc_feature (155)..(155): n is a, c, g, or t
  misc_feature (159)..(159): n is a, c, g, or t
  misc_feature (165)..(165): n is a, c, g, or t
  misc_feature (183)..(183): n is a, c, g, or t
  misc_feature (192)..(192): n is a, c, g, or t
  misc_feature (209)..(210): n is a, c, g, or t
  misc_feature (215)..(215): n is a, c, g, or t
  misc_feature (224)..(224): n is a, c, g, or t
  misc_feature (227)..(227): n is a, c, g, or t
  misc_feature (235)..(237): n is a, c, g, or t
  misc_feature (248)..(248): n is a, c, g, or t
  misc_feature (251)..(251): n is a, c, g, or t
  misc_feature (253)..(254): n is a, c, g, or t
  misc_feature (261)..(261): n is a, c, g, or t
  misc_feature (269)..(269): n is a, c, g, or t
  misc_feature (281)..(281): n is a, c, g, or t
  misc_feature (285)..(285): n is a, c, g, or t
  misc_feature (290)..(290): n is a, c, g, or t
  misc_feature (293)..(293): n is a, c, g, or t
  misc_feature (298)..(299): n is a, c, g, or t
  misc_feature (304)..(304): n is a, c, g, or t
  misc_feature (311)..(311): n is a, c, g, or t
  misc_feature (317)..(317): n is a, c, g, or t
  misc_feature (320)..(320): n is a, c, g, or t
  misc_feature (326)..(326): n is a, c, g, or t
  misc_feature (329)..(330): n is a, c, g, or t
  misc_feature (337)..(338): n is a, c, g, or t
  misc_feature (341)..(341): n is a, c, g, or t
  misc_feature (351)..(352): n is a, c, g, or t
  misc_feature (395)..(395): n is a, c, g, or t
  misc_feature (398)..(398): n is a, c, g, or t
  misc_feature (400)..(401): n is a, c, g, or t
  misc_feature (415)..(415): n is a, c, g, or t
  misc_feature (428)..(428): n is a, c, g, or t
  misc_feature (505)..(505): n is a, c, g, or t
  misc_feature (516)..(516): n is a, c, g, or t
  misc_feature (536)..(536): n is a, c, g, or t
  misc_feature (551)..(551): n is a, c, g, or t
  misc_feature (556)..(556): n is a, c, g, or t
  misc_feature (565)..(565): n is a, c, g, or t
  misc_feature (591)..(591): n is a, c, g, or t
  misc_feature (613)..(613): n is a, c, g, or t
  misc_feature (626)..(626): n is a, c, g, or t
  misc_feature (711)..(711): n is a, c, g, or t
  misc_feature (720)..(720): n is a, c, g, or t
  misc_feature (727)..(727): n is a, c, g, or t
  misc_feature (763)..(763): n is a, c, g, or t
aagcgcagggccgccaacnnccagcggcagcggngaagggnaggggaagggaaaaggaaaaganggangggnaagnagangnngncgngaggnncaggaagggnagnggcnggnagcgnngggaggngggccaggggggcgagaggggncggggngggnggggangggacagggagaaagagngcgagcggnggcggaccagggagaanngcganggcaagagnagnggggggannnccgcgccgggnggngnngccaggngggagggnaggaagaggggnaagnggggngangggannaagangcggggnaggggnggnagacgnganngcggggnngangggggggggnnagaaaagaggagaagtgaagcgtgggggtgagagtagtgaggnaanannaaaaggtgaagtgngtagggaagagtngtgtgtgtagtgaaagggagtgaggtagtgtgtcagtggggaaaacagtgggtggtggagtggtggaaaggtccagnggcgcccccantgaaagccccgcagagtggngccagcctcccttantccgnccctgggantttgaaaccgccaaaagagcggtgcntgaacccctgagcgccttcggnaagtggccggaancccagctcgtggttacccctcacctcaccctctgtcccacgtctgccgggacacccccaggtttgcgtttcgtacaagtgaagancagggaggntgccccngtccacgtgggcccccgggtgaagtgcgagtgaacntccagtgtccaattggtaagaaccagcgtttggtgggc

SEQ ID NO: 666000 - DNA, 363 bp, Homo sapiens
  misc_feature (50)..(50): n is a, c, g, or t
cgaagatggaggaggtgcaggtactggagcttgatggtcgaggccatctnctgggccggctgacggccatcgaggctaaacaggtactgctggaccggaaggcggaggtcgtacactgtgaaggcatcaacattattggctatttctacagaaacacgatgcagtacctggcttgactccgcaagcggatgaacaccaaccctagccgaggctcctaccacttacgggacaccagccgcatattatgacggaccgtacgaggtatgctgatgtacccaccgccctacgacgagagaaagcgaatggaggtttctgctggcctcagagcgcgcgaatgaagcctacggactgcctatctgggcg

SEQ ID NO: 666001 - DNA, 826 bp, Homo sapiens
gattccaccagctgtcaatgcataccatgaagcagctagtcttctaggtaagaagtatggacatgacagttacatgagtgtggtaagaaggcttcggtttgctctatggagaaatcgacttctggagttggcaaggaatggagaatggtgtgtagggaaacgccttggaaggttgtgcatgtggtaagaggaatgaagtgcagaaagacaacgaaaaagagtgatagtctctagctagcatatgtaagtgcatagacactaccatggaaactggaaggcacggatactagggcatctgtgataaagcatcatagagcttgggtgaaatatgcgctccccgtatctgagctccattggatgagagcgagtctcttcaagtcaaatttgaggatcaggagatcggaagcccagatcttgcctgggctatgctgcattgagcattgcgatctatatggtagaacacggcgagagaataccatgacgaaggcgacagtcctactactagcttggacacctagggagctatccttaagaactcgtgccgaatgttcaagtgttagagctctgaaacactatgtgactaatggcttgtgtgaggactctccagtccctgccttgaaactgcaggaacgagtaccgtggcacccaccactggacgtactacctttggcagccgaccccactaccagactgctgctatgaccgttgatgggccacaagctctcagtatgatgacgcagtggcaacagttgcagcgacgtctatagaaactcctcgagaaccgacctggctgtctacacgacccggccccactcgccgctgcgga

SEQ ID NO: 666002 - DNA, 130 bp, Homo sapiens
gtttcaccatgttggccaggctggtcttaaacttctgaccttatgttatgcggcttcctttgggccttccaaaggtgcttggattacaaggattagccaattttgccttgccaagaacttttcaagtttt

SEQ ID NO: 666003 - DNA, 377 bp, Homo sapiens
  misc_feature (55)..(55): n is a, c, g, or t
  misc_feature (311)..(311): n is a, c, g, or t
ggtcacgggaagcgcttatgtgaatcccacttctgatattgtaagattctctccnagggcctgaaagcttaaggggttgagcaactcctcccttctcaggccgcagccccaggggcgcaaggccgcttgcatcagcagcgtgcgtgagcagatgcgccagcaagatagcaaaagcaggaagagagccagccggaagacaagtacctctgaagatggagaaagaggccatctgggtacaacgttgcagttacgtcagaccaggacacttcctgtttacaggagactataaaacctttgccccatcctcactnggggtgacgccgttttagcctcagcccgccagcacccaggctctcattaaaacagcatgttgctcc

SEQ ID NO: 666004 - DNA, 153 bp, Homo sapiens
cggtccgtgatgtatcgccaacacatagaggcatgctttaatcgtatgtcccaagttctctgcaaaaaaaaaaccaacaaaaacgaaaaaatctcaaaatagctcataaggttttacagaaagtttacaaattggtggtggggcgataaatca

SEQ ID NO: 666005 - DNA, 440 bp, Homo sapiens
  misc_feature (36)..(36): n is a, c, g, or t
  misc_feature (58)..(58): n is a, c, g, or t
  misc_feature (152)..(152): n is a, c, g, or t
  misc_feature (191)..(191): n is a, c, g, or t
gacatgggtaagataactaattatgtctttttagtntgatgaaatgtgggccagagtnttggaagaagcatagccctattcagtgtccactaggtggattgcagaaggcatgagtttgtccttttttccccttaccttaaataacacttcantagctaactttttccaaaatatccatttaggcatctctnatttcttaaagccaaatatttcgtccccagttcttaactctgagtatgctaaatcaggctggtgggaagaaactttatatttcgttttgatatggtgtagtggtttgtttattctcttgtaaattcctttttcgggacataacttcggatgtgtcccagagtactgtagaactggtttttaaaatttcacattttttgttggtttaggtgtttcttttgtccctaggatttggatctataccaagttct

SEQ ID NO: 666006 - DNA, 918 bp, Homo sapiens
  misc_feature (1)..(1): n is a, c, g, or t
nggcttggtactgtgttgcttaggcttgcgtggcgtggttgtcgtgtgtgtgtttgtgtgtggtgtttgtttgtcttagtgtggcgctgggctgcgaggtccattggacgctcccttcgggtactgccgagaggtgtaaccaccccaatgggtttttcccaccgtgccggtgccgtttttggggggagctgcgcaaactttgtgaacctatacaggtttcccggtgcccggcccgcacaattcccggggtttttgcctctttcgccggcgataattacgttctggtaatggcgaaccaccctttgggagggggtgggaagaaacacaattttgggcgacccacaccaccaccggtgaaaaacttgtggggacccccctaaagggcggaaaatttgggggaccaaactattcgccccctaccgggggggggggccccaatttggcgaacacacgacaccacaaagggggtattggcgttgtcccaccacccgcccccatggttttgcggccgcggcccggcaagagttttatatgagggcccagcaaatgcttttcgctgacgagtggaggcgctcccctagtcactttctcggactctcctctcgtccccaaaattgtgtaactcaccccccatccccatggctgcccccgagcactctaacctgcatcccccacatagaaccacctgcttttatgccaccaaagctcctcggtggttttgggcccaaaaactcgacgcgccctccattttgttggcctacatgtgcttacaaccgttctatttattgttttctccttttcattggaaactaaaaaccaatcccccaccaaagggtttttaaacataaatcttttttttcgcccccccgggcggggtggctaaacacccccttggtccttggcccggggaaaaaaaca

SEQ ID NO: 666007 - DNA, 172 bp, Homo sapiens
  misc_feature (116)..(116): n is a, c, g, or t
  misc_feature (120)..(120): n is a, c, g, or t
  misc_feature (151)..(151): n is a, c, g, or t
tctgacatgaacttggtcaagttctgagccagaaccaccccgagccgcttgagctcaatcttcacgctgtactcagccttcccagatctggagccatacaggcccaaccccgtccnatanacctttttgcccactgcaaactggatgctgncgtattgcccgcggtaccgcc

SEQ ID NO: 666008 - DNA, 159 bp, Homo sapiens
caatcccccggccgcacagcttctccggccccactgcttctcatacttccacgtggcctggggtctctgacagcacccatggatctgatacgctggctggtcctgctagtcctgcgtaatgcgcattcttgtgattcttgatgtccacctgtagaccat

SEQ ID NO: 666009 - DNA, 493 bp, Homo sapiens
tggaggtgactctagaggtatccacacgtaacgcgttcacactacgccttcaggataaggaaggattcccccgagcaggagagggtcatctttgcaggcacgcagctggtagatgggcgactctttctgactacaacatccagaaggagtcgagcctgcagctggtcctgcgtctgagaggtggtatgccgatcttcgtgaagaccctgaccggcaagagcatcacgcctgtgaatgtgtgagcccaggtgacaccgatcgaaaatgttggagggccaaggatcccaggatacatgaaggcatcccttcccgaccagcaagaagctcaattcttttgcaggcaagccaggcctgggaaggatggccagcacctcttttcttgacttacatacattccagcaaggaagtctgaccccttggcaaccttggttcctttgcggtcttgagaaggtaggttattgccagattctttcggtcgaaagaccccttgaac

SEQ ID NO: 666010 - DNA, 3121 bp, Homo sapiens
ggcacgagtggctgcttgcggctagtggatggtaattgcctgcctcgcgctagcagcaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaata

SEQ ID NO: 666011 - DNA, 119 bp, Homo sapiens
catctcaatgaccccatcctgaacaagaacggtgctcgcagatggactgctctctcttctgcattctcttccctgggggacccaggaactggggctcctctacgagtcgagctgcgagg

SEQ ID NO: 666012 - DNA, 198 bp, Homo sapiens
ctgtagctgagagcgagctgtccaggccgagatgagaataagaggacacaatgaatcatccaaagagaaatgaggcaggcgggacatgtacaagacgtgcggcagatccggcaggcaacaccaagcagcgcatcgacgagttcgaggccctgtaacagccagtgcaggaccatgggcagaggggcgctcatagttggg

SEQ ID NO: 666013 - DNA, 219 bp, Homo sapiens
tgatacgcggctcgagagatctccagcgtgatctcccaagtagctgggactacaggctcacaccaccaagcttggctaaattttgtaggttttggagagacgggctcttgccacgttgcctgggctggtctcaaactcctgggctcagatgatccacctgccttcgcctcccaaagcactgggacatgagccaccacgcccagccgcgtagtcagatcg

SEQ ID NO: 666014 - DNA, 492 bp, Homo sapiens
gattctggctctctgggtagctgggattagagatgctgccaccacgcttggcaattttccttttttttttctttattttattgaaacagtctcatcctgttgcccaggctagggtgcagtgacgcaatcttggctcactgcaacctctgcctcccaggttctaggattcttccatctcaagccttctgagtagctaggaccacaggtttgtgccacatgcccagctaattttagtcttttactttgggacggagtatcactcttgtcgcaagactggaacgcaatggtgcaatcttggctcacttgaacctcaaactccctggttcgagcgattctcctgcctcagcctcccaagcagctggaataccaggcatgcgccaccttgcccagctactaaaggtataaaaagaaaagacgtggactcaccatgctggccaggatggtctcgatatcccgaactcatgatcagccctctttggcctcccagagagc

SEQ ID NO: 666015 - DNA, 427 bp, Homo sapiens
ggtaccccagctggctggcgggtttccttggcctgctgggcacccgaatcatcctgtaaagcggaggtcatcgccatgtgcgagctgtacgtcaaggccgacccgattctctacgagtcccgctcgcgctccctgcgcatctgcggcgtggtgaccaccgtgcgcctggaaaaccagttctgggacatcctcagcgagatcgccgaggcggatggcatgaccaccaatcaactgatcgccaagctgtatgaagaggtgatggactaccgcggtgaagtggtgaattttgcttcgtttttgcgggtgagttgcacgcggtatttgagcaagcagcgggttcacgccccagagctcagccttgtgaatacaagaaatggcgcgcagaagatctgaatgtggccactcgttcaattgggagccgggcttg

SEQ ID NO: 666016 - DNA, 721 bp, Homo sapiens
ggcaggagtcccagctgcttgcttaggaactggcagcttttcttgccggtccctcccctgcctccagaatcacagcccttctccccaagggaggctgaggaggcttctccaccagtggcagacccacccgtccctggcattcttgggctccagcccgcatcaggcccctactcgtggcgctccccagaaggagccacctcatcagtggcctcagctccaccctggactccacagactccggagatgaggttacctgacccccttcctacctacggtaaacaaaaacactcaattgggttcccaggacggtccttcattatataaaccagatacatgttcttagtcatgggtccgcaggaacaaagggaagctgggtacagaacgggcgcctatttcgtaatcccttacatgctttgaggctataatggtagaaccaaatggttgcgttatccctcacctggttgtatgttggtgtgtgaccctattatcatttaaacccccaacgagaaaagcaatattaactcatcctctgtagagacgcgttttgaaaaaagagccttcggcgcccacagatggtgcaaagggggtaaacaaggacggccatgcaacggttgttggaactggggcacctttggtggacacgtggggacctggtgttagcgtggcgggagagcttaatgaagagacagacatgaaaggggagatagaaaatgtaccagaa

SEQ ID NO: 666017 - DNA, 333 bp, Homo sapiens
tagacgttcttcacacaggtggtggatgtgagtgccacctctctgacagctatgagactctgagacacagactaggacaagagcaagtaccacagcgtcagccagctctacttacaggggcgcccacgctgcgcttctgatgtacgacatcaccaggaaggattccttcctcacggctccgcgacgtggctgaaggaccctgcgacggcggagctgcacccaggagaacgtcctggtgactgctggtgggccacaagacggacctcagaccaggaacgggaggtgcacttccagtgacgacgaccgtgtaacacagctgcagacaagtggctg

SEQ ID NO: 666018 - DNA, 170 bp, Homo sapiens
attgagatcgcttgctcctttaccagacccaggtgtcagctgaaccctcttccttctcagaagtgggaggagtgcacctactgcgacgcaggcagaggagagtgtcctctccggtctgccagcagctctggtgagtggcggaccactggctcaacagcttcactcctctc

SEQ ID NO: 666019 - DNA, 153 bp, Homo sapiens
aacgggtgatgcggttgcaagctgtcagcatcaactggcggcagacgccccgtgtctccttgcggatctcggtgcacaaggactgccaccgctaggaacggctagcaacggactaatatgcagtcaggatgccctcggaagttgccactatgc

SEQ ID NO: 666020 - DNA, 376 bp, Homo sapiens
  misc_feature (16)..(16): n is a, c, g, or t
  misc_feature (61)..(61): n is a, c, g, or t
actcattctagagtgnagtggcatgctcatagctcactgcagccttgaattcctgggctcnaaggtcttagctttccaagtctcagctttcctggctcctgcctcagctttccaagtagctgggattacaggcacataccaccatgcctggctttgtttgttttttgtgtggaccagcctggccaacatggtgaaaccccgtctctactaaaaatacaaaaattagatgggtgtggcagtgtggcctttaatccagctacccaggaggctgaggtgcgagaattgtttgagcccaggaggtggaggttgcattgagctgagactgcgccactgcactccagcctggacaacagagtgagatgctgtcttaaaaata

SEQ ID NO: 666021 - DNA, 168 bp, Homo sapiens
taatcagctcgtaccgcttctgcttctgccgcttctgcttctgcttcctgctttgctgcttcctgcttctgcccgtcaccctcgtcctaccacttctcctccttcttccttgcttcctgcttctgcttcctgcttctgctgcttcctgcttctgcccccccccacgcc

SEQ ID NO: 666022 - DNA, 275 bp, Homo sapiens
gagccagattttatctttaaaaaaaaaaaaaaaaaaaagggttaagctgaacacattatttcaaaggtaaccaaactgcaaagtaacaaaagggccacccatgttcccctaataagttatacacaggcacatccttttatcctgaacacatttgttaaacagggcgtttttgatagcccgccggcccatgtggacacactcacgggggtgctccctttgtttgaccatgccagctaagtagctaagccaatgcagcagcgcagggttaaaaaaga

SEQ ID NO: 666023 - DNA, 459 bp, Homo sapiens
cctcaggtatataagggtgatcctgcaggttaatactgtgggttttaaacccctacagcgggggttaaaccaactgagtcaaccagcttccttgaaaaaaaagtgaagaagaaatttgattgggcctttgaacagacagtggaaactgccattacatgcctgtctgctgttttatcaattgatttccaaccttccgaaatagaagttggagtagtggcagttgaaaatcctaaattcaggatttttacagaagcagagattgatgctccccttgttgctctagcagagagagacttaaccttgtcgttagtttaccaggtccgtgatgccccttacctgtgtgtttgggaacccccaacccacatcatggagggccctggattgaaaaaggagcctctcccactcctcctacccccgaaatggttaggactctatataaataaaaacaaggcttttgga

SEQ ID NO: 666024 - DNA, 482 bp, Homo sapiens
ttttcccttcccccgttctggccgcgcccccctgccccccctgaaggggtggtttcccgccctcccgagagtgggcttggccctaggccctcccgctcagcccagaaagccccagaaccccggtgctggacccgggccctccgggaggggaccctgcggctagagtgggctaggcctggctttgcccctccagatttgaacgaatgtgtgtccccttgagccctcaggagagccgccaagaggggtgggaccaggctgggaggacaagagcccagccaactgcccaagccctcctgctcccccccacccccgccctagccccttagcctttcaacctgtgctctggaaaggctacccaatactggcccaggtccggaggaccccaaatgagcccgcccccgccccttggctttgtgttaagcacatttcctcccctgagagtgtttctgttggccataaaatgccccttgactgtttgttgt

SEQ ID NO: 666025 - DNA, 215 bp, Homo sapiens
tgccaacgctgcgcttaaggagaagatccggctctagaggaacacccactacgaggaagttcgaaggctccacgagcgcttaccccgagaggaggtacatgtgaagcttgacaaggcccggccacatctcacggcacgaatccatgagaggccgacgcggcctgaacaaagaacagacaactctcgcgcggctcccgccgacttctacagcgtag

SEQ ID NO: 666026 - DNA, 930 bp, Homo sapiens
gagtcccggctggagcgactcggccgtggtggtggccgttaccgttgcctctgggaggctctggcggcggggcggcccgcggggttcgcggagcgcaggggccgcccttcgcccgtggcgcctcaagcagctcgcgccgacacaggggaggcgagacggccggctgcggaggcgggcgggagcatttgttgcccgggcccccctccttggggggctccgtgccccccgggggggacttgttggcgaatctgggacagcccccacggggggcggggggggcccggagggcataacaaggagccccgggggacaggggggaattgggaccaaaggataggcggccgcgaggggaaaccggttaccgaatttggacttggatttgaccaggaacttgcatgcgacttatgacggttattgttttgaagcggacccaatcctgggagtgggcgggaccacaaaagacgaacttgacgggacctggcttcccaaaatttccccaggtgggttgttatccaaccatttattcgtcctatatctcactgcacctccaggtaccataggccaggaaaaagggggctcctcattgattcggcacgtggtggtaccctaaccaattttcgcagtgttgcaacctggtcttggaaaggccacccttctggaacaggggcggtggtacttgattactgaagttttgcctttgaaaccagggtcccggtcttggtactcaggttggagaaacccagtattaggatccagttctttccactggggtttgtgaaattaccaatacattctctaaagtgattggggcagttctacacgtaacttccactataatgacgcacagttgtctattccaagatctcacgagatttgcaatgcggggattccacctaagttactcaagtgacgcaggtcgttccccggcat

SEQ ID NO: 666027 - DNA, 371 bp, Homo sapiens
  misc_feature (222)..(222): n is a, c, g, or t
  misc_feature (315)..(315): n is a, c, g, or t
  misc_feature (354)..(354): n is a, c, g, or t
acacaatatatccacccaatatatcccaatatttaacccaacatttccccacgcaggaagcattccagcctctggctgggcgccatcagtatcctgtcagggctggagtggggtctgagagggaagcacgtctctggagcccgcctgcaggtggctttgtgacttgacaatggcccaagtgctgccattgcagagatggggaaactgaggtaagaggaggcnaagccgagggccctgcagggacctgcatccagcatctgcgcccctgcccaggcctgcccgtagatcaaggttgctgcaaggacctcagcccanttcccatagccgccttcctgttccaccagtgaggaggtnaggctcataggggccct

SEQ ID NO: 666028 - DNA, 440 bp, Homo sapiens
tgcccctgtgtgatgtgtgcgcagtggcccagtgccctggctcctcaacccttctgcaacaatgggccaagccctgggccccagtgacacctgtagagctggcccttctacgacctctggtgcctcagacaaccccctgtgacaggcctgttggttggccagtgatgagtttttcctggagcagaccaatgaagaaatgtgagtgaagctgtgccatgcacgcctgcacaccaagcctgtcccagtgctgccctgccgtggaggtggcgcctgcctgagcttcctacaatccatcctttgaagaccaccagaccctgctctcatctggcccacgaggtggagagcagcggcagaaggagtgcggagaagctgagcggagctggccctgcccgccacggagcatgcgcaccaggagtccactccggactgtggagggtgtg

SEQ ID NO: 666029 - DNA, 413 bp, Homo sapiens
  misc_feature (236)..(236): n is a, c, g, or t
  misc_feature (248)..(248): n is a, c, g, or t
tgcccatattcttctaaatacacttccaccacacttgatacatattctcccaataatttctgctgtgcaaattacttagcttaggcgaaatattcggagcgtactgcgccgcggtaatttacaactctcccttggatgttttgcttcgccccctagggtattcttcgtgggagcgcgagccaccctcccgttttatagcctgtgggatatacatgactgtctgagcgacctctccncggagatgtggnggaacaccaccccaggagctttattgcaaatgtgcccccccagagctgtcggcaagctttcttaatatgctttggtagaccaacttatgggccacaacttcctccgggccactcgtgggcgcacaattcacccgcgatgtattcccacaggaactaatacaaaca

SEQ ID NO: 666030 - DNA, 894 bp, Homo sapiens
  misc_feature (19)..(19): n is a, c, g, or t
  misc_feature (72)..(72): n is a, c, g, or t
  misc_feature (107)..(107): n is a, c, g, or t
  misc_feature (112)..(112): n is a, c, g, or t
  misc_feature (119)..(119): n is a, c, g, or t
  misc_feature (128)..(129): n is a, c, g, or t
  misc_feature (162)..(163): n is a, c, g, or t
  misc_feature (196)..(196): n is a, c, g, or t
  misc_feature (215)..(215): n is a, c, g, or t
  misc_feature (217)..(217): n is a, c, g, or t
  misc_feature (219)..(220): n is a, c, g, or t
  misc_feature (230)..(230): n is a, c, g, or t
  misc_feature (241)..(241): n is a, c, g, or t
  misc_feature (250)..(250): n is a, c, g, or t
  misc_feature (256)..(256): n is a, c, g, or t
  misc_feature (265)..(265): n is a, c, g, or t
  misc_feature (270)..(270): n is a, c, g, or t
  misc_feature (276)..(276): n is a, c, g, or t
  misc_feature (278)..(278): n is a, c, g, or t
  misc_feature (286)..(287): n is a, c, g, or t
  misc_feature (289)..(289): n is a, c, g, or t
  misc_feature (301)..(302): n is a, c, g, or t
  misc_feature (311)..(311): n is a, c, g, or t
  misc_feature (315)..(315): n is a, c, g, or t
  misc_feature (333)..(333): n is a, c, g, or t
  misc_feature (337)..(337): n is a, c, g, or t
  misc_feature (341)..(341): n is a, c, g, or t
  misc_feature (359)..(359): n is a, c, g, or t
  misc_feature (364)..(364): n is a, c, g, or t
  misc_feature (368)..(368): n is a, c, g, or t
  misc_feature (370)..(370): n is a, c, g, or t
  misc_feature (373)..(373): n is a, c, g, or t
  misc_feature (376)..(376): n is a, c, g, or t
  misc_feature (382)..(382): n is a, c, g, or t
  misc_feature (385)..(385): n is a, c, g, or t
  misc_feature (398)..(398): n is a, c, g, or t
  misc_feature (400)..(400): n is a, c, g, or t
  misc_feature (418)..(418): n is a, c, g, or t
  misc_feature (437)..(437): n is a, c, g, or t
  misc_feature (443)..(443): n is a, c, g, or t
  misc_feature (494)..(494): n is a, c, g, or t
  misc_feature (520)..(520): n is a, c, g, or t
  misc_feature (563)..(563): n is a, c, g, or t
  misc_feature (615)..(615): n is a, c, g, or t
  misc_feature (618)..(618): n is a, c, g, or t
  misc_feature (620)..(620): n is a, c, g, or t
  misc_feature (626)..(626): n is a, c, g, or t
  misc_feature (683)..(683): n is a, c, g, or t
  misc_feature (693)..(693): n is a, c, g, or t
  misc_feature (735)..(735): n is a, c, g, or t
  misc_feature (756)..(756): n is a, c, g, or t
  misc_feature (770)..(770): n is a, c, g, or t
  misc_feature (787)..(787): n is a, c, g, or t
  misc_feature (850)..(850): n is a, c, g, or t
gaaacaaacatgtaaaaanccagggattctagaaataaaaactcaattaattcaaattaaagatcatccagnaccctggttcacaaacactaggtgaagaatgcatntgagncaccaantgaagagannggcggggggcgggggttgttctctgtggggccnncggtggttgggttggtgtgggggtgggtctccnttggtttccctggggtgtngntnncctccctttntgtggtttctnctctttctntttgtntttgttgtntttcntggttntntttttttnntnccctccccttcnntggcctgtncttntttggcctgttccttttngttntttnctctcttgctctggtttnttgcnttcntnttnttntccttnttnttttttttttttntnttttgttgctggtttggnttctgtttttgctgctgtntggttnggggctttgggggtggggttgtgttgggttgttgtgtggggttgtgctgtncttggtcccctctcttcttgggttcncttactgttcttcctgctcctcttttgcgtcctctcggttctntgttagtgctctgttggcattagctgctatcctggtgtcctgtctgcttatnagngntcgggntgggctcactggccagcacttggtggggctggctggtaagagacggcagcggtggcngcttcttccnatgggtcaggctgctgctcagcacagccaagcgggtgctgtnctgcctggcacggtccatgtnctcatgctgctccntgccctgtgagtctgcngcagacacatcaatgatgttgctggctgtcttggccaggatgggagagagcggggcctgctcntcagtgcgagcggcaggcaggctgtggtagttgggctcggctcc

SEQ ID NO: 666031 - DNA, 425 bp, Homo sapiens
  misc_feature (71)..(71): n is a, c, g, or t
tcagaccaggccgaggagctagagcctgcctcggcgcttctggaccacccagatgtcgccactcatttgcngcatacaccagaaccctctcccctacctccaggatgggaagagaggcaggatgtccttggaaggacctactacgtaaaccatgaatctagaagaacacagtggaaaaggccaagccctgacgatgacctcacggatgaagacaatgatgatatgcagctgcaagcgcagcgagcattcaccaccaggcggcagatatcggaggatgtggatggccctgacaaccgggagtcccctgagaattggggaatcgtacgagaagatgaaaacaccgagtatagtggtcaggctgtccagtcacctccatcgggtcacattgatgtgcagactcaccctgcagaagagggggtcgacgc

SEQ ID NO: 666032 - DNA, 573 bp, Homo sapiens
  misc_feature (187)..(187): n is a, c, g, or t
  misc_feature (280)..(280): n is a, c, g, or t
gcaacgtcgtactttgtaggtggtaagaattcacatccactcggtggaagtgaatctataataaaagtaaggaacatgctcccaagggggggcttggctgaccacatcttctcccatgggccgatatcctgcagactctccttcccttccttgagggtggttctcttagtctttcagacggtggggntcgtttcatcccctgatgagcccagggcagtggtgcaatcatggctcaccgttgcctggaacccctgggctcaacggatcctcccacctcagnctcccgaatagctgggactgaaacgcctaacctttttactctaacttgttactttgaattttgtcctgcttgtctctttaatcacctagccttgcttactacatgttaaacattacacagaacttctcctctagcttgggaagggctggacaaactccaattgacctttctaatttacaagaccacttaaaaggcttcctcacacttgaccccctcccgtaacggagttgggcctgggtaaacagatcctcagcatttcaaaagagcccaattaactgataaggtacttaacc

SEQ ID NO: 666033 - DNA, 132 bp, Homo sapiens
ttatcgaaaccctgtaaccttccccttattaaacctcatcaaaccctgtcatcaaaccctccaatggatccttgttaaaggatttaaagtttactcattccaattacaggtccttgaaagagtcctgtattg

SEQ ID NO: 666034 - DNA, 287 bp, Homo sapiens
ataactaactccgggcctcagggtactcctgtcttgactttcatcatttttactgggatgtttatttgtggatctggttgagtttatccttctggagtttctggtgttaggtttatgttactcaatacattatgttggtacactttttttttctttttttgagatggagtcttgctctgttgcccaggctggagtatagtggcatgatcttggctcactgcaacctgtacctctcaggttcaagtgattctcctgcctcaccctcttgagtagttaggtctacctgg

SEQ ID NO: 666035 - DNA, 395 bp, Homo sapiens
gtaatacggctctcttggcacgtatttaagagatattgggtcttaatttcaattccaattcttcattgctgttataagcaaagcaatggacctttgtatgttaactttgtatcctgggcagagaagaggtagaggtaggcggtcagcgctggagccaggtcaggctgggcaggcggtccctgagtgcctgaggcctcaccttctccttggtcatgtccagggggctcaccaagtaccgtcacagccacacttttaaaaccaaggtctattgggctgtgcggcagggtgcaggccacctaaggtgtcccagctcctgggggacccatgaggccctggccacagccccgcacacagccgtcagagacacacgttttttgtttttttgttttttgttt

SEQ ID NO: 666036 - DNA, 1371 bp, Homo sapiens
cccctctacacaacactgcttggttacttcagcctggtcgggcttctccgcctgcactccctgcttagcgagcattactaccaggccatcaatggctgctggacgaacactcgaactgaacaacgaagagctatgtacttcccgctgctgccagaagtgccaggtcaccacactactattatgctttgggctttgcactatcttgactgactgccgctcgcttacccaggatagccactccagggtcttctgccacacatcctccatctacactcccagatgtgaccaactgacgcactgcttcccagcaggaccacagtacaacgtatgacgatgacttcaacacacgcagaactgagcacgactgcacttgccgctgcctggccatatagccactcacagactagtacccacaatgcagatactcgactgaagagcacttcaccatccgagcctgccgcgagcatcaacactacttgggtgaccacatgcagtgcttcgccgccacttgacacgcaaacaggtagaaccctaacaaagctcatactgcacacgacactattatcaaggtctaacctcacaattgccccccaacacgctctccactatgctcgagcccaatagataacgcattgcacctaaaaccattactcgacctacacttagatagcaaaccccccaacatcaatatccaacccatacactgcactgcccccatattcccctttgctccacgcccatgcgcctttgcacaacgcggcgttggtatcttctccgctcggaacttggaagacggcataaccaacgaccccaagagcccaacggcggtcggcacccaggtgccccttcctctccaacatcccacaatatacaccggtcgaagtgcctctttccccccattgcaacagttcctttcagttagccacaacctctaacccctaacatttggctgcccactatgattaggcgggccaccgcaagctgcaggcctcttgggtgctcttatggcgtcctcgttattcctcctgatggtgcgacacccgctgatgtccaacctcagtgggaaatgacccccatcgggtgggaaatacggtttactccccctggcgggaaactctcccccacagcggtcacctttctactttcttgggctttccctcttctcccagcaacgctcacctaacccacatcggcgacctttggcaccagtggaacaacccctctatccagggtgcttgtgtttggtggagaacccccaagcgcactgggggctcataatctcctttacagcagcgacgcccgcatttgtggacgaactttcggggagcctcgtgccaacacacttcttatcacacaacgggtctccaaccg

SEQ ID NO: 666037 - DNA, 958 bp, Homo sapiens
ggagagagagagagagagagagagagagagagagagagagagagagagagagagagagatctccccgccctctcgcgcggcccgtggggccgtaagaggcgcaggaggatgtagagggggcgggggtcgcactaggttgtgtctcatagagaaagagaggcgtctcgtgaaagggcggagcgactagttgtgcggccggaaccccgcgggcggggcgccacgactatttaaacgatcgatcctctatcttgtcgttgttgacgaggacacgttgagatcgtgtcgctcttttgagcggcggctatctctctcttctatactctctcatgatatatccacaggagggagtctccacgatggtatcctcactaatatctcggtggcggctagattgatgatgaatgtgaagaagaacgatcggtcgctcctcttgttaggcgatgtctccaagatggatctctatctagatcggtcgtggttaggtatatccactccggtagatagatcgtcgtcgctccccgcaggaatgtaacagcgaggcgaggttgcggtgcgagcaagcctccttcgttgaattgagtagattgagttgagcttatcagtgtacctacttcaagagggggagtgagttaggaacacatctcctcggtggctaatgcgtgagggaagcagttagtgaagcggatcctcgtttgtcggttggtctctttcggtcgcaccaagcgcgccgtgcggctcgctcgatgtgctgggtgggcttgcatgtgataaggaggggggcgccaaggaaaagaaccaaacgaaatggttaatttttctcatagcggaatggccatggattcgggtgtggaggcgcaggaaggtgaactttagaaggaaagtagcgggatcgaacgaaggaagacggaactttcctccgatagagagctcgtcggtgtccaggagcaccctagattgg

SEQ ID NO: 666038 - DNA, 128 bp, Homo sapiens
tttcgaagtctagtaggagtgcatcaggatcagcttacaagccccaagtaatcgtaccatcagagagccaatagcaaacatgtcattctatgtccacactgggtccccacacatctttaagacggatc

SEQ ID NO: 666039 - DNA, 870 bp, Homo sapiens
  misc_feature (1)..(1): n is a, c, g, or t
  misc_feature (65)..(65): n is a, c, g, or t
  misc_feature (68)..(68): n is a, c, g, or t
  misc_feature (91)..(91): n is a, c, g, or t
  misc_feature (97)..(98): n is a, c, g, or t
  misc_feature (104)..(104): n is a, c, g, or t
  misc_feature (106)..(106): n is a, c, g, or t
  misc_feature (112)..(112): n is a, c, g, or t
  misc_feature (150)..(150): n is a, c, g, or t
  misc_feature (171)..(171): n is a, c, g, or t
  misc_feature (176)..(176): n is a, c, g, or t
  misc_feature (189)..(189): n is a, c, g, or t
  misc_feature (192)..(192): n is a, c, g, or t
  misc_feature (202)..(203): n is a, c, g, or t
  misc_feature (212)..(212): n is a, c, g, or t
  misc_feature (217)..(217): n is a, c, g, or t
  misc_feature (221)..(221): n is a, c, g, or t
  misc_feature (240)..(240): n is a, c, g, or t
  misc_feature (245)..(246): n is a, c, g, or t
  misc_feature (262)..(262): n is a, c, g, or t
  misc_feature (271)..(271): n is a, c, g, or t
  misc_feature (362)..(362): n is a, c, g, or t
  misc_feature (438)..(438): n is a, c, g, or t
  misc_feature (461)..(461): n is a, c, g, or t
  misc_feature (644)..(644): n is a, c, g, or t
  misc_feature (648)..(648): n is a, c, g, or t
  misc_feature (659)..(659): n is a, c, g, or t
  misc_feature (668)..(668): n is a, c, g, or t
  misc_feature (708)..(708): n is a, c, g, or t
  misc_feature (725)..(725): n is a, c, g, or t
  misc_feature (747)..(747): n is a, c, g, or t
  misc_feature (810)..(810): n is a, c, g, or t
  misc_feature (835)..(835): n is a, c, g, or t
ncttcccccccccctttgttcctccccacgctccctgcctcccctcctgtccctgcggctaatcntgncagtccttggggttgtcgaggcncccttnngcggcnantggctncttggttctccctgccttggctggtgcccccgcccggncccttgccgggcccagtcccntgccntccttgggcctcnggngcccgacagnngggaatggntgtgngccncggctttcctccctgtccngccgnncttgcgggttatcgtncagcctgcnccccgcctctttcccccgcccccccccctcccgccctcccctccccgcctcccgcgtcctccggctcccccccccctgtcgtctggccgcnccgggccgtctttcgcgtctgccgcctgctgccccccccggcccgcctggccccccctgccctcggcccccctccncccggcctcccttggccccggcngcccccccggggccctgccccttgcctggctccccacttccggccctggggcagacctggtctggctctgcggccttccccccctctggctctctggctcctccgctcttccttgccgcttttccctgccgccccccgccggttggctccgggcctggggtgcggctccccttggggcttcanaaancaccatagtancacaatctnttgctggccttgggcattggtctgattcaccacgtggatnacagaactggggttgtnctgagaggctgagagggctgtnccttcgctacccttgtccctcctcttcctcttccttacgttctggctcccctggcactgtttntagaataaatgccctgcaggctgcnctcgttcagcgacgttcccaggcccgatccctctt

SEQ ID NO: 666040 - DNA, 671 bp, Homo sapiens
tgaagggttgtttaaaattcttcccaccaaaatgcttaaacccccttacggactccgtgattgccaaggctctcatccttcgtaaacagtagttatgccttagaccccattgtaagtgggcaccttgatgtttttctaccttagtggcacaagcttacaagatgcgttgcaggtcctaacctgttatccgtggctatgaaatggtcccagggtagtgaagctctgtaaagcctataaaagcaatttctgacaaaacatgtacagtaatatgagtgaggggaactaaaatgaagcataaaatctaccacttactattcagatggctcacttaaagattataagatcttgatccatttttaaaaatccaaaatggaagttgtagacattatctgtagtttatgcacaccaataaattagaaagccaatgtagacacgcataaccaaagaaaatgccttgggtctacataacagttgaataaatgtaaagttgctttttatttattgaaatttgtgcatgtctctttatgcttccctgatttactgattttttaaaaactaaccaactgcctgctttgatagttcagagaagagagctttcgttgtaatattagatttatgtttactggttgacatataagcggtgaaataaatagacttacctaaaaaaaaaa

SEQ ID NO: 666041 - DNA, 1676 bp, Homo sapiens
  misc_feature (636)..(636): n is a, c, g, or t
  misc_feature (939)..(939): n is a, c, g, or t
  misc_feature (1215)..(1215): n is a, c, g, or t
atgctccccccgcgccatattttgtgtggtgccttcggtgtgaagagtaatgcgttctgtgcttgtctcccctcgatatacatccaccggcctcgtgggtgttttgcctccctcgccgctataggtttgaaggtgggagacgctgggctggttgtttgtgtgtagttgtgtccgcctcctgctgggggggcgtcccactccatattgtgtacgaaggggctttttcttcttagttgggagggccgctgcccccaactgtggtaagctcgccctccctgtgttttggtaagacccctttgttagaggttggttggggcgcccaccacattcaaatggggggccgcccaactgtatgcacaaaagtgtgccagttgttgttgttgaaaagttgatagatcatttagtatagttgagccgtgttggtctccctgtccccgctgttgcccccaaaaaagggggggagaattcttcgaccccccaccccccacacacactggggggttgttgttaaaaagggaaggaaccccccgcgtcgtgtgtcgaaagaccccccccctctggtgggaaggccttcgtggcctgtatatgtgccactggtcgtcggggttgtcttcgggcctcgtgttttgggggcgnctttctattggagcccacgcgtcggaatagctcgccacgccgctttctcttcgcggaaaatgtgaagaatatattatcttggcgaagattcttgttgtttataaaagaaacatcacactccttcgtgggggggccacatcccgcgcgtctcgcgaaagttgggtcctcttcccctcatacccgcgagaaaaattgtggagaacacacgcggagtgttatcccccacgtcttatgttgatagaccgcgacaaaaggtgagatggcgctgtttctcacactggacgcaccacacccgcttttggnggtctctcctgtgttgacacacaggggagagagtcttgtcctctccctctactgaagccacatcctcacagggagaactctattgtggggctctacacacacactggagattaatggagaaagagagcggagactgttttgtgtataggtgttataaaaaaagagagagatatttgtgtcccacacctctggacgacacccacgggccacatatgtgacgtgtgagggcatagatatgtgtgatattgacaccactcgggtgtgataataagagtntgaatatctcttggggaccacacaagagatattttaataagaaaatttgttataaacacattctgagaaataagagaagctctaaagtgtttaatcacaccctctcttttgtttctccactcgagaatttctctatacaagagagatgtataagctcttaaatagctcgtgtaattctatttctctatcattggtttcttgaaaaatatcctcgcacttttttggtgaatcacatgttcacaccacaacactcacattatatgagaacattataatctagagattcccacatcggcccacatataaaatggcctttataaagaaataataataataaaatttttaaagatagcttgagtaagaccaattggcaggtaatatttcagtacctaaattaagactctgacattggattgtgaattataatgaaaagccccctttccttactaaaaaccacaaca

SEQ ID NO: 666042 - DNA, 169 bp, Homo sapiens
tcttagatcgaagctcaatttagatgctaagaaatgcctaaacatatctgtagctaaactctgagggaaaccatttttttcttttgagacagagtctcgctgtgtcgccaaagctggagtgcagtggcgcaatctcggctcactgcaacctctgcctcccaggttcaag

SEQ ID NO: 666043 - DNA, 884 bp, Homo sapiens
taaggagggggggggaaaggggggggggcgcagagggagaaaacaagttccagaaaaggtgatcacagaaaataccgtggaagtgcccaagagagttcgagccaagaaggcgccgaggctgtgacaccgtggtgggcgactaggtggagaacttctcgagccgtggatgagtgcgagaacgaaaattgtgggctatatcagcgcgcgcgcgaaaaggagaggggggagactcgggtgtagtgggcgcccacagccctcggcgtcacgcgcacaggtcccctcttctccctctggcgcgggagagggtgggtgttaacaactctcacaacacccccgaagagagacggggtgtgtgatacaagtgtggggtctcacagaactgtgtggcatatacacgcgtcgtgtgtggggacacagtgggtcgctgcgcgagagggggtgcgcatctcgcgcggacagtgagcggagggtgtgggtgaaccccccaaagggggctatcactgtggaggacagagaacacctgtgggagtcccctctgtgaggaaatagacggggcgcaccgggggatatctcccaacagagtgtcctctgtggcacacgtgtgggcgagtaacaaacatagtgggagagggggtatagggggggggccatatttattataacacaagagacacacacacagagtctcgcactacacaaataatcgaggggaaaaaaaaaaacatctccaagaagaacctatgacgtggtgtccaaaagcgtgggcagagcgagagaataaagcccaatacacacaccacacgacggggtgtgtgcccgcgccacaagtgtgtgggaccaccacgtgggccatctacaattatatactcaccagggaaaactgg

SEQ ID NO: 666044 - DNA, 223 bp, Homo sapiens
atagttttgatttatgtggtttatatacaataagatattttgagagagaaagagactacattcatatactttttactataatacagtactataattgttctattttattattgttaaaataaaaattaaactttatcacaggtacatacatataggaaaaaacatagcacatataggaaaaaagagtgtatatagggttcagtactatctgcagttactgggg

SEQ ID NO: 666045 - DNA, 736 bp, Homo sapiens
actgtatacgcaagcgtgggtcaacggaagcagtcgaagttaaacggctgactcaggtactgtaagggtttttacttcactcgggacaactcttaaatttggcccattgagtaatatcaaggctagttttggagagactggtcgtttaatagtaagaagccagtgttgtcagttgctagaataattcctatgttcttagagagtaccgttggttatattccacagcggagtaattaggttgtaataccgttgccacgctcaggacagtcagtcagcgtgcgttctagatgaatgggaagtcgcaaccctgcgccctccatgttttgtggttcctggggcttcaattcaagtctggtcaagtctgccatggctggggagttcatgtccatgggaacacgatacatcagattgtagtcatcactgatgtctgcacgtcatcgccaaagactcgtagtactacttgacttagctcagagcatagcttagggcaggctgcctaacaacatggcattcagacagataaagctgaaacaagcttcaagttgcttcatttgtatgcagagactagagaacatggtagataattatatattatacgcctttgtgtaagttcatgtaatacgtgaagcagtctttgtctcaaaagagtatgcccttagctgagaaaggatatgtgaacggtacatttattgttggggagagtggattgtttacatcatgtcttgaccttttgtcc

SEQ ID NO: 666046 - DNA, 834 bp, Homo sapiens
gtcttcttgccagcctcaaggacggagtctgagcctccatggtgcaccacacagggaggacagtggacctgttctccgtggtcatggcccagcagaggggaagggcagttcagtgagtgtaggcaaaagaaagagcgatcagactcttactgtgtctatgtagaaaggaaagacataagagactccatttgaaaaaggcctgtactttcaacaatttctttgctgagatgtgttaatctgtagcttgccccagtcactttgaacaaaccactttgacccaacctgaagctcacaaaagcatgtgtgtatgaaatcaaggtttaagggatctagggctgtgcaggacgtgccttgttaacaagttgtttccaagcagtatacttggtaaaagtcatcgccattctctattctcaataaaccagggcacaatacactgtggaaagcctcagggagctctgcccttgaaagcgccgtatgtccaaggtttctccccatgtgatagtctgaaaagtggcctcgtgggaggagaaagacctgaccatccccgagccgacaccagtaaagggtctgtgctgaggtggattagtcaaagaggaaatctcttgcagttgagagagaggacgcggtgtctctgctgcctggactgatgttcggttaaaccgttgtacttgtcatctgaatgggggaaaacgctatgtggagtggaccgttggggatgggctgtttttacctggagtggggggaaataattgtaaacgtggtgacttctgatctggtaagtgcagggggaaccataaggcgaattggaaaaaaaaagggaaggggttgggccgg

SEQ ID NO: 666047 - DNA, 191 bp, Homo sapiens
  misc_feature (16)..(16): n is a, c, g, or t
  misc_feature (36)..(36): n is a, c, g, or t
gctccccttacagcangctggctgtggcacggtgtnggcgacggtattggctggtggatggcggtggtcaatccggtgccggtgtcgctttgccgcgccatgggcgccgatatcgtcatcgcggtcgatctgcagcatgacgcgcacctgatgcagcaggatctgttctcgatacgtatcgaggaagaaag

SEQ ID NO: 666048 - DNA, 229 bp, Homo sapiens
agatcatgactatggcatcgctagccttcagcaagcttttctagatcgacacaggtttctccacgttgaagctatagcttccaggtcacggcgcagtgtaggttgggtttgattaagggaatacctaaagacctattgggccattatttcctgataacgcttctggtattcgtcactgagcagaacttgccttatgacgaataccagaagcgttatcaggaaataatgg

SEQ ID NO: 666049 - DNA, 265 bp, Homo sapiens
gtttatcttccgcagtcattagtctagcactatccaaactagcaatctatctgtctatggcagccagtctgctagaagacggcaccacaatacctatcctccctattcccctaactgatattaataatcctcttatcaatcattagcaaggtaacttcaatgtcattaagtattaacattctaaatatgtaaagctatagaagaaaggtcctgcctattctatttgaccctcccaaatcattctagtctggtttaccaaacagaa

SEQ ID NO: 666050 - DNA, 547 bp, Homo sapiens
  misc_feature (32)..(32): n is a, c, g, or t
  misc_feature (130)..(130): n is a, c, g, or t
  misc_feature (192)..(192): n is a, c, g, or t
  misc_feature (195)..(195): n is a, c, g, or t
  misc_feature (197)..(197): n is a, c, g, or t
  misc_feature (210)..(210): n is a, c, g, or t
  misc_feature (294)..(294): n is a, c, g, or t
  misc_feature (297)..(298): n is a, c, g, or t
  misc_feature (335)..(335): n is a, c, g, or t
  misc_feature (338)..(338): n is a, c, g, or t
  misc_feature (358)..(358): n is a, c, g, or t
  misc_feature (426)..(426): n is a, c, g, or t
  misc_feature (466)..(466): n is a, c, g, or t
  misc_feature (479)..(479): n is a, c, g, or t
  misc_feature (485)..(485): n is a, c, g, or t
  misc_feature (497)..(497): n is a, c, g, or t
  misc_feature (517)..(517): n is a, c, g, or t
  misc_feature (519)..(519): n is a, c, g, or t
  misc_feature (533)..(533): n is a, c, g, or t
  misc_feature (545)..(545): n is a, c, g, or t
ttgggggaaagaatgaagaggagtagagaatntataattcattaacaatgtacctttcctggaagggtggacagcaagaataaggacaagcaaaaatcatcccctatttaaaaaaaaaaaaaaaaaagtnaccagcaagttgttccgggtgggaggggggagcagaataaaaaaaaatctgcaataatttcnaantntttttcaataaanaagcttgggaaggggttcctgcaagtttcatgagggagggacaacttccaggtagttttggggaagggtataagggcctatgcnggnnggccttttatcccaaaaaagccaagaggaggtttacnggnagcccccccaaacttctggntgtaacctgccttgtaacttttttcaaaagcagccgctgggagcccaccaggttgttatgaccacccnggaacaaaacaacaaggggcaacgggtggtttttcttgtnattcggcactttnttttancttttaaaaggntacataaaaaaaaacttcanantattacccacagcntctccaagtttntt

SEQ ID NO: 666051 - DNA, 462 bp, Homo sapiens
aactcacacatgccccccgtgtcccgcaccttatttttgggggggccgtcagtttttttttcccccccaaaaccaagggccccctttttattttccgggccccttaggttccatgggtggtggtgggcgttaacccccaaaacccttaggttaagttttatttggtcgtgggcggggtgggggtgcattattcccaaacaaaaccccggggggggccgttccacagcccgttccgtttggttagggtccttccccttcttcccccgggctgggttaattgcaagggggtcaagtgcaaggttttccccaaagcccttcccgcccccctttagaaaacccttttccaaacccaaggggagccccggggtttttcggttggccgaggatgttttggccgttccccgttttcattctttcccgggcccccgcctgggaattaagccccccccccttcccttggga

SEQ ID NO: 666052 - DNA, 150 bp, Homo sapiens
tgtgttgagttcttacgacttctaatattgcaacagaaaagctgcgtataaggatttaacactggcatattagagctcggagtacacatgggccacataagcgaattcccttccggagcgcacacgaggtgaccgtgtatgcaattacgc

SEQ ID NO: 666053 - DNA, 192 bp, Homo sapiens
tggaccttctgcagacaacagcaatcacataaaagaagggaccaaatgtcatgcatcacagacatcaagacaacagaaacagcaggccacatatatctacattaaacactgaagcaaataaactgtaagtgctctatcctcctttcaagacaacccagataagtggggaaacctgctttagaaaccctgccc

SEQ ID NO: 666054 - DNA, 195 bp, Homo sapiens
ccataataagaagtggacactacagtattagcttcatcgtgtgggagaaaaaaccttagtataatatatggatgcagacgacttgatgaagatcttaatttgttttggtttaaaatagtgtttccttttttttttttttttttggaaattgtccaaaatttctatccctacggataggaggttaattttcctgtg

SEQ ID NO: 666055 - DNA, 177 bp, Homo sapiens
gacattcatcatgaaggtatccagagctgattcgtcaggcaacaggtagccggacctacaacatgatccagtactatcagaatgacatccctactgaggaggggaccattcgagggcctctgccccatgtgcccttcaagctgccccacaatcatggagccctgcgacctacccgcc

SEQ ID NO: 666056 - DNA, 205 bp, Homo sapiens
tgcacctggaggcccacttgaaacggtacttacaaccgttccgggctccgaagaagttcttccctctacaccagtaacacgactggcctaccgcgggaccgaggccgaagtggttgtggtacgcacaacaaggacacggcatacctggggtctcggggaggaggtcggggacagggtgggggaaggggggtcgggtaggtatccg

SEQ ID NO: 666057 - DNA, 667 bp, Homo sapiens
gcccccgaacatgccggggtttacgcaaagatttcatgactaagaacccataagcaaatggtacaaaaacaaagataagtaggtggaacttaattaaaatagagagcttctgcacaacaaaaggaacagtcagcagagtaaacagtcaacccacagagtgggagaaaatctccacaatctatacaactgaaaaaggactaatatctagaatatataaggaactcaaattagcaagaaaaaaaatcccatcaaaaggtgggccaaggacatgaatagacaattctcaaaagaagatatacaaatggccaacaaacatatgaaaaaatgctcaacatcactaatgatcagggaaatgcaaatcaaaaccacaatgcaataccaccttactcccgcaagaataaaaaaataatagatgttggcatggatgcagtgaaaagggaatactttcacactgctggtgggaatgtaaactagtacaaccactgtggaaaacagtgtgaagattccttaaaaaactcaaaagtagaactaccatttatttgatccagcaaaaccactactgggtatctacccagaggaaaagaagtcattatatgaaaaggacatttgtacacacatgttgatagcaaaacaacttgcaatttcaacaatatggaaccagcctaaa

SEQ ID NO: 666058 - DNA, 246 bp, Homo sapiens
ctataatggcagtggcatgaacatggctcactgtaactctacatctcgggttcaagtgattctcctgcctcagcctcctgagtaactgggattacacgcacccgccaccatgcctggctaactttggtatttttagtagggatggggtttcaccatgttgactaggctggtctcgaactcctgacctcaagtgatctgcccacctctgccattaaaggagctgttcatgccactgccattaaagga

SEQ ID NO: 666059 - DNA, 481 bp, Homo sapiens
  misc_feature (405)..(405): n is a, c, g, or t
tcgggcggaccccaagggccttagccaaagcctaatccagaacaaagctaactctcttcaactctatgaaagctgagagaggtgtggaagctgcagaagaaaagttgaagctagcagaggttggttcatgaggtttaaggaaagaagccatttccataacataaaagcacaaggtgaagcagcaagtgctgatgtagaagctgcagcaagttatccagaagctttagctaagatcattgacgaaggtggctacactaaacaacagattttcaatgtagatgaaacagccttctattggaagaagatgccatctagaactttcatagctagagaggagaagtcagtgcctggcttcaaagcttcaaaggacaggctgactctcttgttaggggctaatgcagctgngtgactttaagttgaagccaatgcttatttaccattctgaaaatcctagggccccttggggcttaagggaccttgg

SEQ ID NO: 666060 - DNA, 339 bp, Homo sapiens
gtctctttaggttgaatattgtactgttccgtgcccttctgtattcttgtctctttaggttgaatattgtactgttccgtgcccttctgtatttttgtctctttaggttgaatattgtactgttccgtgcccttctgtatttttgtctctttaggttgaatattgtactgttccgtgcccttctgtatttttgtctctttaggttgaatattgtactgttccgtgcccttctgtatttttgtctctttaggttgaatattgtactgttccgtgcccttctgtatttttgtctctttaggttgaatattgtactgttccgtgcccttctgtcgtcttctc

SEQ ID NO: 666061 - DNA, 138 bp, Homo sapiens
cagaggcgcgcagcttacgaagacctggagattgtgctctgaggacgccccatgtaagtggggacgggtgctgcttctccacctcccccaaacctgcttctgtgccctgatgcgtatacccagactcagagaccgtga

SEQ ID NO: 666062 - DNA, 400 bp, Homo sapiens
agtacgaaggttgtgtgtcacaggttcctcatggaaacacgtgcgatgatcatataaccatagagaggatacagtcagtatgaccaccaaacccaggagccatatataaaaatactgataacatataactatataaaaacattttagccgggtgtggtggctcacacctgtgattctcagcagacaatcagatcaggagatcacagaaggtcaaggaactactgagagcagcaggaatggcagagcagtgggggtcagcaggaagcttggagaaatctgcaaaatagtagcattacaaaggatcaaaagtcagtgaggttcaacaagaggtagggtgggataatgcacaaagacagagggaacacttccaggttcattctgtgaggtcagcacaccatga

SEQ ID NO: 666063 - DNA, 303 bp, Homo sapiens
ttaccggacgggcgtaagtttcgaaggggagggagcacgtgtcagctgtccccgagtgtgtattggtgcctggtcaacactgaatggaacaagtaggtgacctgctgttgctgcgtgcttcctcctcttcttcctcctcctcctcttccttttcttcttcctttcttcttcttctttctttttttttcttcttcttctctttttcttcccagcttcttcttttgatttagggtgggtatagtcagagctctctacctctcccccaggccttcctatgcctcacaaagcactgctccagaagaa

SEQ ID NO: 666064 - DNA, 119 bp, Homo sapiens
  misc_feature (31)..(31): n is a, c, g, or t
  misc_feature (89)..(89): n is a, c, g, or t
  misc_feature (115)..(115): n is a, c, g, or t
aataaacccaggtggtcctgctccagatttntgctctaaattgcagaattatgctgcttctcataaatttcacacacacacacacacanacacacacacacacacacacacatantgtg

SEQ ID NO: 666065 - DNA, 239 bp, Homo sapiens
aaaaaaatggggggggggttttttgggaaaaaaagggccccctcccccttttttttttttggggtcccgggctttaatttgggggttttggggggggggggggatttttttaagtgattttttttttttggaacgggaatttttttaagttttttggggttgccccgggaagggattttcccccttggggtttttgggggttttttggggaccatttatggggaattggccccccccca

SEQ ID NO: 666066 - DNA, 251 bp, Homo sapiens
cataaacccagcactgagacaggactcgcgatgcatgtgctgtttaagtgaatggactgcacccaagactaccaagtccagagcccaaggcacacgaagggcggcaaggcagaaacttttaggagcatctgttcaccgaggcgcagaaggcagccagcgcccagacgcttctgggtaacctaagtgaggcttctgcagacaacaaaagaggaagggtccctttgcaaggacagaccagccctcagcttcct

SEQ ID NO: 666067 - DNA, 211 bp, Homo sapiens
  misc_feature (87)..(87): n is a, c, g, or t
ttattattttatttttcatctttatttatcatggagattcctttcgctttattggaaaacgtaagacttgggtacatcaaataaaancaatttctggggggggaattcaatgaccacaatcaaaaaccacgttttcactgtctgggtcacagtagtaacccaaagaacatattcgcttagtcgccaaactcctcggtgtgtacatcattga

SEQ ID NO: 666068 - DNA, 132 bp, Homo sapiens
  misc_feature (69)..(70): n is a, c, g, or t
ggcaacccctgcgtggtcctctgttggcagccttctctcatcagagctaaaagagaactcaggtagggnnttaattgccaagttccagacttggggatgttctgacgaataattggtcctgaccattggggc

SEQ ID NO: 666069 - DNA, 191 bp, Homo sapiens
tagtaccatgctcctccccaggaaccccagctgacagacaggcagactcctcttcatccttccaagcaccacctcctccaggcagccctcctccagtgcccaccaacctcctccagcagccgtacagaccgcttgcttgtagcaacttgcattcaatcccttgcccaggaacttccatatgcgggtgtggc

SEQ ID NO: 666070 - DNA, 458 bp, Homo sapiens
gtaccagcgtgtcggcgcggtctgttcgccgacgatgctcttgacaatggcggccactgtgccacgtgcaaggttgaccaccgccgccgagtagttctgacggtagacgcggtagaccactggagacttgacgccggcggccgcggaattgtcattggaggtcaggctcagatcatcgttgcggcccgtgcctccggggccgttcttgccatacagggtgaaggcttgcagggagttcagatcgaatacgttggaaatgcctgtgctggcctgagtcggaacggtcgcggaagtggagggaccgtaggtctgaccgttgtaattgaacgagccctggtagacgacatttgcttgttcttccaggttgctgggttggtcgaggtccaattggttccagcctgcggaggcgacgccggcggatccggtcatcagcaaggcggcggaaagtgaggcgagtt

SEQ ID NO: 666071 - DNA, 883 bp, Homo sapiens
gctgagagtgacccccacgtcagcggagcctctcatgggaggtgttcctgacagccggctggaggtggagcgagagcgtgagctgccgctccagcaccacacagctgtcatcacgccgctccaagtccatggcacgagctgaaactgttggagaagattcctgagaatgccgaggccacggtggtccttgtttggctgcgtggagttgcctctcccgtcccaccatggtcttgtgtgcggctccgggaggctgtggagttggacgcagtgttggaggtgccggtgcctgtgcgtttcctcttcctgctgcgtgggcccgagtatgtgcctagacatggaactacgcaacgagatcggcgcgctccgtctccaccctccagtgtcagacagagtcgattcctacgaggcgagcgctaccgtggtcatgacgtaagctgggaggacctgctgaggctggtcgatctaaggccttcctggactgcgagcgtggtgcgtgtcggcttcagcaagtgctagggcgaggagctgcgtgcgcgtctgtggcccacttccagtcgccagatgctcgagacgcgagaggagcagggcggtggtacctacaggggctgggctggagcccaaatctgcccgcgatagggcgctcctgcggatggtagacggcggcaggggggccgctgaatgatggattcgcccttcggcggacggggcggcctttgggggggttgatccgagatgtgcggatgccgtatccccgataacgtggagtgatttccgagaggccttgggcctcagtgctggccgcgtcatcctcctcggttttaggcctgcggtcttgggggctctctgtgggcgaccccgtttcggcgggggtcgcgggggtcgc

SEQ ID NO: 666072 - DNA, 1221 bp, Homo sapiens
ctgtctcactcatttacacctaatgcacccaagctatctataataccttaacgcatgtactatccccttatgagcgggcgcgagggatgatagggctgtcggcatcgtagagtagtgtaaaaagtgccacatagactcacatctatcgtttacctacgaaaggcatatcctactccgccttttatccccaatactgagttagttagtctgataaccagtcaacccgtacgtcagtccaacgcaattatcgccatgcgtcggtacgccaatagacacgtgctaactacttactctgctagggcaatgcttacttcgattgcaatccatagattgtgaatgcagccgacccgtatctaattgagtccaagcgagttagccgttcccatctacatattatccatctgtcagcatatgctgacatttgcttagctgatctacttcccttacgacaattcgcttgctccgccatctaatgcgcaagggcccgaacggtggtggccacaacttacttaggtagagcccatgcgtagcttggcagcaaacagaccaccgatgaacacacacattgaaacagaaaaaacgcgcccggggcttccttatccctgaaggaagattatcccaccataacattatagaaggggcccacgcgccaattgtgtttaggggcccgcaataagcccctgggttatgttcatctcgtgaccctaactgtgggggtgtaacgcgctctatgaaggtggggaaaacgggtatacaacttataggacctacactgggcaagcgagaggtccgcgaagcggtttatggtaacgtacagcagtcccgtgggaatctcggtggcaccaaccttacggatctaccctatgggctgaatactctaaagaaaaaaagcagaagaactcttatggtactccgaggaatagttcgaaccctcaaactctcggacaccaaggcttgagcctttacttaggaagcaattttaaacccccctccaagaggggctccacattgtttcaaacgttgcttacaccgagggtacattacgtggtggctcacaaccaagttaggtccgcaatatagacgtagcttggcattgtagaaacgcactccggccacacggggacgacatgagacttcaccgcaaccccctgctcacttccacaggacatcagagtctaacaaaaaggacactctcggatagagcgacaccataactacgag

SEQ ID NO: 666073 - DNA, 442 bp, Homo sapiens
ggagagagagagagaatgtagctgcgtggggacaatccatcgtggagtgttctctcagccttacggtctggacacggagacttgcgcggcgagatgctccagcgatgctgggctgacttctgctacctggggcacggctatctctgactctcccgcacagggagacatctccgcagcgccaagccacagcgggctcagcggcgccagcaggctgacactaccatatagacactggcagccacagcacctggcgcgctcagcggcacgcacggctgctgcgcttcatgacgaccaagcgatccctgcggcgccgcgggcgctgcggcgcctggcggcccattctcatggccatccatatctgaatctctccaacctgcaacacgcgcatccaagcagccacgctcacacacaaccgagcgtctctctcctccgcatctccctc

SEQ ID NO: 666074 - DNA, 771 bp, Homo sapiens
gcacagactcagagagaacccaccatggggctgtctcctgccgacaagaccaaggtcaaggcctgactggggttaggtcggtgcgcacgctggcgagtatggtgcggacgccctgtgagaggatgttcctgtccttccccagcacaagacctacttcccgtcacttcgacctgaggcgacgggctcatgcccaggttaagtggctcgactggcgcagtaaggtggcacagagcaggctgctgatgctaacgccagtgaagggcaccgtggcacgacgatgccctaactgcagctgtccaggtccctgagccgaactgcacggcgtcactaagcttcgggtggacccggtcaacttctaatgctcctaagccactgactgctggtgaccctgggcgccgcctccccgccgagttcacccctgcggtgcacgccttccctggacagagttcctgggttctgtgagcaccgtgcttgatctccgaaatatcgttaacgctggagccgtcgcgtggctatgcttcgttgctgccttttgggtcgtccgccctgtgggcctgtatcccaccttggccattgcgatgactgtaacctccggcgtggatcgtgtggtccatacacagttcttgatgttggcgactggtaacgaaggggggtattggaccatcaccaccaaatgcccatccgtgcagtcatggacctgggctggcccgggagcctgactgacttagctcatgaacatctccaccgagcgcggtaaatggtttcagcacc

SEQ ID NO: 666075 - DNA, 370 bp, Homo sapiens
cttacataacctgcaaaaacatgagagctatacacaaagtataagacttgaagatggctcagatcttaaacgctctcctcataggcaatagatatatagacccaggatgcagacattattttgtaaataatttcctttggaagctggatgggacagacaaattacaggaaggtgagagatggaactgcacaggaaaaaagtttgtctttgtcactttaatcttatcattactagagaatatttatgaatattttagaataatatatttttaagcccaaatctcaccaaatgttttttctaaaacaaatactttttgttgttgtttgtttttgttactgtgtctctcaaaaaaatacagaagaataatgta

SEQ ID NO: 666076 - DNA, 95 bp, Homo sapiens
tcctcggcggcggaaggcgaacagcgaggaaccctaaccctaacaaccagtagatccgatctgcaaggcctgcgacgatggcggcttcccttcgc

SEQ ID NO: 666077 - DNA, 726 bp, Homo sapiens
ggtcgagacgcgcagcgcgcagtccggtgggggccttgtcttacccctctctgcgcgcccgcgccccctttcgcgtcgcaaccagaagcccagtgcggtgcctggagccggacccgcgcccgcgccgctcccgggacctgcgatcccgtgccgcccacgatgattagcgcgagcgagagggctcctgcgcgtcctcttgtcttcctgtcttggactttacggccacatggacctatatgggctgaatagcttccctggcctgcaacgccccaaaatggattctgcgaggatgacaatgtttgcgtgtgtgccagcctggcttggctgggtcccctttgtgaccagtgcgtgacctctccctggttgccttcactggactcttgtggctgaaccctggtgcagtgcattttgcagccgactggcttggtgaccggggatgctctgtgatagagatgttcgggcctgctcctcggccccctgttgccaacaacgggacctgcgtgagcctggacgatggcctctatgaatgctcctgtgcccccgggtactcgggaaaggactgtcagaaaaaggacgggcccttgtgtgatcaacggctccccctgccagcacggaggcaccttgcgtggatgatgagggccgggcctcccatgcctcctgcctgtgcccccctggcttctcaggcaatttctgcgagatcgtggacaacagctgcacccccaagca

SEQ ID NO: 666078 - DNA, 184 bp, Homo sapiens
aggtctgcagaaacggctgctcgactctatttcgacgcgcggacgctcgaggaggagcaggtggtcaacatcctctacctggccctcggcacgctgaaatgggtcgatccgaacaacgcggcgaacatccgtcacgcgccgctgatcctggtgccggtggcgctggagcgcggcaacgccgccg

SEQ ID NO: 666079 - DNA, 121 bp, Homo sapiens
ttgtcacgctcggcccgtgttcaggtgggggctgccccgtgggccggcttcctgggacccggcgctctcagcagtgaccccgataaatgaaccacgcaagatcattaccacggtgctataa

SEQ ID NO: 666080 - DNA, 193 bp, Homo sapiens
tccgaggtgatccacccacctcggcctcccaaagtcctgggattacaggagtgagcactgctcccagcttacagcctttttttaagacccaatatgtcagtccagctttttttgaatatagcaagaactagcacataatacatgcaaggagaaaaactttgtaaactaaagtgaatgcctctggatagggaga

SEQ ID NO: 666081 - DNA, 373 bp, Homo sapiens
aaaaaggccagtgtggtaacctttcctgtttaccttaacttcacccgggcagacctcattttccccgtgggctttgaaaatgctacaaaagaggatccttccaggtttttcgaacggggggttgcagttttgtgcccaaagtaaacttttttaactgcccccttttgtaaaaatgaaaggtgggatttaacctttattccttttttaaaaatttggaaggtttgagcctgttaaaaaaaaatggttggttttaggttggaggaaacttaaaggaattttacggttgggagtggtggaaattggaaggaaacccggagggattttggaaggccaaaggggggggtccttttaggaaataaaacccttagcatta

SEQ ID NO: 666082 - DNA, 1160 bp, Homo sapiens
tgggagggggtgtacattttatgggaaaccttaaatacgtgtctcagaatcaatcagggctctgggtgcagcctacacagaaaaatgaagcttttggggttaggggcaaggagagagacagtacagaggacaaagacccctcacgatgaagtgctcttcagccagcttatattcagcttttggccacagctttcttcaagggggtctcccaccatattaaaaggccgtgtccggggagagtggctcaatattcaccgtgccaaaatcgtgcgtggaactccttggagtggttctcctctcgaggggctaccagttttcccacattattgacgcgtggtgaaagacctcagaaaccgtggaatggggtgtgagaccaaaaaagcggcgtgatattttcgccggtgcacgcggagacagcggctcaacctgtggtcttccttcgagaaagagttcatccaatacccgagggagtggccaagtgaatatccgtgggagggcattgggtagatccgtgcgaggactctttgtgcaccccaagggcgcaacatcgtaaggcctcacggccaacaaggtgtggagatccaggatacagagaagggggagtctagaaggatccacagtgggataggatgcccagtctcacgaaagtgggcaccgcgaacagtacaggggggtacgcactccaagtggggcaaaccgtaggtaagcacggcgcgccggagacagaccaacgtcatcacgcagtgaacactagataagccgggaacaacgagggtgaaagaaccccttcatgggcacgtggaaacacacaccaccggaataaaacccaaggtaaatgggacacggtaaggttgcaaaacccccacggaaaagaggatagcgaccaccaaagggcacaaaccctctgagaaccacctggtgggaacgcaaaaacgtgtctacaccacaacaaggaaacacatctggacactagtgggccagacaattatacgagccagcgcgcccatcaacgaccccgggccaagccacagggggacacagagccaaacacgggcgccccaaagggggctataagggcgagcaccaacagactcaacaggaaaaaaaaccgagacaagactgcacaccacagaaaacgaaccaaggtaaacacaaaggac

SEQ ID NO: 666083 - DNA, 158 bp, Homo sapiens
ggtccacatggcggtggtagacaggaggccggagtgaagtacgcaaagaggacgagaatggcgattacaccttcggccaggtgacaacacttttttagagaacaccccggaggcggtcgcacaggcggtgaaaacgcgctttgaactgtggacgggcg

SEQ ID NO: 666084 - DNA, 717 bp, Homo sapiens
  misc_feature (377)..(377): n is a, c, g, or t
gcttcagtctccacccggactacgccatggtgggggtatgtgggtcgggtggccgctgctccgtgcctccggggcctttgcgggtgactcaccgccttcagcgtcgctgtccccagttcagttcttattgcgggtccgctccgtcgggaggctccatcctgtcatgggatcgtatgcggggcaaagcatctccttctgccagaagcaggggccctgacaacgggctgcatcgatggcggtcattggcgcagtgggtggacgttcagcttcgattgagggagtaccaccagattctaaatgcccttggaagtgcagagggcacgggagactcagacttggttgtaggaggtggtccagcatttgggtgagtagcacangtaaggagctatgtgctatgggatgggtgacagaaggtgtaggtgtagaggccagaaagtactgtgattctggtgcaccgaatcgagaatttgcctgttggtcgctgagacttggggctagaatcatgtaatgtcatttgggagcaacctgattgtatgaaacgagcgtcccatcaaaaggccaattcagatgtatgctcccatttcatgctgaggggcccagagttgcatggcaatggggtggtagagccaggagaatgttggtggactggtatccacgggttgtcggatctgctagctgcctatgccaagggtggcagagatgggcttaatggaggag

SEQ ID NO: 666085 - DNA, 872 bp, Homo sapiens
ggagacgcgcggggggaagatggcggctgggttcaaaaccgtgaacctctgagtatacaggagattctgaaaagaatgcgtcctgatggaaagagacttgtgggtgaatcagaaccacaatgtcaacatcggttcaattagcaccgcaaggatggtccgtgcttaaagtgaagtggggaaatactacagtaattctgtggcggtcacaacgcagatttggcagcaccatcaaagattgcccttgataaaggaatacgtgtgtcctaattgtgtgtatctaccacccttgtgttcatcgagatcgggtctgacctcctgagacagaggcccaagttgactagccagttcatggcagatgtctttgcaaacttcaccagatatttcagacaagaggaacttatgcacttctccagggaaagctggtcgggtctaatactgtgatctcattggcctcgatacgagtggacaaccattttgatggctgcaacatttgttgaaagcggtttacaaaacttgtcccggttgcctgaagttacctacttaactgaagacacttgtttcagcaaaaggtactttaaaccgaaggacgacgttattgtgactaatcagaactcatccagttggcacttcctttggcggggttgctgaccctttgctaataggttgacccctactgcggaggggaactcttggagacgggaccttaacaatagtatggctgagggaggcaactctgtggttttccaaacagggttggtcggcaattagtctaaaatttgttggtaagctcgggggcgctaaataggggcgagtgacatgggatatttaccacatagaagagttagcacacaggtcccgtaaggaggagggga

SEQ ID NO: 666086 - DNA, 291 bp, Homo sapiens
aaaaatagctcggaccgtgatgctcccaggtgtaacatacaggtgacaagacgtagcgtacagtagacttgaccatataacacgccaccaataaagacacttcccagacatgaacaaacaggaacatgaggtcggacagatgaaagtcgcagggagatgtaagcagtggcctctccagcataacccctcctgtctgcacctgggcacgcgacccgctgaaggcagcagagagaccccagttgtgggcgaggcgtggaccgtgcagggtccaccgtgggatgccatcaggga

SEQ ID NO: 666087 - DNA, 849 bp, Homo sapiens
  misc_feature (38)..(38): n is a, c, g, or t
  misc_feature (632)..(632): n is a, c, g, or t
gtagaccttgaaaaacaaagaaaatgagcatctgtgtnatattgattttttctaccaattttatatagactttatgttttagagcaatcttaggttcctagcaaaattgagaagaaagtatagatatatcttgtataccatctccccccacatatgcataacctacctctcctgttatcaacatcccccaccaaagaggtacatttgttaaaactgatgaacttacattggcacatcataatcatccaaagttcatagtttaccttagggttcactcttagctctgtattctatgggttgtgataaatggaaaatgacatgtacctgccactatggtatcatacagagtagtttcactgccctaaaaatcttctgtgctgcacctatttatccctgtgtctccccaagcccagccaaccactgatctctttaactgtctttatagtttgtcttttcctgaatgtcatatagttggaatcatacaatgtgtggccttttcagaatggctattttgcttagtgatatccatttgcttagaaatgtctatccaatagacatttcttccatgtcttttcgtgttttgatagtggggttttttctttttagcactgaatattattccattgcctgtnacacagtttactttttcattcacctactgaaaaacatcttggctgcctccaagtgctggcaattataaacttgccaaccatgctataaacaacaatgtgaaggtttttgggcagatatagttttcactcctttgggtaaataccaaggagctcaactgtatggtaagagtatgtttagttttttaagaaactgccaaactgtcttccaaagtagctg

SEQ ID NO: 666088 - DNA, 598 bp, Homo sapiens
aatccaatccaaggttcccaaatcagcccgcacatccagacttttctctctcctccggctttattaaaaaatccgctcgagctctcgcctttacttccgaaaaagaaaaggggaactcgcagaacccgaaaggtcctctaagccgtcgagttgccggtagggagaagaggtcggactatagtgaattggccagtcctcgtgaaactccctctagcgctaaatctctatcgcctccgtaaagccgaagccatgaagtagtatttcctccaccgaagcggtcgtgtcctagttcgacccttcctccgcgggaacggagcgagttttattctggttctaatgagctatctaagccgacgaggctcgaggattttggtgtaccttctttaagtggggtaagtaaatcggtaccttcgagggtaaggtccgatgagggtagtgccgggagtagtcttaatggtttgggtatacctagttcgtctctccctactaggggtaggaccgctaaccctaactttattcctccgcctcttactccgatcgagaatccgttatttccgataagtacggagaacccgttcttagaggagaagcctccttt

SEQ ID NO: 666089 - DNA, 352 bp, Homo sapiens
  misc_feature (52)..(54): n is a, c, g, or t
  misc_feature (56)..(56): n is a, c, g, or t
tttagtagagatggagtttcaccatgtgggccaggctggtctcgaactcccnnntnacctgtttgcccacttcggcctcccaaagtgttgggactaccaggtggatccatcacacccggccaacttttctttttttttttttttaggagacagggtcttgctctgttttccaggttggtctcaattcctgggcccaagcagttctcccacctgggcctgccaaggtgctagtattataggcgtgagccactgcgcccagccctttatagtttttttcttttttttgagatgaagtttccctctgtcaccattgcactccaacctgggtgacagagagagactccgtttaatt

SEQ ID NO: 666090 - DNA, 271 bp, Homo sapiens
agccggcgtggtgtcgcatgcctgcaatcccagctacttggtgatcctagaagcaggcgaatcactcgaacccaggaggcggaggttgcagtgtgctgagattgcaccattgcactccagcttgggcaacaagagcgaaactccatctcacataagaaaaaaaaaagaccaggcgtgggggcccacgcctgttaatccctaacactttggggagaccaaaggcgggtggatcgcaaagtcacggagataggagaccatctccactaaaaaa

SEQ ID NO: 666091 - DNA, 307 bp, Homo sapiens
acttttcttggataatcaggaggtgccccagtggtcacagtgtggcattccgagttggcgcggatggccgggtcaagatacggaccagcaggtgttagggctcaagacaccaccctcttcatcttatggggcccatgagcctgtccctgctacaggcgggtgcccgcaagcttttggcctcacagtctcttcgccggatgctgcccgtggacaagtttctgcccatcatgttcgaccaggaccccaactagcgattcataggacacttttgggccctggacctgggggccttttttgtccaatccct

SEQ ID NO: 666092 - DNA, 569 bp, Homo sapiens
  misc_feature (361)..(361): n is a, c, g, or t
ccgggagccctcaaacctcgaaagtgccaggtgttagccaccatgcctggctcatctccataattcttgggacaactctacagacaaaactgagtaagtaagggctgggtgtggtggctcaagcctgtaatcccagcactttgggaggccggggcgggtggatcacctgaggccgggagttcgggaccagcctggccggcatggtgaaactccgtctctactaaaaacacaaaaattagccgggggtggtggcgggtgcctgtaatctcagctacttgggaggctgaggcaggagaactccttgaacccaggaggtggaggttgcagtgagccgagatcgcaccacagcactccagcctgngagacaagagcgaaattctgtctcaaaaaaaaagtattcgccttggaagaattaagggtctcaaactgctttcagataacaaacacacagctaaaagtacttacaaactgtattaactcattcaacaaatgtttgagagtctactgtgtattagttgtttatagagaacagcaatgaacaagaagaacagtaattatcaaaacttagt

SEQ ID NO: 666093 - DNA, 737 bp, Homo sapiens
agcggggtggtccgttgacagctgcggtcgccggagcttctcctctcctcgacgacctgaggcagagcagtcattatggctgaagccttggactgctgtcatgctggttgctctttgttggccactatggagtagacctgggccgtctcgcaaagcaagcagcccgaatgccttgtgacggattggccaccattgggtgagcacgaccgattaacctgtgagtgccatgggtcatgacctgagaagcttcatcgcttaccctacctcatgcggtcggacggtcgagcttgaagaggcatgcctctatgattgagtagagcgtagggtggcaagctctcatggctggtggacctggcgggcaagcactacgtgagtaggctggcctggggaccagggcttccatgggtgggatgggctgggggtcgcatggcacggtggcacccatcagctcagtgcaagcaagtccgaggtgagccatttaaataccagacatgaagcatcattggataggtgcttgcacgactgactggggcaggtgtgtgtgtgtggagcctttgcgtggcgctaccgatgaatggcgggggatgtggcccttgaagcgcggtcccccatcataccattatcgagcagatgactattgacggaccggtgtacctatcgttgacatgtacatgcacctgttaatcccgaagctgaggttgttctacagtgcccatggatgagtacaggaaccataa

SEQ ID NO: 666094 - DNA, 173 bp, Homo sapiens
ttttggaattttggggggggggtcctttttggggattatggcccccccccgggattttagggtagggggggggggggcccccctggcaaatggggcccccgggccccccgggggttgacaaaatcccccctttgtaatgtcctggggcccataaaacccaatggcggtttcca

SEQ ID NO: 666095 - DNA, 115 bp, Homo sapiens
ggtacccctagcaccttcctgtacaataaatacaaaaaatagccagtttgtggcagcacctctgtgttccagctacttgtgaagctgagattggaggatcacttgagcccagaag

SEQ ID NO: 666096 - DNA, 1471 bp, Homo sapiens
gcagcggcggcggctgctgggctgtagcggtgccggatgccgacgcggtggcgggcaccgcgggcaccgcgcactgccgctgccccagtgtgtcgccccggccgcgacgcacctttgtccgggggtggggcccgcctgctgattctgccgccgttcccctacgcaatagtagctagcgatgctccgggtagctagggcagctagcattctagggcgtttcactagggctcgtgatagggtggctcagcccttgtgtccccggtcggaaggttgagtacttcgtccgacacgagcgagtgcgtgcctgtgtggcctcgcgtactatggcagcgcttcggtttgaacgctcgcttgagaggcctctagggacaatgagattcattatgcgcacggtgttgccctttgttcatcgcacagtgggtgatacggtgtgctcagtgtcctcggatctgttcgtcttttgcacccggtggttgatgttgcacgtttctcgtgaaaggaggttgcccggaggtctacatctggacgggaatgccgcgagttgccaccatgcgcatacaaaggaggggtgttccccttatggcagggacgtagaaacgaggagacggcgaggacgcccagagagaaggcaacacagaagattagttcgtcgtttaccacattattttatggagacccacccacaatagggaagcggggacgacaaaccggtttattccacgcaccgcgtaatgggggagccaaaccgcacgccaaaataatatatatccaacgcgtttaggaataggtcatcacgttagagaccagagagccagaagggacactagtatttatcctatttcaagagatacccacaggcataaagtttctactcgagttggtgggaacaaccccagaggtggatagaagtaatcataggggcaacggcgcccagaagaaataacaagacgacaggagatatagaaccgcatggacggataaaggactcgacacagtaaagttatcgccacgtactcacacggattaccaggcgagtggaagagcaaagagagcaccccggccacagggtggacgggattaagccagacggataagggaggcgacttttaaacatcacatatcacgaagagtagagacccttagaggggagagatattaaccatattaacgtttaccagaaagtacagcagcaagaagaggagccataatagagagatatcagccattatcacaacagaagataaatacagccacatacagccagcggagtgagacagccaccccacgatattaggatataggcaccccagccatatatttcagacgagcagagcacaatatatagataagaaggtgaggtcgaagcaagcgcctgatatcacccaacagaaaggaatcatgagctaattaagacgcgcacataacaagtaattcaacaacatatcccagagggtcaagagaacagcagccg

SEQ ID NO: 666097 - DNA, 264 bp, Homo sapiens
cagagtctgactctgagctcaggtgatcaccgtgctcggccgtcccagagtcggattacaggcatgagcactactccgggcttacctccttcttaatctgaaatctatcttctgtatcctttcttctgtgtgaattgctcttcctgatatctccgttcagcatgtccttacccgtcagatacgttttccggctgtcggccgcctctatcttcgtgtgctctctcccctcgtgggctcctgcctttctgacaggtccttcttcct

SEQ ID NO: 666098 - DNA, 1813 bp, Homo sapiens
  misc_feature (1609)..(1609): n is a, c, g, or t
  misc_feature (1813)..(1813): n is a, c, g, or t
gagcagcggcggctggcgcggagagacgcagcggaggtttacctggtttcggaccccagcggccggatggtgtaaactccatcccatgcgagcggaatccatctaagtaggccactgcgttcggccaagacgagaaggaagggggcataaacgccatgctgccacacgatccgatcggtcgcaggccggcgagctcatgccggcatccataaggcgctgctgcacgctctgcgggcgtgcgagggaagtcatgtgcacgagttgccacgggatcttcccgtccatcctgtcatgtagatagagcctcgagtgtcctggagggctctcagcgatgggtgcttccatgtaatgccacgcttcgagactcaggtccccctgagaagactctcgcgagggtggggaacgtgaacgcgctacgattagtctccgagatacgtgcgacaatccacagaaatccggttttcccaggccttaacactgttgctatccgtctagacttacgcggaaattgataatcgggcggcgttgccaccattggttgagcacccaggccaggggcaaacagtgagactggctctccgaaacgtggaacctataggcactggaaggggacacaatttcccttcgaaagacggtttcgccaacggattccccaagtaggcgatcacgaacatcgtaacagggcccccagaagagttctgcccaagtatcagacacgatggtgatctggaaaatccaagaatgggacgtagacaagagtgtgacacggtgacgcacagaccattcctttaagcgaatattccggtcaggcaaattttgcgccgaaggttgcacgggcgacgggtctgccccatgacccactggggaaggggaacacgcaaggccccaacattggacaccgcagggcattttttccagcccagtgattctccgttgccgctggggggagaattcctcccggcgttaggaaggcgcaagaccgacgactttaggtcgtgggaacgtcacctggaatcgccaatttggttacgctgtttgccactacactgtgagccgtttagcccaacgtgaatatggcaaaaatcccggcttagaaagggagaccacatgtacgcacgccggggccctggtgcacctccccgtgacaaaaccctttttcaagtaccattatgtatggcgaggcatttgtgcagcggcacttcggtttgcatgaacaccagaggggatgacttccgacacctgtgttgtatacgcacgctgaaaggcaagaaaagacgcggagaagggaccatctgtgacgtattttcaactttggtgacctataaacagcgagctatccgcaccaacagacagcaaagatctcattatcacgggaggaaaacaaacacgcacacagcgagcagccgaacagcagacagagtagaaccatggcccctaccatgctgcagcgacctggcggagaattccacgaggagcgacccctcggagcgtgggccaaccccccccttttgtctaatagccaaggagttggggtaaaccggaacgcttgaaaaaactcccggtcaaatctcttccgccattgtgcgtttatgccccaacgcatatgtcntgaactctgactccgacaatagtaacacgcgtaaccaatccacgcagacaataaaccacggaagaaataccttgagaacgtaatcaatctgcagctgcttagcagcaacgtcagaagtcatatagagttaaaattccatacatgaataaccatatcatattctcaccacacacaatgacgctggggcgcacggtagaaagtacn

SEQ ID NO: 666099 - DNA, 112 bp, Homo sapiens
ttcgatcccaggaggacgcgcgacgcctgggatccgcgctaccacagttctaggagtggccgcatgcgcgccactgagccctctcccggaacctccgcgggtagtgttgtgt

SEQ ID NO: 666100 - DNA, 137 bp, Homo sapiens
tcgatctagacgatcccccgtgagacgacttcctttcgtacagggaggaattgaagtagatagaaaccgacctggattactccggtcctgaactcagcatcaccgtaggacctttacatcgcttgacacaaaacgaa

SEQ ID NO: 666101 - DNA, 105 bp, Homo sapiens
ggaaaccagctatgaccaggaaacagctattaccaggaaacagctttgaccaggaaacagctattgaccaggaaaccgctataatcaggaatccgctttgaccag

SEQ ID NO: 666102 - DNA, 207 bp, Homo sapiens
gatagcgtgatgtaacacgagaaagcacataccaaggccaccacacaccacctgtccaaaaaggccttcgaatacgggacaaatcccatttataacctcaggaagtttttttctatcgcaggaatttttcatgaagcctatttaccaactccaagcctagaccccataccccaccaatataggaaagggcacttggacccccacaaa

SEQ ID NO: 666103 - DNA, 369 bp, Homo sapiens
atcacactgttgcagatcatgtcaggatctgtaatagccagcacaggctgttgaccttcataagagcctcacacttttccatactttttatgacattccatgtctatacatgcataagtccttatggtaggtcaaaatatttcccaataaagtcagaggtgtgggccctggaattactagcttcttaaaaatgtccatgtgaatgggttccatatagatacaggagcaccagtctgacagccagtagaagccaggtttccatggccaagtctgggatcagagccatctagtactttcctaacttatctctctcctatgagtcttcctttcagctctgtgatgctcttatctgggctatgtgcatggagc

SEQ ID NO: 666104 - DNA, 271 bp, Homo sapiens
  misc_feature (40)..(40): n is a, c, g, or t
  misc_feature (66)..(66): n is a, c, g, or t
  misc_feature (93)..(93): n is a, c, g, or t
  misc_feature (96)..(97): n is a, c, g, or t
  misc_feature (117)..(117): n is a, c, g, or t
  misc_feature (142)..(142): n is a, c, g, or t
  misc_feature (185)..(185): n is a, c, g, or t
ggcacatgaaacatcctatcatctgtaggctccattcatnttctctaacagcagtaatacttaaantaacttttcatgattcgagaaggcccnttnntcgcttcgaagcgaaaagtncctttaatagtagaagaaccctccnataaaaaccctggagtgactatatggatgccccccaccctaanccaacacattcgaagaacccggtagtacataaaatctaggacaaaacaaatcggaacggaatcgaaagccccccaaagctgggttt

SEQ ID NO: 666105 - DNA, 298 bp, Homo sapiens
cgcgacatatacgtacctcagaggatagggatcgagccctatagtgcagacttgtctactgtactgtcactagctatagaccctcaacatgggggtagtaatcacaaggaagtagaacagcagagtacggtagattaaacctacagctattctgactaggagggccatgacaagcgagggactcaggaatacctagaaagtacctcaggaagattgtcgtggagggaggcgctggaggacagccgacctcataaaagtcgcccatggaaatcccagtgctcgacacctgaagcgggga

SEQ ID NO: 666106 - DNA, 81 bp, Homo sapiens
aagctccccgcaaggagcccctgaggaaactggtcgctttttgtcctagatataggggagtgcaggatggtgtggtggagt

SEQ ID NO: 666107 - DNA, 363 bp, Homo sapiens
agccaaagtttcgattgttggttctgtaccagctgatgcgaatgtaatatccacatcaccagatggtgcagtagatgcccaatcgatgatcttaaaaccttctgtagccaattcttcagcttcgtcagcagtgaaccattgttgacgtggttgctttgaagcaacaatcaagttaaccttttgacgttctgagaaggcacgtgcttgaacagccaacaatgagttaccatcggctggcaagtattcacggatgaagttagacttcttttcagccaagtgtgtcacatacctggatcttggtgtgtgtaaccgttgtgatcttgttggagggcagttgatgttgcaatcaagttcaatgatggg

SEQ ID NO: 666108 - DNA, 586 bp, Homo sapiens
  misc_feature (220)..(220): n is a, c, g, or t
  misc_feature (237)..(237): n is a, c, g, or t
  misc_feature (239)..(239): n is a, c, g, or t
  misc_feature (243)..(243): n is a, c, g, or t
  misc_feature (411)..(411): n is a, c, g, or t
agactacgattctgagctccgttccccctccccccgacggggtggccctgagattcttgattcacttccctaggcggtgcccctaggaaaccgggcttccctgacgaactctagcgtctccaaccccgggagggccctgatgacttggccttgtttaaaaggacctggcccttacacttccctgccggccctggccagggacaagggagcccctccctcnattgtttatgatatccncntacntggtttgtttgtcttttttttttttttgagacggagtctcgctctgttgcccaggctggagtgcagtggctcactgcaacctccgcctcccaggttcgagcaattatctgcctcagccttccgaggagcgggattagagacgaccaccaccaagcccggctaattttngtatttttagtagagatggggtttcaccatgttaaccaggctggtcttgaactcctgacctcgtgatccacccgcctcggcctcccaaagtgctgggattacaggtgtgagccactgcgcctggcctgtttgttctttttaagcaacaccttcccaccccgtcgggtggagcggg

SEQ ID NO: 666109 - DNA, 460 bp, Homo sapiens
ttacaggagagagaaaagtagataggagtctcgattccaagtgggcagtagggatcctgcagaagtggctgaaatgagataaggcctacagagaataagttctacagtcattacgtttctgcctatatcctccagattcaaaggcagatggggtcatctcgaaactcatgtctcctccaggacacagcaacaacacattttcaaggaacagcctcattatatgtaaaatctgtagagtataaaacataactgctccactgacaggaggttggatttggacttaatattgtattattctgtccttacattatggcttgataaacagaatgtgattccaattctgattccaaagtgagactctcccagatcatccatgtcttctcattctctttgtccctctagctctctctcccttctcatccccaccaagaagtggaacttgaacctgccattccctaag

SEQ ID NO: 666110 - DNA, 178 bp, Homo sapiens
  misc_feature (152)..(152): n is a, c, g, or t
  misc_feature (164)..(164): n is a, c, g, or t
  misc_feature (168)..(169): n is a, c, g, or t
ggggggggggggggggggggcccccggaacaggcaccccaaatttttttttttaaataaagggtggggggggggggggggccggcgggcggggggagggaggagagagagggggcgggagggccgagcaggggggggggggggcggggcccncggggggggggngggnnggggggggg

SEQ ID NO: 666111 - DNA, 378 bp, Homo sapiens
ttggaggaactggttgtccagcctctgtcggtatcagtcagtgctctgactcttgcaactgaaactgttcggagcatctctgaaaatagatgatgtggtaaacactcgataatctggataactgactagcaccatcatgatcaccagtatcgtggctgcaatggaagcagatcaccttggtgttcctcgcttggacacgattactttcctctcgaatttctcggcctggtctcccagctggcattcgcctgaagttctcttgacacaatttaatgaaaatctcacatatttggcttcacaaggcagactcatcttctccccacatcctgttatttctgatacttttgacaaactactaacaactactaaaagcagcgt

SEQ ID NO: 666112 - DNA, 117 bp, Homo sapiens
tgttaaagctaataaagcattcagcaggggacctctctcaccacaggaagttgaatattggatcttaattggagaatcaagtagtatcataccctgccattcactggaaaaaatggg

SEQ ID NO: 666113 - DNA, 743 bp, Homo sapiens
ggttgccacacttgctgtccccagtgctggggcccttggcgccactgtgagagtccctgtggccagcccccgaccctggtctcgggccccgagggagacctccttttgtcccggctttaggtatccccccgtggatcttcccggggcccccatgagatcctgagtggatggtgccgactgactccagactggagcacccactgggagccccgcatccccgctgtctggacatgctccagcatctcccccttctcctttggctggtcatcccgccggtgttcgaccatggcagcatctaccaccctggagtgcttgatatccccgaggaactctgcacttctcgcttcctggagggtgtcccccatgttgcccgtgtctgtctgccgattggctaccccactggtgcatccgtacccccttcctatcatcaacgggtaccaagcgagtctctggcgttgttctgtggagagcgggattacacctctcccacattgctggaaaggtctcaggccttctctggcgtgatccaatctgccctttgtggactgctgcccctgtgggtgctgccaccaccagctgctcctgctgctgctgcagccccacgctaatggttgtacccacaggaagagtcggaggagtcggacgaggatatgggatttggtctctttgactaatcacccaaaagcaacccaattagaccagattttatttgccaaacacaggcaataaggcttaattcttta

SEQ ID NO: 666114 - DNA, 205 bp, Homo sapiens
  misc_feature (8)..(8): n is a, c, g, or t
  misc_feature (111)..(111): n is a, c, g, or t
  misc_feature (141)..(141): n is a, c, g, or t
  misc_feature (189)..(189): n is a, c, g, or t
  misc_feature (191)..(191): n is a, c, g, or t
accatggnaggcagccctccctctccatactacctcaacccaccccttaagccacagatgaaagggaaaagaaaatgaagaaagcctacagaagggcccctgaccaagggnaagagctgcccccagaatgtgtgagtgtanccacaagatacaagtaactagctgtggctgagaggccagtctagactngnctctacatagagac

SEQ ID NO: 666115 - DNA, 238 bp, Homo sapiens
  misc_feature (79)..(79): n is a, c, g, or t
  misc_feature (81)..(81): n is a, c, g, or t
  misc_feature (122)..(122): n is a, c, g, or t
cccagaacatcacatatgtttatttcagatgtaacagcattgttaaaattgacaagtttaataaaaaactgccctggtncncttagttttttaagtctttttttaagttattccctccaaancactgagggagcttttcttttcccccaccacaccatggtttcccactagttctctttttggaggacttttcccttggtgagtaaactgctttagatctttcagaccttcattcccc

SEQ ID NO: 666116 - DNA, 146 bp, Homo sapiens
acacaggcaatgggataagccgagacacacagacgttgaagaggctgcagaaaagactgtcgtccatatcatatctggagccgggtttatgtgcatgaactcactcctcagagaccagggccatgtagtaacagctgggtaccgag

SEQ ID NO: 666117 - DNA, 604 bp, Homo sapiens
aggtgactctacaggatcctttactgtcaggcggattgcaccatgagccatcatgctggctgggagtttattttgctgtgcagaagttctttgtttaactgaccatggtcaattttggtttgttgcaactgctttggcatcttcgtcatgaaatctttacctggtcctatgtccagaatgatattccctaggttgtctcccagagtttttatagatttagattttacattttagtctttaatcaatcttgagttgatttttgtatatgattctggtacattgtctctttctcattggtttcacagaacttcttgatttctgccttaatttccttatttacccaaagtccttcaggagcaggttgttcaatttccatgtaattgtgtggtttcgagtgcatttccttaatcctgagttctaattttattgctttatggtctgagagactgttcgtcatgattccagttcttttgcatttgctgaggagtgtttcacttccaattatgtggtcgatctttggagctaacgtgtcatgtgccactgaaagaatgtatattctgttgatctggcgcggacaattctgtagacgtctactacgtccact

SEQ ID NO: 666118 - DNA, 357 bp, Homo sapiens
gcctgctgagtttttggaactacaggcatgcactaccacgcctggctaatttttggatttttagtagagatggggattcaccatgttggcccggctggactcgaacttctgacctcaggggatccgcctgccttggcctcccagagtgctgggattataggcatgagccaccacgcctgacccttgagtatacttaggaattctgatttattacctttaacggggacttaaagtattttaatactataaataatgatagggtttcgtaggaccaactctcctggggaaaacctgaatgatgttttatcaaagaaaacctgtggaaataggcagagctgccctgctaagatggtgaaa

SEQ ID NO: 666119 - DNA, 331 bp, Homo sapiens
  misc_feature (9)..(9): n is a, c, g, or t
  misc_feature (90)..(90): n is a, c, g, or t
  misc_feature (154)..(154): n is a, c, g, or t
  misc_feature (169)..(169): n is a, c, g, or t
agagaatgncaagcccggggagaaggcgttccgggcctcaaccttggcgtcgtgagattcttgtaaggcgtctgcctggaagccggcagnaattttccttctttaaagagaaaaagaaggctagggactcaaattcctggattctaagatccanaccagttcctcccanacctctccagaagaagccatgggaacccctcgtatccagcatttcctgatcctcctggtcctaggagcctccctcctaacctcgggcctagagctgtattgtcaaaggggtctgtccatgactgtggaagcagttccggccaatatgtttaactggaccaca

SEQ ID NO: 666120 - DNA, 148 bp, Homo sapiens
aggtattaaggatccagctagtgatttaggcgtaggtttggctagggtgtagctgagaataggggaatagtgaatgaagctctatatggcaatacagctctattgataggacatagtggaagtggtgtaaatgtagtacgtgtcgtgt

SEQ ID NO: 666121 - DNA, 108 bp, Homo sapiens
aacctgcaaccttcgctgagcgccctgagcagcaatatgcaagacattcgcgaggtgctggcgcgctgcgccggcgaggaagaggaggaacgccttaacggcggcgaa

SEQ ID NO: 666122 - DNA, 704 bp, Homo sapiens
  misc_feature (54)..(54): n is a, c, g, or t
  misc_feature (136)..(137): n is a, c, g, or t
  misc_feature (159)..(159): n is a, c, g, or t
  misc_feature (197)..(197): n is a, c, g, or t
  misc_feature (222)..(222): n is a, c, g, or t
  misc_feature (236)..(236): n is a, c, g, or t
  misc_feature (238)..(238): n is a, c, g, or t
  misc_feature (240)..(240): n is a, c, g, or t
ttgcatatggcaaggccaagcacgacaagtacatggcggacatggacgagcttntttctcaggtggatgagaagaggaagaagcgagaatccccgactacctgtgtggcaagatcagctttgagctgatgcggganncgtgcatcacgcccagtggcancacctacgaccgcaaggacatcgaggagcacctgcgtntgggtcattttgaccccgtgacccngagcccctgacccngnancagctcatccccaactatggactatgaagtgaggttattgacgcattcatctctgagaatgtgcatgggtggaggactactgcaggtatccctgccctacctggctgtacctggtccaggggagccctgtggcagaagcccccgagcccctatacatagtttatagttcctggccacctcagaacgcttccacccaagttactgctcgtatgagactctggactgtgtatccccttactcagcatacgctttagctagggccgtgatcggtcaccccttttgtgggctggaataagcagtgtgcactggtgggctgggctagatggcattagccggacaagcggattcgtgtggtcacttcacatatccggtgaacgccacggaatagccagagcaaataaaaagcactcctcaaagcccaccccggagacaccgtaaacatttacagcacaaaaaaaatacgc

SEQ ID NO: 666123 - DNA, 460 bp, Homo sapiens
ggtttctttcaagttgaaaagaaactggttattaggccactatcatttgaaactgccactagtgctcaaatgcccatatgctatcccaaagatttcctgagtctgccagaggcccagacaggctcacttaagctctttaactgaaaagcaacaagacactccaggacaaggttcaaaatggttacaacagcctctacctgaagccccagggagaaaggggtattgatacaagtcttatagtcagagattgttttacactccttctaaatattcccagaggctgaaacaggaggttattttcaattctattttggaattaaatacttttttccctttattactgctgtagtccctcacttggatatacctctgttttcacgatagaaataagggacgtctagagcttctattccttggccatcgtcaacggatagcttgccgtctttaccccttgctacct

SEQ ID NO: 666124 - DNA, 791 bp, Homo sapiens
  misc_feature (54)..(54): n is a, c, g, or t
  misc_feature (136)..(137): n is a, c, g, or t
  misc_feature (159)..(159): n is a, c, g, or t
  misc_feature (284)..(284): n is a, c, g, or t
  misc_feature (309)..(309): n is a, c, g, or t
  misc_feature (323)..(323): n is a, c, g, or t
  misc_feature (325)..(325): n is a, c, g, or t
  misc_feature (327)..(327): n is a, c, g, or t
ttgcatatggcaaggccaagcacgacaagtacatggcggacatggacgagcttntttctcaggtggatgagaagaggaagaagcgagaatccccgactacctgtgtggcaagatcagctttgagctgatgcggganncgtgcatcacgcccagtggcancacctacgaccgcaaggacatcgaggagcacctccaggtaaggctgcggctcggggagcagagccactggcatggtcctcgggccccatgacggccctcggcccttcattgtcacatcccgcgtntgggtcattttgaccccgtgacccngagcccctgacccngnancagctcatccccaactatggactatgaagtgaggttattgacgcattcatctctgagaatgtgcatgggtggaggactactgcaggtatccctgccctacctggctgtacctggtccaggggagccctgtggcagaagcccccgagcccctatacatagtttatagttcctggccacctcagaacgcttccacccaagttactgctcgtatgagactctggactgtgtatccccttactcagcatacgctttagctagggccgtgatcggtcaccccttttgtgggctggaataagcagtgtgcactggtgggctgggctagatggcattagccggacaagcggattcgtgtggtcacttcacatatccggtgaacgccacggaatagccagagcaaataaaaagcactcctcaaagcccaccccggagacaccgtaaacatttacagcacaaaaaaaatacgc

SEQ ID NO: 666125 - DNA, 118 bp, Homo sapiens
tctgcgcgctctagagatcccgacaggccagcatgtattgtttcccaatacaatgaagacttgaaaacaaggatcaagacctgacttaggaattcgtattgagaaccgacaggacatg

SEQ ID NO: 666126 - DNA, 1303 bp, Homo sapiens
  misc_feature (183)..(183): n is a, c, g, or t
gggtgttccatctcagccccattgctgagaacaggatgactggcacgaacaggccctggccttgtgcccagccagctctctgtgttgcgcccttagagcctctgcgccctcagttccgtcctgctcttgtgcgcaatttccagacactctttcagaccagtggccctgaagcccgtatagccntcttcctctactcatgtcactcctcgaacaaacagaagcaatttaagggcatgctatcgtcgttgtacggcgttggtggtgcgttgtgacactttcgagagaatttatgaagaatcattgctccagaccaacctctgagatagggctattccataagaacgccggcggcgggcgtgcttccgggttgtccgccccagggaggggggccctgcttcctttgctgtcccccttgttattctctcttggggccagcttggcggcctccggttacccctgagggccggcgatgtgtatgctccccctacggcggggatggcacgagcccatttggccaggctttgcgggagcggggtgggccaaccccattgcggcgtcccctggcgagtggaagcaaccctgctcgggaggggcacgggagcacccgtaaaccccccccggtgcgagggcgcgggaggcccgtatagtcttgtggaggcggcctccttgtgcgccacggttcaaggcggcgtcctattttgtgcgcacacgcgcatcgtcatacacagccaggggataccctttgtttgccaggtttggtgtggggcctaagggttggggttacgccttggtggggctctggttccaacttcccaatggacgctttgcggtttgttggacccaactcgggtaccgcccctttaacagaagaaagaggtacttcccggggcaaccaattagcacgggattcagctcacttgttccccccacagaacgaacttgtcctactgccacgccgcgaggagccaacgggctgactgtgaatcaccaataccttccccttgggcaagcagctggtttgaccttcattcccccatggcgtccggggacgcacccccccctttggttggcgcctttccaaatttgggtgacctccaaatgttggggcgtcccctttgtgttccatgtttgttctggtcgtggaaatttttaggttcccgtggggatgtggaacgctttcccctggccgggcttactttccttaggtagtggatcacgcttatgctgtctttatgccacaaatggtgccttttatctacctggacacgcgaccagaggcagtctctcacgttcacgccgagac

SEQ ID NO: 666127 - DNA, 599 bp, Homo sapiens
ggagacggggtctcccggggtagccagggatggtctcgatctcttggacctggtgatctggcccgcctcggcctcccaaggggctggggattacagacgtgagccaccaggccgggccgggaattttctagtaagaagaaaaacatacagaatatgtcttcagggtggggtaactctcaaattggtagcaatccgagattttttggtaaaactggggctaatggggatatttaaggtcagagttatggtctctcacttcaatatctagtacgggataaggtttctccggggagcacgtatttttttttcaagtcctcttttccgggacttaacatgttcttctagaagacaccagaagtcatgaccctgagacccggtctccagagggggagagggggtctcaatacggagctggcatatctcagcctataacggatttcagtcatctgagtcaaagattagggaaaggtcaataaaaacggcgagcgctcttaggtttttcttaatcagatggctccacaaaattgataaagactttaataatgatcagtggtgaaataggtgggcctctagaaccttgtgtagaacatgggccaaga

SEQ ID NO: 666128 - DNA, 425 bp, Homo sapiens
cttagaggatccctcgattcaacctgaggtcgggagttcaggatcagcctgaccaacattgagaaaccctactgagaatacagagttagccgggcattgtggtgcatgcctgtagtcccagctgctcagtgagcctgtgcaacaacgagcaaaactccatgctcaaaaaaaaaaaaaaaagaaaaaaaagctggagctggtggcttaggccatcacccttcccttggtctggaactacgggccggcccttttagagatgtgcctgtgttgctgtggagatgtgtgtggtggtctaagctcttgtgtggagctgtgtgtgtgtgtggtgtagtcttagctgtatgctgaatttgggcgtgtgtgggagggcttcttagcctcttgggtgagatttggtattcctatgtgtaggatcgagctagggt

SEQ ID NO: 666129 - DNA, 1855 bp, Homo sapiens
  misc_feature (233)..(233): n is a, c, g, or t
  misc_feature (369)..(369): n is a, c, g, or t
gacacaaggtgttcgcagtcagtttagtcaaacccaatcccattatcctgtaccttggtggcgcttgcgtactattgctctcatctcgtaaactgtatccttcggtctcgtagcgcatgatcattatgtctactttctcggtcccaataagaccgtcttcactcattaacttgacgccctatcattgatgctgagcagcaccgtaacgcggcatactccctaatgtgtactgngacgtgcaaactgttcatctacgcgagcatatacgtcaacactatccaagggcccaccctatacagcccaccgtggtctgcatcaatagggcgcattctgcacttctggtgcgataagtcgcgtaattctatttancttcgatgagagacttttttatgcggtatcagtccgcgaggactctgtgtacctccgatcctattattcacccactatccgagacgcaatggtcactctctctcaccacactccagaacatggctcagggggactacatggagatctccctcgcaaacaagcgaccttactacctcactctgtctatgacaaatgccctcacttaaggtaaggattcacccgaaccaaacgcatatgaagggaactactcacagattatatcaacattccgcaacttaacgcgtaggatagagccaaacgcgcaccactggcagggctctatccgcaaccatagagtctgataggtaagggagacaccagggacaagggctgtatagagcacgcggtcattcaacagtgccaagacgaacgatcggcgcacatattaatattagcaagaatcctcccacaggcttggggggacaatcggaacttccagtgatcgccacttacccccccaaccaatagggcggcaattccattgtatgtcaattctcttctcagagggtttccgccacaaccaatatagcgtatgccctaggaaaacaacccctgtacagtggtaacacaaatatgctatatttgtgggcaatcacagactaacactataacaacagttcacccgaactagaaagaacgacacacaagtctgtacattacgcaccaaaccgttggggattaatccaccaactggaatcaatataacttctcagagaggacattcgaacacacatatatacaccaaacccaacaggaaacgatcggggccaatgagtcgggacaccgcatacgaccgtacaactacattgtgctcagcatgtgaagacaaggtgccaaaatcaaccacaagaaaaatggacaaaaagcgaacactgcggcggcacaacgcccagaagaaatccgcgggcacacagcggcacagaacgaatgacacaacagtcagtaaacgcagagagtaaacgacagggcgaaaacaaaggcgcacaaagacagcgagcaaataccgacacagacacaagaaacaaggcagcagagcaccacgagcacaaacaagaacggaaccacgacggaggagcgaccgaacgaccaacaaaagcacgtacgcgaaaaagcccaactagagacaagaagagggagcacgcaacgaggacaacgagggagagaaaaccaacagcacggtagaacgccagcacagatgcacagccgacaaacgagaacaacgcaaacaaagaaaacagagccgacgacacagacaacagggagagcacagaaggaggccgcagcacccagcaagccggcacgagcagaaacagcagaggacaaggaagccccgcaggacagcgacagagaccacaccatcgaaaaaccgacaagaaagaacgagcaagggacacaagcaaccagaaaacgaacaagaaccaagacaaagcaaataagaagtcacgaa

SEQ ID NO: 666130 - DNA, 130 bp, Homo sapiens
gacgtgaggacccctcggatgcaagggtcagatctcgtcagcatggagtactggagaagaaaaacttcctccacagtctgaatacggacgggtggtcgcatgcactctgatagaagtctctgtgcactct

SEQ ID NO: 666131 - DNA, 160 bp, Homo sapiens
tagactgtaaatgtattttattttgtaagtggcaatcaaaatatatttgtgctactgattttttcaaatgttaaatgggatcttaacaaaatttgtccactttgatgtgttcatgtataattttagaatctgcagagaccctgactaaagaaacagaagt

SEQ ID NO: 666132 - DNA, 380 bp, Homo sapiens
ggcgcctgaccgacatagtgccacgatggacgggggtattgtgcaggtttcgcctgctccatcgcaattgcacctgatgatcgcagcgatgggcggctttgtgcatgcccatgcggggttacgccgcgtcgtgcatggccctgcatttcccgactggcaaattctcgatagctggcgttgtagtgggaggttggagtggcgacactggttttgaccgcgtagggcacggcgattggcgggcccgtcggcggtgctgttggggccatgcttggccagcagctcgatcgcgctatagttggaaatggggccccgccgcgacgggccgcgcttgctggaactggaactgcaaacgtcgagttatggcacttgcattccagcga

SEQ ID NO: 666133 - DNA, 1328 bp, Homo sapiens
gcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccag

SEQ ID NO: 666134 - DNA, 629 bp, Homo sapiens
  misc_feature (15)..(15): n is a, c, g, or t
  misc_feature (127)..(127): n is a, c, g, or t
  misc_feature (170)..(170): n is a, c, g, or t
  misc_feature (225)..(225): n is a, c, g, or t
  misc_feature (228)..(228): n is a, c, g, or t
  misc_feature (242)..(243): n is a, c, g, or t
  misc_feature (261)..(261): n is a, c, g, or t
  misc_feature (274)..(274): n is a, c, g, or t
  misc_feature (287)..(287): n is a, c, g, or t
  misc_feature (291)..(291): n is a, c, g, or t
  misc_feature (293)..(293): n is a, c, g, or t
  misc_feature (300)..(300): n is a, c, g, or t
  misc_feature (320)..(322): n is a, c, g, or t
  misc_feature (345)..(345): n is a, c, g, or t
  misc_feature (418)..(418): n is a, c, g, or t
  misc_feature (424)..(424): n is a, c, g, or t
  misc_feature (428)..(428): n is a, c, g, or t
  misc_feature (479)..(479): n is a, c, g, or t
  misc_feature (482)..(482): n is a, c, g, or t
  misc_feature (500)..(500): n is a, c, g, or t
  misc_feature (588)..(588): n is a, c, g, or t
aagtaagcacaaatncgtattagaaagaatttgtccaaaaagaattaagtccaataattttaagatggctcaagtgtcaagaggttccctccctgtgcccccactgttgcttcatgcaggtgaatanagaaggaatgaaatgcttaaatattcttaattagtcagaaaanattgaaatgcaacagttgggcaattacaaaaaataaatccagagaggtcaaaacntanattagccatttganngtggctctggtgtctgcnaaaaaaagtagcnattgaaaaaacanagananctatgangtggttcactcattctagannnattttcattttcctcccgaaaanccccccagtccctcaccgagccccggaccttcacccaacacggctgccacgctcaaatgggcctgattcaaantcccangtangtccctggcaccagggagtaggataagaaaacctccagaagtgaaactgangangaagtgacatttaatcanttcaaaaccgaaacttcactggcaaggtcaaaaccccaggccaaggctgacaatcgagcgctggtcagttccaggggtcaggctcggnacctgaaaatgcagatcctagctgttgctgcgtccctcagg

SEQ ID NO: 666135 - DNA, 3804 bp, Homo sapiens
ggcacgaggcacagctcacgaggctcagctgtcctccatccttccccctgtcctttggtgcctctgtttgcaagatgtgcagaaacaccagagggccagaggagaccctccttttactgaatgctggcagcctcctgagaaccacgtctgccagcagcagagagcagagagtgtggacgagcatgggcgactgaggtcccaaatggcgcgagccgctgggccctcctgcttgtgccgatgtctcaggctcgattgaagctggaagaaaccaaggacaatgtgtcctttaaaagtgtaaggttagaaggtgccctgactccagccgacctggaaaaggacgtgtcctgcatatctggaggtggcccacagggtccgggaaagatcggctgccttgcctgcatcccagggcgcttcccggcctccattaagaggtgaccattgcatccacgtgatttcttttgctccactatttccaggcacagtgcaactgactccctcttgaagctagaatgccctgcacacccgggatggacttctctcccctttcaaagatcgagtgaagtttgcaaatgtgaaaggaaggaattgcatttccagtggtaacctttgaaggggaatgaaattgtcacaggacgtcaggagccacgtgggggagcccggtgtcctctgagtctcaacgccccttgcttcccgcttggtgacggtcgatggctgtgtccagcggtgaacgctttaccacaggactctacggtggggtaggcagcgccacttcaatgtgaagacaaatgaactggcgtctcttgagataggcccctgcctccaggacctctcaggccccgggccctggttactgccgtggaagctgcctgttcagacgtcatctctatcaccccttgaagggagacagagaggtgtttgcgagttggatgttttatcttgtctttcctgattctttgttagaacacccccagggcttggtttttgttctcaacctgtgattagaaataagatcctaaagtgtcagatctggaaggcccatgagagctgaggagatcaaatgcccggagctcgggagatcagatgacctggggtgtctggagccagtggtggcctcatctgcagcatcttcctctgtcctgcccaccacagagtccctgctggccccggggggcccctcctccgccacagggcccctgagcattgctgcgtttgtttctccagctcctccttcctgcagaagcagttcccagaggggcaatttctccagcctgcctggttggttgtgttgattggttatagttgctctttcaggtgaccgcagaccctctgaaggctgtggccgtgggtgtggctctatggccacctctctctcttctcctctcccaggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccgagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggagtgagggcctactgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtatgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttc

SEQ ID NO: 666136 - DNA, 1585 bp, Homo sapiens
ggcacgaggcacagctcacgaggctcagctgtcctccatccttccccctgtcctttggtgcctctgtttgcaagatgtgcagaaacaccagagggccagaggagaccctccttttactgaatgctggcagcctcctgagaaccacgtctgccagcagcagagagcagagagtgtggacgagcatgggcgactgaggtcccaaatggcgcgagccgctgggccctcctgcttgtgccgatgtctcaggctcgattgaagctggaagaaaccaaggacaatgtgtcctttaaaagtgtaaggttagaaggtgccctgactccagccgacctggaaaaggacgtgtcctgcatatctggaggtggcccacagggtccgggaaagatcggctgccttgcctgcatcccagggcgcttcccggcctccattaagaggtgaccattgcatccacgtgatttcttttgctccactatttccaggcacagtgcaactgactccctcttgaagctagaatgccctgcacacccgggatggacttctctcccctttcaaagatcgagtgaagtttgcaaatgtgaaaggaaggaattgcatttccagtggtaacctttgaaggggaatgaaattgtcacaggacgtcaggagccacgtgggggagcccggtgtcctctgagtctcaacgccccttgcttcccgcttggtgacggtcgatggctgtgtccagcggtgaacgctttaccacaggactctacggtggggtaggcagcgccacttcaatgtgaagacaaatgaactggcgtctcttgagataggcccctgcctccaggacctctcaggccccgggccctggttactgccgtggaagctgcctgttcagacgtcatctctatcaccccttgaagggagacagagaggtgtttgcgagttggatgttttatcttgtctttcctgattctttgttagaacacccccagggcttggtttttgttctcaacctgtgattagaaataagatcctaaagtgtcagatctggaaggcccatgagagctgaggagatcaaatgcccggagctcgggagatcagatgacctggggtgtctggagccagtggtggcctcatctgcagcatcttcctctgtcctgcccaccacagagtccctgctggccccggggggcccctcctccgccacagggcccctgagcattgctgcgtttgtttctccagctcctccttcctgcagaagcagttcccagaggggcaatttctccagcctgcctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccag

SEQ ID NO: 666137 - DNA, 775 bp, Homo sapiens
ccgaagtgggacgtaactttgaaggtgcttgtaggtattagctctgctaggttgtaccatcatagcaacgtagatttcagcagctatgcgtgactgagcacgtacattcatagttcttcaagatacgttatattgtccagaatccaccccgttcacccaagcataagacatacagtagacataacttttccatcttataacacgtcattttactgtaaccctgcttgcatgcaattatagataccatcccattccagccgtcagaagtcaggaccatcaactgggcagttggagccccagacgagaatacaatcttctaacgtatccacagataaaatggctaaggctagcacttatggtaccatgacttaatacttcaaacacaatcttcactacatcttccatcatatatcacaacgtcacagtacttggacttcccactaaacggggacaaactaaacatgggagtgatttccctcccttctagcggcaggtaactgccaacagcagttgatggacacattcttctaaatctttgacggaacagataaattgactatcccccttgacaggagctatacatatgcgacctgttattcacaaataaccatgttagtgccaccaagttcaaatccgtcatatttaaatcacttaagtttgggtactggcgtcaaaatagcgattggtcttacagcataacaaatcaagaagtgaaatttggaggttatactccaagaaaagtgtgtaaacagtggtgatatggacaaatagcata

SEQ ID NO: 666138 - DNA, 363 bp, Homo sapiens
gcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcaggtagcggtgaggaggggaagggcgcgcgctgcggcggcggacagggccatggagtgggcgggactggggctgatggggcggtgcctggcccgac

SEQ ID NO: 666139 - DNA, 641 bp, Homo sapiens
agcggaggtttgctacctgatcacctcctgaagatgtagggttgacgatgtgtcacactgtgtaagggaatcgcatggagatgggcattccgaactgtgaatggggacatgggactccagttgtctctgatcacttgtgtggattattcctggcgtagtaacgacgaagccgttagttaagtcgccaagacctacacgcagagaattctgcaccaaagggcataaaatcttgtaatattaattggcatctgggagaatgtctgagcaggaggagacctgaatcaggccaatagcagaggaaggagggactgagcaggagacggccactccagagaacggcattgttaagattcagaaagtctggatgaagaggagagactggaactgcagaggcggcgtgtgaggctccgaatcaatgaaacgaaagaagatccaaagtcaggaagcaggaaaagggtagaacctgactcgcgagatcttgctgtctgtgaggaagtcttctgccatgaccagggaggtgaaagtcttcaggatccaggaatcgattcatttacatgctttccagtttctaccaggcctgcaagaggaggatagaactctaggagagatgactctgagaagacgaaaacagaacccggata

SEQ ID NO: 666140 - DNA, 3436 bp, Homo sapiens
gcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccgagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggagtgagggcctactgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtatgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttc

SEQ ID NO: 666141 - DNA, 3970 bp, Homo sapiens
gcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccgagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggagtgagggcctactgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtatgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttcattcttggctacttacactattcatgataatcacagagatacttggacaaagaaatatattgggcaaaagcaagaatttccttcttttttttttgagacggagtctaactctgtcgcccaggctggagtgcagtggcgcaatctcggctcactgaaggtccacctcctgggttcccaccattctcctgctcaactcccagtactcggagctgaggcaggacgactgcttgagccaggaggtcgaggctacagtgagctgttgacggctcgactgcattcaagcctggggagacagcaagatacgtgctcagaaaaaaattatcctttgaagctgcgcttttaacaaacaaaaaaaggcggcggcaaaagaaccccagaggccaaactaacgtacccgctttggcacagggcccaacgaaggggacaaagaagcggcggcgaacacggcgggaaacgactcggagattggacgacacaccggtgcaacggaacaccagctccgccgcgaaaacccgcgtacaccacagccacgcc

SEQ ID NO: 666142 - DNA, 825 bp, Homo sapiens
  misc_feature (749)..(749): n is a, c, g, or t
  misc_feature (784)..(784): n is a, c, g, or t
  misc_feature (807)..(807): n is a, c, g, or t
tatatgctagttgtaggaaatatagttattaaaccagactcccagactataacctgtgaaaactgtagattgcttacttgcattgattcaacttttaattggcaacaccgtattctgctggtgagagcaagagagggcgtgtggatccttgtgtccatggaccgaccgtgggaggcctcaccatccgtccatattttgactgaagtattaaaaggtgttttaaatagatccaaaagattcatttttactttaattgcagtgattatgggattaattgcagtcacagctacgggtgctgtagcaggagttgcattgcactcttctgctcagtcagtaaactttgttaatgattggcaaaaaaattctacaagattgtggaattcacaatctagtattggtcaaaaattggcaaatcaaattaatgatcttagacaaactgtcatttggatgggagacagactcatgagcttagaacatcgtttccagttacaatgtgactggaatacgtcagatttttgtattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtacttgggttaagacccattgggaagtnctacgattttaaatctcatattaaatccttggggngcctggtttggccggtggtaagnctgaagggggaccccaaa

SEQ ID NO: 666143 - DNA, 3337 bp, Homo sapiens
gcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaaggccctgcgtgcacccccaatgctgctggcccacaaatcaccgtgggccacggccccaccacaccaggcttggccctgtcagcggccagcatcccgagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggagtgagggcctactgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtatgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttc

SEQ ID NO: 666144 - DNA, 803 bp, Homo sapiens
  misc_feature (107)..(107): n is a, c, g, or t
  misc_feature (182)..(182): n is a, c, g, or t
  misc_feature (214)..(214): n is a, c, g, or t
  misc_feature (223)..(223): n is a, c, g, or t
  misc_feature (233)..(233): n is a, c, g, or t
  misc_feature (237)..(237): n is a, c, g, or t
  misc_feature (803)..(803): n is a, c, g, or t
gtacactggtttctcgtatgttacggtggtattccggaactgggtttgtataatagctgccattggagacttccaggcaatgaaggcatatgtttgtttttttaaanggaaacaaactctcaaatcatgaagtgatataaaagctgcatatgcctacaaagctctgaattcaggtcccagtngctgtcacaaaggagtgagtgaaactcccacnctacccccntttttatatnatanaagtgccttagcatgttggtcggcagctggtcaccacttacaggaaagctgggtttacagatggttttccactggagcatcacaataaagaggaccaggtgctaaaaaaaaaaaaaaaaaaaaaaaaaaaaaaaaaaaaggggggcggggggcaaaaaataacccccaggggggcgcccaaagctacgcgccacccattttttgggaaaaggggggccaaaagagaggggtgtgtctatttatatctaacgcataagagcaggggcacgcctgattataacaaagtgtacggtggtgcttgagggaaaaaaccgtggagaaagagagggagattcttcttttgggaagggaaaccactaattatatttggggggggagcagaaaaatatagtgggcgagaaaaaataccatatagaaaattatataagacgttcgaggaggaaaattaaataacattataacggggtgttatagtgtgctaacaaaaagggattattctggctgttagaacaattcgaatacccaagaatgtgttctggacattcttaccagcgatgtatataggn

SEQ ID NO: 666145 - DNA, 3649 bp, Homo sapiens
gcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggatgtttttgtttccggatgatgtcttgtgggttccaagaagttaatggaccgagagccagtgaagctgctggtgcgaaggctggagtcaggtgtcctccggggactcaccacccgcccgagaggggagagacacatgcgattctggaagctgagagcattgcttattgttgattccttggttgccgtgctgagtcctgctttaaggaagcaggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccgagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggagtgagggcctactgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtatgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttc

SEQ ID NO: 666146 - DNA, 322 bp, Homo sapiens
  misc_feature (107)..(107): n is a, c, g, or t
  misc_feature (182)..(182): n is a, c, g, or t
  misc_feature (214)..(214): n is a, c, g, or t
  misc_feature (223)..(223): n is a, c, g, or t
  misc_feature (233)..(233): n is a, c, g, or t
  misc_feature (237)..(237): n is a, c, g, or t
gtacactggtttctcgtatgttacggtggtattccggaactgggtttgtataatagctgccattggagacttccaggcaatgaaggcatatgtttgtttttttaaanggaaacaaactctcaaatcatgaagtgatataaaagctgcatatgcctacaaagctctgaattcaggtcccagtngctgtcacaaaggagtgagtgaaactcccacnctacccccntttttatatnatanaagtgccttagcatgtctttgcttgtctgtctattactatcagtaagctgtgtttaccgatgttctgctagagcagcacacatta

SEQ ID NO: 666147 - DNA, 154 bp, Homo sapiens
gcgagaatgattatatactatattttagatgagtagcatcagatattgtaaggagtctatacttctataacttctgtggttaatatatcctctcatagtacacatcactagttggtaaacataatggtaatagctaatgtattgaacacttgcc

SEQ ID NO: 666148 - DNA, 3352 bp, Homo sapiens
  misc_feature (8)..(8): n is a, c, g, or t
  misc_feature (10)..(10): n is a, c, g, or t
  misc_feature (13)..(14): n is a, c, g, or t
  misc_feature (16)..(16): n is a, c, g, or t
  misc_feature (18)..(18): n is a, c, g, or t
  misc_feature (30)..(31): n is a, c, g, or t
  misc_feature (33)..(34): n is a, c, g, or t
taggcagntngcnngncngggtgtttaatnncnnactcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccgagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggagtgagggcctactgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtatgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttc

SEQ ID NO: 666149 - DNA, 242 bp, Homo sapiens
ccgcctcagcactcaagtatctgggattacaggtgtgtgccaccatgcccggctaatttttgtatcctttagcagagacgggtttcaccatgttggccaggctggtcttgaactcccgacctcaggcgatcctcccacctcagcctcccgaactattgagatcacagaagtgagccactgcgcccagctcacactgttctttattttactttttttacttgacttttttttttttatgatat

SEQ ID NO: 666150 - DNA, 3378 bp, Homo sapiens
tacaacaaagaaacgaacggcaccaatattataggtacgatccgggtttaatcagccgaggctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccgagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggagtgagggcctactgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtatgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttc

SEQ ID NO: 666151 - DNA, 388 bp, Homo sapiens
  misc_feature (54)..(54): n is a, c, g, or t
  misc_feature (89)..(89): n is a, c, g, or t
  misc_feature (108)..(108): n is a, c, g, or t
  misc_feature (130)..(130): n is a, c, g, or t
  misc_feature (196)..(196): n is a, c, g, or t
  misc_feature (210)..(210): n is a, c, g, or t
  misc_feature (310)..(310): n is a, c, g, or t
  misc_feature (381)..(381): n is a, c, g, or t
ggattcatggaccggatcagttaccaggacataggagtgattcctgccccaacnaaccgcattcgggtggattttttatcaacttaatngctattccaaagatttttntttcctatttttgccgattganccccttaagatccacgatggaattgtgtttgccgtttttggtaaaggagcaaaaccgaggacctgnagataacgctggancatctccttggaggattcagcacgagtagatggtaacattttaaagggaaagggggggttttgtttaaatagtaatcagtaagtcacttctaatttaaanaaacaaaattggagttgaagaataagtaggtttccaattgctattgcccgttttctttgaaaaaataaacnatttttt

SEQ ID NO: 666152 - DNA, 124 bp, Homo sapiens
ctcgaggagttacccgactagcccgacagactttggatcctgggcgagatgaagggaagagggttgttttggcttcggacgacccttgctcctgaccggaagagaagtccctatcccacacctg

SEQ ID NO: 666153 - DNA, 116 bp, Homo sapiens
agaggaacgttgggtgcctgcccttatgtacaaacagagctctgaatttgaggcgggaaagaagactagcgtcacactccatgttcacacgaacattgctgggagtcagtttctct

SEQ ID NO: 666154 - DNA, 989 bp, Homo sapiens
aaaaatgtgtgtatattagtctgtcagggcgttgtgttggaggacgcagttcacgcactgacttgtgtctattcctctgcccaggtgtctctgtttgctgcccaaggcagtcagttcatgatcatcggtccatgtccatgttcgtgcttcagcacttacgtgggaacattgtaccacctttgtcttttctcctagtatcagtggtgttccatcacaaatctttaacgttctcgtcctcatttgcttatcctatcaggcgtaatgtaagtaagtgaaaagaatttaactctcctgcttcatttctttgtcttatagtcctcccgtctttgcagcctgtcttctcttccctcagtgcctggacgctggtactgggcccctggccccatggagcagttctgccttcttgagtcactgacctgtgtaggtacatacctgaccgggagtgcaaaccaccttgagtgcgtactgaaggtccacatgatctcatcacgacctttcttagcctggctcctctcaagggcattctgggcttgtaaacagacataggaagcctctgtataacctgaagcaccatgtgtccagtccgattggttccccactggcagcactggtaagagctgagagaaaacaggcgtctcagggtaccctgacttgagagggactcgttctcatgaagctcgaacttcgacgcaatatgtccagatacgttctttcagagatctgctatccccatcccaaagtattaagaccccaggccatttccactgaagtgtacttcaccaactgaatagcgacaaggacactgactcatcgtgcaactcgacaacttccgagtgcgtcccgatacgctccgcgtttcacttgatcgcccgcgtccggcacccttcggcgccctaccccaagggaactcgaaccgcctaccgaccgccagcagcaccactccgccagcgcccccaccctcatggcccaccaacccctccacccaccca

SEQ ID NO: 666155 - DNA, 188 bp, Homo sapiens
aagctcggccctcctacctgggcataagagctcttccttggcctctcaagtgctgggattatagttgtagccctacaacagccttagaatatttaaaaaacaaagcaaagccgtggtgtttcctgaccctcagactggaccctaacctcctttgtttcttttcttgttgagacagagtctcagctctt

SEQ ID NO: 666156 - DNA, 439 bp, Homo sapiens
gagtgagaaaactgacgaagagaagatgctagtaagtgagtaaagcttggattcgaatgtgggctctctgacttcatagtttgctcttaaccactagacactagttccttcttataatcatatgggttctttaaaaaaggaaggtgaggctgggcgtggtggctcacgcctgtaatcccagcagtttgggatgccaaggtgggtggatcacttgaggccaggagttggagaccagcccggccaacacggtgaaacccggtctctactaataatacacaaaaattagccggggatggtggcaagtgcctacaatcccagctacttgggaggctgaggcaggagaatggcttgaacatgggaggcagaggttgcagtgagctgagaacacgccactggactccagcctgggtgatagagccagactccatctcaaaaaaaa

SEQ ID NO: 666157 - DNA, 535 bp, Homo sapiens
  misc_feature (18)..(18): n is a, c, g, or t
cccactgactgtggcccnccgtgatcatcctctcagggacaagacagagcgcaggaatggaagcggagtcctaacaggatgaaggttcccccatcagttcccccagtacctcaaggcaagtagctttccacatttgtcacagaaatcagaggagagcgggtgttgggagccctttggagacgcccagtctcccaggccccctgcatctatcgagtttgcaatgtcacaacctctttgatcttgtgctcagcatgattctttaatagaagttttattttttcgggccctctgctaatcatgtgggtgagccagtggaacagcgggagacctgtgctagttttacaaattgcctcctaatgacgcggctcaaaaggaaaccaagtggtcaggagttgtttttgaccccctgttttctcctcccccaaggaaaaaagtttaggagaaaccagcttttctggtttttgaaaaattacagcttccccctgtcaagttaccaaggaaggcctgggcccaaaaaaggtttttcccccttgga

SEQ ID NO: 666158 - DNA, 270 bp, Homo sapiens
  misc_feature (180)..(180): n is a, c, g, or t
gtcctttatgtatattccctagcctgtcaccagggggccttgtgccgtttgctccataatattgagcacattagtaccctttctgcttccactttcttcactgtcttagtctgcttggctgcttacaaaataccatagactgggcagcttaaatcacagatatttatcctcacagttctngaagcttggaagtccgtgattaacgtaccagccagtttggtttctagtgagggctttcttcctggcttgcagatcgccaccttctcaccg

SEQ ID NO: 666159 - DNA, 965 bp, Homo sapiens
ggtcgccggtagcgcaggacacgggcgcggctgggtggggctgcggtgcgtagtggcgccgggatgtctgcggtgtgcgcgcatgccgtgagtgtgcgcttttggagagtctgcggctggaagtgatgcccggctcgccgcccgcggtatggagctacgatcgcgccatcaccgtcttctcgcgccgacggcacctcttccaagtggagtacgcgcaggaggccgtctaagaaggggctcgcaccgcgtgttggtgttctgaggaagagacattgttgttcttggtgtggatgaaccaagtcagtggccataactgcaggatgaaagaacacgtgcggcaatgatctgtgtctttggatagactcacgtctgcagtgggcctttgcagtgcctcaccgccgatgcaaggatagtcatcaagcgagggcccgggtgagagtgccagagccaccggctgcactgtggaggacccggtcactgtgagagtacatcacccggtacatcgcagtctgaagcaggttatacgcagagcaatgggcgcaggccgtttggacatctctgccctcatcgtgggtttcgagctttgatggcactcctaggtctatcagactgagccctcgggcacataccagtgtcctggaacgcccaatgccataggccgggcgtgccatcgtcagtggccgtgatgttcctgggagaagaactatactgacgacgcgcttggataccgcatgatctgaccattaagctgtcatccaacggggtcctggaagtggtcacgcttgtggcacaaccttggctttggtgtctaaggcggatcatcctcagatttcaatctggcaccagtgaccgctgtcgttcacttgcacgcaacccacactcgggactcctcggcgggaagcaggacgcaccatggccatgtcccccctcttaaggagagggccaacgagttcagcgcacgctgc

SEQ ID NO: 666160 - DNA, 162 bp, Homo sapiens
ggccatttcatggttgatttgctagggtgcgcttcaattaggtgcatgcagtaggtggctgcagtaatgttagcggtcggcgtacggcaggctattggttgcatgagtcggctgatgttcgctaataactagtatggggataaggggtgtagggtaccgagc

SEQ ID NO: 666161 - DNA, 137 bp, Homo sapiens
gaagcggagagagcacatatgctcagaagaggcaaatagacattagtaaattcagtggtcgaaagtcaacttaatgaaatcactggatcaacaggcattcgtttttttttgaaacggagcctcactctgtcctcagg

SEQ ID NO: 666162 - DNA, 185 bp, Homo sapiens
ctgaggttctgtggcctgttgtcagtcctgagctccctctttgccaactttgtttatgttgtcaccagaactctccagcgcattcaaaggatgagaattgtggacccacataccctgccaaggtccctctgccagggaagcattggccggtttttcagtgctccacataggatcctagacaccgg

SEQ ID NO: 666163 - DNA, 102 bp, Homo sapiens
tgtcgaccttctgctctggacacctgagcttatccaaggctgatactctgctcacacacagggactctcctggactctcagccatggtcttggctgagcaca

SEQ ID NO: 666164 - DNA, 403 bp, Homo sapiens
tattcctgagctgggcctgagaaacaaggggagaaaaggtgacagattatgaacattaaaaaaaaaataagaaaaatgtcatgtcatggccagaagttgcaggacagctcagggcctgtgcatcagggctggcctaggggttacgtgctaatttcactgtgctgtggccaccaagccccagacccagctgcacggatggaggcattccagacggaaaagccccattaggtcatcgctacgccgcctgcaatgccgttcagccttccgctgtgtaatctccagcacactccggggagactgtgaatttcagacactctcccagggaccctggctccacaaagcatgaaatgaattgcattcatccatctgtgggcttttaaaaaattcaataattaattcaaaa

SEQ ID NO: 666165 - DNA, 163 bp, Homo sapiens
ccactggtgttactcgcctctgcgagcatcacacatctcagctgcactattcgagctggactagtgtgtcagcctcagtctaattactcagtacaaagggggaatgatcatatccatgcacataggtttacagctctcaggcctactgcacggaaaacattgt

SEQ ID NO: 666166 - DNA, 1107 bp, Homo sapiens
ttattagtataaaaggggagataggtaggagtagcgtggtaagggcgatgagtgtggggaggaatggggtgggtttggtatgttcaaactgtcattttatttttacgttggttaagatatggggagtagtggtgattggagtgtggagtaagattagcgcgtaggtaagaatgtagaggttaagagagggtgatgggtggctatagatgggggggatgatagaggctatgtgtttttgggtgaattcttcgataattggcccattttgggcaaaaagccggttagcgggggcaggcctcctagggagaaggagggtggatggaattaagggtgtaagtcatgttagctgtgtttcagggtgcgaaatagtagtagggctcggtggtgctggagttttaagtttgagtagtaggaatgcggtagtagttaggataatataaatagttaaattaagaaagtggttatgtaagggttgtacggtaaaacgtgctattattcatcctagtgtgggtaattgaggagtatgctaagaatttggcgtagctgggttgggttaaatccacctcaattgcctgctatgatggactaagattgagacaagtgaggaaaaggcttacgttaagtgagggaagagattgggcatatgattgacatgggggctagtatggtcattgtgagaagaagcaggccggatgtcagaggggtgcctgggggtaaccttctgggactcagacgtgaccgggggggctattcctaatttatggctatagccatttgatttcgtcagattacccatgcaagctcccgttcccgtgagttcaccctctatatcaccaggatcataagggacaggtaaagcagcagaatgccgtcaaaaaggcttagccaagcacaagcccccggggaagcaccgcggtgattacccctatgcacaaacggcaggcttacacagcataataaccccgcgggggccactctgtgccagccacacggctgtagagtaacacagcaataacacggcgcaagaggagttatacaccccccgaaagaaaccactggatgaacagcgtgcgaaacaacaacgagggagcatacatcaacgcgacg

SEQ ID NO: 666167 - DNA, 288 bp, Homo sapiens
cagctatggtgatctttgctttttttttttgaaatggagtcctcatgttgcccaggctagagtgcagtggtgcgatctcagctcactgaaacctccacctcccaagttcaagcgattctcccgcctcagcctcctgagtagctggaattacaggtgtgcaccattatgcccagataatttttggtattttcagtagagatgggttttcaccacgattggccaggctggtctcgaacttccttgacctcttgtgatccgacttccttcggttctcccaaatgtgctggg

SEQ ID NO: 666168 - DNA, 330 bp, Homo sapiens
  misc_feature (97)..(97): n is a, c, g, or t
ggagccccaaactggaaatctgagaaccaggccttccgctttgctggtgcagggtcggctccgccctcccccacctgtgtgtccacacccagtcctngccctcggggatgacaccatcctgccaaggcgctagaagtttcccagataagccaggtgggctcggttcactcccactctcccaggggtgctggcctccccagggtttgccttcttacggatttaacgaggttgaggctcacctatcagggcagctctcaggattgtcattttcctcttgctgtgggttaactttgtatttttttaatccaagtttatcaaatgttttatgta

SEQ ID NO: 666169 - DNA, 530 bp, Homo sapiens
gctcttttataacatgtgcaataaaaagaggtttagtcaaaagagaccaaagcccatgtcatcatcagactcctcggattctgatgatgacatgggctctcggtttgtctaaagttcagccttcatatctagaacatgttgagtaagaagacgttcgcgtgcgtgcgaagactaaaatgccagtgtccatgtatccagcacgtgcctccgtgatatctgacattatcgtcataggtatctacaactgttcgtctactcgcgtcacctgggcgtaagcagcgggcgcaaaggcgcgcaagacgtcgctgcatggtgcacggagcccatgattgacatagggagtcgagaagtccagactccgggactcccgtacgtaggacatggattgaacgggtctctcccgaacctgttgcgaccgatttggagggcgagcggaaccttattgtagaaaaaagaaaaggagcaagcggcgcaaaacaaggggagtccaaacgaatggtcacacccgaggctcgcactcgaacttggag

SEQ ID NO: 666170 - DNA, 156 bp, Homo sapiens
taagttactcctgcggtgcacgcctcccgttacatagttcctggtcttctgtgagcgcctgtgctgacctccaacataccgttaatctggagcctcggtaggcgttcctcctgccctgctggtgcctcccatacggtgccctctctcccctctctt

SEQ ID NO: 666171 - DNA, 490 bp, Homo sapiens
  misc_feature (15)..(15): n is a, c, g, or t
  misc_feature (107)..(107): n is a, c, g, or t
  misc_feature (116)..(116): n is a, c, g, or t
  misc_feature (430)..(430): n is a, c, g, or t
  misc_feature (434)..(434): n is a, c, g, or t
  misc_feature (475)..(475): n is a, c, g, or t
  misc_feature (478)..(478): n is a, c, g, or t
gaaaagggtatccgnaagttaagccctactgtccctgggccatcctctctcctctgcctcccccaacatacctgctctgccctaagcccacccagggcctcccttancttcttcanatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaaaatcctttgcacctcaagttaggggttccactggtctcctgattgtgtctattgatattcctctggtcttgtcttgtataagttgttactgttttcctaacttcattttaaattctcacgcttaaggaccatgtntgantagtttcttttatcccccggtaggaaatggcagtacttatnctntatcgtgtccac

SEQ ID NO: 666172 - DNA, 230 bp, Homo sapiens
atcgtgtacacccttccagccaggtcctggtattgggggtctttgatcaggatgtccccgagcagcgacgattggagttaccctaagctgtatgagccgggccagctgaaccttcttttcaacaagcggagtttttcatctgcatcgcccagggaatcttacacctcccgtgcttcatagttcttctattccctatggggggttttgctgattccaccccgggatgatgg

SEQ ID NO: 666173 - DNA, 150 bp, Homo sapiens
cgagacatggcaaccatccgatttctgtgtggaaagaggtagacacggaagaatttttcttgagtacagaacaaaatgaaaagtctcccgtgtctacctgtttgcaactgaagaggtagatctggatatcttggtaagatttcttaggtt

SEQ ID NO: 666174 - DNA, 155 bp, Homo sapiens
tgctgacggtcgcctctagacggatcccctagtacgagacgggatttcaccattgggaggccaaggcaggcagatcacaaggtcagatcgagaccatcctggctaacatggtgaaatcccgtctctactaaacaaaattaaaaaattagccaggc

SEQ ID NO: 666175 - DNA, 491 bp, Homo sapiens
  misc_feature (407)..(407): n is a, c, g, or t
atgggttccccctttataaaatgggcttttttttttcagggccagaaaataaaactttcttttgggcagctgctccagttttgtccaaaataatttttttcccacccttccaaaaaacatttcggcaaaaaaaaaataattcccgtaggagcaggcaaacctttctttctttccgggggttcccctagaacctgccggaaaggggaaagtccggggggggggtccccaaccccaggggggccaaggaaaaggtcaggaaataaaggattgtcctgagccctcctggccatgggggccgacccagggggcactgaggcacttgtgggcaaaggctggaggcccatccccctttgtggggggcaaaagctgtcctggaaggcccaattgggaagggagggggtgcttangccttctttaggaaaaaccacccactccattgggcttttgaggaaaggctctctggggccgggcttgaagggggggaatacttt

SEQ ID NO: 666176 - DNA, 520 bp, Homo sapiens
taaacatttctcagatgtaaatggaaatctaataaaatctgtgaaaggtatttttaaaacagctttattgaggtgtgatttacataccataaaatccacccacttccagcaatttcagtgatccacccacgactcaatgatttcagcgcaaccatcaccaccctccaattttagaaatttccatcacctcgaagtcccttcgcagccatgagcagtcacttcctcttcccacccccagccctaagcaaactctaacctgctttccgccttgatagatttgccttttttggaaattccgcataaatagaatcatacaactggtagtctttggtgtctggctgctctcactgagcataatcctttgaggttggtccacactgtagcatcatgggtgggtagttcttataattctctcccattgtacggcaaagccatattttgtttagccattcaccagctgatggacgttcgagccgtttccatattttggctgttattaataaagctgctatgaacatcc

SEQ ID NO: 666177 - DNA, 1052 bp, Homo sapiens
ggccgcagcatttggcgcgccgtctgtgtgtgtgttgtttccgcgtcgtttgaagttttctctgttgtgatggggccgccgattgtgtttcttcagcggccactgtgttcctctccatgatgtgtcctccggctggttctgttagtgtcggccatctgcgtcgctggcctcgcattgtgtgtcgctgtgtgtgctccccccgcctccgtcgtttgttgcttggatgatgggagggcgtctgctgttctcgttgttgcggactgagccccctcggtgttttttcagtgttgttccgtccgctgtctgtgtgcgtcatttgctgccctgacctgcttgtgcgcttgctacgctgtgcgtgttgcccccgtctgctcctatagtttgctgctctctctctggggggcgatattattcttcgcccccgacgaggagggccttcttcttgggggggatctctcccgcgtgggcgcccgcggtaagtagggtgggtgattattctccccgcgctgtgcgttttccacgctctcgtgttttgtgccgctttgaggaggcgcacagaggcccaccgcgaggaagatgttgtgtctctccccgtttccctctctggtctctccccgtctctatgtgcctctcgcggagtgctcctcgcgtgcgtctctgtgagaggtgtgtatcccccctctactctgggcgtctctcccacctcctgggccctctctcgggaccctccacacggcgcgactggtggtttgttgcgaggtgatagatgaagtagagatgaaggaggactctggggttggctttcccctcgtccccgcccccctctctggtggcacttgttcccttcccacctgcttatattttttctaccccacgttgctattttttctcggacccaatcctctgtaagagtatgtaaccactcccaaggcccggaagggcctcgcccgtggccggccttctggttggaggaatggtaccacgttttatttgtacccggtgcttaaaccccacccccccctaaaaagaaaatgggaaaacaaaaagattta

SEQ ID NO: 666178 - DNA, 956 bp, Homo sapiens
  misc_feature (521)..(521): n is a, c, g, or t
gctcctgtcacagaaaagcaaaaaaaaaatagagagagaccatagaggagggttggccagccctgttggtcgggtgggatgtcagagacactttcccagaataaagtaagagttaaccctgcacctcaggtgtgactagtgggtgtcagtggtatgtgatccaggctgggtgagccagagtgtggatgcatggtgccaactccacatcctatctcctgtttctaggccctcatcctcccttgtacggtttaatgtggcggggaagctcagccttcgctgtggagtggacagagatgcacagagctcttccatccttgtgttggcctcttgaccccttgacgtggccatgtggcaaatcctccactagtccccttcttgcccatccaatccctcatgtccccaattctccattgctccccaagcatagatcttgggggccatcatatgcgctaactgaggtaaacatattcaaataacattcataccatatcatctcatcgaaatcacattgcgaaatatcnctagatccttatcacttttattatcactaccattaaagatctccttcgcaaaaggtaacacagaagagcgacaaacatctcaagaaaccctacaacaacaccacatcgaacggaccatttttgggttcccctgcgaatagcgcctatatcttgcacagccccacggccccgttgacctcttggatagggttctcaaccaaaggcattgaaccgttgcagctgcacgaacattgaacggttctagcgcacactttgacctgtgggcgccccccgggcgctgttgtaacgactattttccacgaaaaactataggcggactttataccaaccgcgaactcgttgcgtgtagacagcacaacagttatataaacgtggggaaaagggcgaaaacggccttttgcccaatgtggtccaccgagaaaaagggcttcgcca

SEQ ID NO: 666179 - DNA, 192 bp, Homo sapiens
agagaaaggtgtgattggtattgttaatttagacgagtatgaagctgtggatttcctgtcgataacaggatgtaagagggtttgctcagtggaataaacgtgtttcaccagtattggctgtagtttcccagtttcagtaaatcgttgtcaacagttcctattaaatgcaaataaataagttttaaaaggtca

SEQ ID NO: 666180 - DNA, 868 bp, Homo sapiens
atgattaaactggcctgagttgaatgaaaggataatgtatgctcaacctgtgactaacaccaaggaggtcaagtggcagaaggtcttgtatgagcgacagccctttcctgataactatgtggaccgcgattcctggaagagctccggaaaaacatccatttgctcggaaataccaatattgggctgtggtattggagtccagtgtggtgatccagcagctgtgcagtgttggtgtttggtggtatctgggtgtatatggatgagggtcttctggccccccatgtgctttagggactgccgggttcttcactgatgcgtatgttggttggatctcattgatggatgtgtgaagggcggaagaagagtggccagacccggtgggctgacctgaagagtgcctagtcttcattcacttccacttatgggttccaccagtgctgaagacccttacagagtctgtcagcactgacacacaatctatgccatgtcagtcttcatgctgttaggcaactcatcttttgtgactatggtgcaatgcgtgccaattgtatccaagaaacctatcctttgaacagtggccatctgggcttctgaatggcctggatcacggtctccccggcccgtgatgcctttcaatcatggtggccttggcatcaagaatttggcgtggggccatgtggcggacgaactaggcatgacccccggagcaagggggacacgggcatggacttaaagcggaggacgcatagccacataggaggggacgcgaccatggctacggcacagtacacacgcgggacccaccctcggacggctaaaacacacggcgggagagcaccagacaaggcggccgaaagaaacacaaacc

SEQ ID NO: 666181 - DNA, 1167 bp, Homo sapiens
  misc_feature (130)..(130): n is a, c, g, or t
  misc_feature (132)..(132): n is a, c, g, or t
  misc_feature (176)..(176): n is a, c, g, or t
  misc_feature (308)..(308): n is a, c, g, or t
  misc_feature (316)..(317): n is a, c, g, or t
  misc_feature (355)..(355): n is a, c, g, or t
  misc_feature (357)..(358): n is a, c, g, or t
  misc_feature (364)..(364): n is a, c, g, or t
  misc_feature (382)..(382): n is a, c, g, or t
  misc_feature (392)..(392): n is a, c, g, or t
  misc_feature (493)..(493): n is a, c, g, or t
caaatcagaaaggaaaaattagcattgtctcttgttgtgcagactacagtttttattacataggaaaacccgtaaaggactccagttaaagaaaacgtatttaggacgtaataacggtcaggtcaaaatngntcgggatacaagtcaagcatacaagaaatcaggttgaggtttcngtatacaacaattcttgtctggaacaaaacattagggacacaacaaggtcgcactttactaacagggcagacaaaagaggcagaaagcattattcacaggacggggcaacaatactttggtttacacagganacaactanncgaaacgggttgcatggaacatttaaacaacgaatacnannagcagnactcggacaggattatcncgtggtggcnttcatacgacttggcacaacgcacgttaatcattgggttcaaacagtgttcagataactggcgcgcaagaggtagatcgtaacaggatttcaagtggtacnatccctaatcagaattgccgcaatgggaacttcttttaataggaacttaggaacaaagatacattgctagaaactttcatatcgggggagtacagaaagtaccgtcgaacataagcttaagaacgagatctttggatcaaaggagggaaacagaactgtaggaggggcattcacgactgtccgtacatgttcaagagattgtattttccaaaaggctcatacgggtaataagcgtatagacacagtgggatactacacaggtgttgctcattcagcaaagaagtgattaacgcatggtgaacggggaatgcagtattgcttacattcagcttagtgtacgtttattgcaagcgattgggtatgtcagtaactgtgtaaaaaagcagatacgcagtttcacttacccactggggtgtagaaagttaccgaaccaaaaaagggtcttgtcaagtccataaattcccaaagtaagaaacacgaagcaagcacaaacgccaacgaaacgacaccacacagcagacacaccacacatatgtgtcgcgagcacgccggcgcggtggcggcccgccagggagaacagacgctcgtcagagagaacgaagaaccgcgtgtagatggaggaggagcggccgagacacgaccgagcatgaggagcatcagatcggcacactagt

SEQ ID NO: 666182 - DNA, 267 bp, Homo sapiens
  misc_feature (9)..(9): n is a, c, g, or t
  misc_feature (24)..(24): n is a, c, g, or t
  misc_feature (43)..(43): n is a, c, g, or t
  misc_feature (68)..(68): n is a, c, g, or t
  misc_feature (141)..(141): n is a, c, g, or t
  misc_feature (162)..(162): n is a, c, g, or t
  misc_feature (221)..(221): n is a, c, g, or t
gtccaccantgtgaagaaggtcgntgtttcccctttggccttnccgccatggagtgtaagtttcctgnaggtctcccagtacatactggctggttaagcctgcagaacggtgtacttgtttgaaatgtatctggcccaatncgactgagcgttccgcgctgncatttctccaaactgcccagcagggggcggtgctaacctcggctccgcgcagccacggnttcccgctggcgaaccaaggggcgcgggaaatctggaaaaggcgag

SEQ ID NO: 666183 - DNA, 432 bp, Homo sapiens
gaacacaatgtaagaatgaatggttggatcagaattgcagttataataattggccagtatggagaattaagattttttttgatcaaggtaggctaaatgctctctggcttcccttgaattcaatgctacagggggcaacaatctatggcgccagatagctgccaaaaggttgaacgtacgtatcgttaggatcataaggaaagccatgagtgaaacatgaaacgttaaattttatctgtgaacatacaaacaccatgttatgattatggattttttggggggcaattcaggcatacaataattaatttcagagttctggcagcttcatctaaccaacattttttttttctttacatcaaacgccctgtgaggagtgctacgcaaacaagcataacaccgtataaaaacgacgtcgacgcggccgcgaattta

SEQ ID NO: 666184 - DNA, 798 bp, Homo sapiens
agcgggggggcgcgaaaatcctcggaagatgtggcattacataccgacgaccggtacctgctgcattgagagcagaggcgctgccactaccgctgccccttcgagggaacattgccgggtgcgccatcttcctagtcgctactgtctgcagcggcggagtgccgtgagtcggtggactcagtgcggactggtgcattgtgttgggtaccgggggcgcaggaggatacgagatgcaatttccttctgacaccgtaatctttgtattggcagaccgccggagaggacgaccgggaccttgacgctccgccttgggcgcgaattcctccttctcctcctcctcagtcaaaggctgccggtcgctcctgccgttcgaagagccgagactatcggaaagggaggatgaacgacggacaggctcttccttgcacgcccacggctgtcttcacgaaagaaccggggcggcgacgatagggccggaaggggggtcgggagagactccccattatcttccgacgtgtcgattatggatgtgcccagacggggactgggttgtcaagggaaaccgggtacagacccggaaccggcccggattacaaagacgtggcacccgcgactttggcttgcaccagatgcctggatccccccttcgaagaccatattcacaacgtgtgccaattggcgacgtacaggcggactcgagacaacgaatggctgagccagcaaggcttataccaacgatatcaccatggtccatgatcgctcctcctgggcgcgtagggactcattttactctctaac

SEQ ID NO: 666185 - DNA, 822 bp, Homo sapiens
atggcggctggcctgacggtgacgactcgctgtaccccatcgcggtgctcatagacgaagctcgcggaatgaggacgttgcatgcttctggctcaacatcgatcaagaagctgtccaccatctgccttgtgcccttggggttgaaaggacccgaagtgatgcttctgcctttccttacagataccatctatgatgaagatgagtgtcctcctggccctggcagaacagctgggaaccttcactaccctggtgggagtgcccagatgtacgtgcactgcctgctgccaccggtggagtctgctgtgccacagtggagtgagacagtggtgcgggacgaaggcagtggagtccttacgtggccatctcacacagagacagcgtcgccctctgacctggatggcgcactttgtgccgctagtgaagcggtggctgggcggctgagtggttcacctccctgtacctcggcctgcgtgcctcttctccagtctgctacccccgagtgtccagtgctgtgaaggctgggaagttcgaccagatacgtccggaacctgtgctcagatgacacccccaatggtgctggtgtggcctgagagcgtccaagcggggggggagtctgtcaaaggtgttgggagctggacaacgtcaggagtgacgatcatgccccatgttctccaaagcctggctctgacgagcaggatcaggggcggtgttgctgtggatgggttcgtaacacgccaattctgcccagaagactggacccgggtgtccattggccatgcatgaaaaagctgcgccggaatagaggcgtcacaagccaaaggg

SEQ ID NO: 666186 - DNA, 203 bp, Homo sapiens
cccttctggcatgctgcgccacatcgtccacgaaggccggcgcacccgcagcctgcggcccacctggctgttccaggcggctcgcacgcgcagcgaacgggcctttgacacggagattgccgaactggtgaaggccggcaatgccgaggtgcactgggtgcgaacgctcagccagcccggcacggcaaaggccggccgcgact

SEQ ID NO: 666187 - DNA, 433 bp, Homo sapiens
  misc_feature (301)..(301): n is a, c, g, or t
agaaaactcaacggatccgaggaatattttattctatctatatctgcttgaacctcgactttcaagaaaatttttaaaaacaaggcctgctgacacagttacgggcgccctgctatgtgaggatctgtgggaaagtgactctccctccttggattattgggtgacacactagctacttcatacctggtgcctgaccactcttgaaaaagatacagctgaaaactcagtccaggaggagaaggacctgtgatatttggctttcccaggaaactcctacattccttctcaagatcaaatctanaaacaggtttgtagaatattcactccagctctaagagatggcagaaggttgcagggagtccattgccaggaacacactttcctcagtctcgtaaatgaaactgcacagatggcaaagctaagcaaagggcac

SEQ ID NO: 666188 - DNA, 506 bp, Homo sapiens
gagtcggaagctgctgactcccaactatagcgatgggcacttggcccctgcttttcctgctcagaatagcctccgccgcgttcagagattacgggtacttgcaatgggacaggtggctgctggctggcccaagcaagagagctgaggtatccaagacatgtccattgggggtggtggtccaggtgaggtgcagcattcctgtgtatgctggcagcacttgaagagcgggtgcagggggtcggggcagtgtaggtcctggggcagcccatttatgcgttatatgccccttctccctcatagcctatatcaaaagtcgcctttgctgtcagatcaacctcaaaactttgaatcggatcagagattctgattggctttaaagaggtggatagaagaatattggaattgcctttatattatgcatgaatgtctataattttatctaaatgactgcgctgtaacacattttgtgtgagacagttgaaactgttagtgtgggggataagatg

SEQ ID NO: 666189 - DNA, 334 bp, Homo sapiens
  misc_feature (45)..(45): n is a, c, g, or t
  misc_feature (47)..(47): n is a, c, g, or t
gataattctaagatctgactgatctggggaatgctgacatccttncnagctctcactctgggagaagcatgctaccacgttgtgaaaagccctatggagaggcccacatgatgaggaactgaagctttcagccaccagccagggaggaatggagccctgtcagcaaccataggaatgaacttggaagcagattcaccagcaacagcctagctctggtcaacagctctaacagcctcatgagagacctggtagcagaaccatgcagatatgctgctttttgattcctcagaaactgtgagagaaaataaatgtttgttttttaaaactgagaaaa

SEQ ID NO: 666190 - DNA, 108 bp, Homo sapiens
aaatctttaggatctaggaataggcaaacagaacttttatttatttgtttttttgagaaggagtttcgctctttttttgcccaggctggagtgcaatggtgcgatctt

SEQ ID NO: 666191 - DNA, 158 bp, Homo sapiens
  misc_feature (55)..(55): n is a, c, g, or t
  misc_feature (63)..(63): n is a, c, g, or t
ggggctgggctctgcgggcgatggggcggcagcatgcatgcttctcgcgctgtgnactaggcncaaggggctctacttccacatcggcgagaccgagaagcgctgtttcatcgaggaaatccccgacgagaccatggtcatcggcaactatcggtacc

SEQ ID NO: 666192 - DNA, 104 bp, Homo sapiens
tgtgggaacccgtatccagaggggagacggcagctgcctttaggggcagcaggatggcatgaggccccgtaggagtacaggctggtctgaatcgcttatccaaa

SEQ ID NO: 666193 - DNA, 565 bp, Homo sapiens
agtttaatgtcagggttggtcagaccatactatacatgctgtgagactttttcatcctatcaggtttattacatttattgtacattattgatttagaaactcataaactacctttcgttaaaattacattttcaaccaaagcaagttattggaaataaaaagcactgtaggaattatatatatatgtacatatatacatacatataattgtatatatgtacgtatatgttatatatgtacatatatgtaaatatataattatatatgtacatataatatatgtacatatataattatacatgtatattatatatgtgcatatatacacaaaacatacaaatatatgtaaacatgcacatattcaactatatattatatcaattatattaatatattaattgtatagtaatataattaatattaatatattaatataatatataatcacacatgtgcatatatacatatatctggatgttatatatgcatatatttatatataaatatgtatccatgtttggatatatttatataaatatacatttatatataaatacatatatcc

SEQ ID NO: 666194 - DNA, 112 bp, Homo sapiens
agcgctcgataaatatcgtagctttctccacttcaagtcaactatgactcataatagttcatgctgtcataatttatgctgtaatagtttatgctgtaatagtatatgctgt

SEQ ID NO: 666195 - DNA, 976 bp, Homo sapiens
agggacaaccgcagctgcgcgcaaagtgcaggccttgccggggggacccggagctcctggggggcaccccggagactccgtgaccacgggcaccgcggaacagcgggaagtacctgggaccagcataatgccgctgcgcacgcgagaagcagaagctcgtggagaagatcatgggaccaatacggctgtgctaggagcctgtgcccctgccccggaccaaagaagggcagactggctggcagacaagggtccccttccccggcacccatgcgccgggcccagagctccctcgtgcctgcgggatgagaccttggcaggcgaggcagcaggcggaaactcagctcaaggttcccggtgggacgaagcatatgagatcacttcaggcctggggacacaccctaggcaacgattccgacagcgccatccaggccacctgggggcgcccgtctcccagcagcaaaggacatggtgtgggatgggagaacctcgcgactgagaaccatgcagcgaacagcgaaaccagatgccaaccgagagggccccgaggtacaggaaccggagaaactgtcccactcaccccatccctcagccagtgacaccgtgggaacagcaggcttcgggagtgcagccttctcgggcactggagtgtcagcggaggcccacaggcagcccaagagctcagggagccaagggaaccccaaggggagtcacttggacaaggaggccatgggcccgtgagagtcctaccacggatcagcgaccggaggcccggagatggaagctgggacgagtcgtgtgtacaggggggatggctggcccccacgagcagctccaggctggagttctggttattcacaggtggctcccgttgaggcagcaggtctcctggagggatcccccatgctgcaggaggctggcaggaattggcaagagaacccagtgccatgtccaggtgggaagctgagtcccaggttaa

SEQ ID NO: 666196 - DNA, 442 bp, Homo sapiens
ctgtggcgatgctcttgcctcatacaagcgtaaggaaagcaaaatgcatcaagtactggtgtctctgggaaggggcgcagaatggctgatgcccactgagtggtggacagagaggggtgggttaaggcccagtacgagggccgactctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaag

SEQ ID NO: 666197 - DNA, 352 bp, Homo sapiens
tggagagagatagcaacgctacacactactggatctggcaatgatttattggatgtaccgccaaaggcacaggcaacaaagaatagacaaataggactgcatgaaaatttttatttttttggagacggattctggctctgtcgcccaagcttggtctcaataacaccaacaaataaaatgaaccaaaaaaccctccctaacttcacatcttattgatttagcaaaaagaccaatctaaccccaaagctagcagcaagaacggtcattaagagcagagattaatgtatcaatgcaaatagagcatatagaaaaacaataggggaaaaaaaatatcaatgttcgtccctttccg

SEQ ID NO: 666198 - DNA, 1630 bp, Homo sapiens
  misc_feature (260)..(260): n is a, c, g, or t
  misc_feature (1378)..(1378): n is a, c, g, or t
agtaagaactagatgaaaaaagcttaggtccgtcttacgtgccttctcatgtggacgcgtatagattcacttgactaggcccatgaacgacgaaccgttcggtggtggtggtcgcgtcgtagtaggtgtcatgggtgtgtggtcaataccactaatcttttgacttttgtcgaaccgccgcgcgattgtgtcgatgtgaatctgtttcttgtaaaacttcgtggtaatacgtggtcttttcgagtacttagcattccagntatgtaacactgtttctttaagtacttcgactcgaagtgggcacgagagagtgaagtcagtggtccatataactatagtgcatataatataaatatatcctttcctccttctgtgtagtggagtcgtgaaatattcagtgatgagggtgatagtgggtgtggaaattgcatcactctttctcgtttgtggggcttgggatgaggggattcccttctctattcttcttataattattcttgactcgtgtatcgtgtgtcgttttgtgaggggtctgggagtgcagtttatgcgcgagcccccaccgttccgcgcgtttggcgttcccgttccgttttcctcccaacattgggacggcacacataagtttcgttccccgtgatatcatttgtgtgtaagttatcagcctttttcatgttgttgtcagtaattatcttcccgtaagtttttaattcgcaggttatattggaggtttgcatatctacttaaaccctttagcggtaagtttgtgggtacatttccgggaaactggaaccttttcaaatatatataacacacaaatccacatgggtgaggggcttcaagggtctttgggtggaacgctggtgttggggaaacttttttccccaacaatggggtaaccccttggttacaaaagcgtggggacataactccagtggagagaaacccactgggacttctccaattcaaggacaattaatttatttccccccccaaggacgcgcacccggagttgttaacgtgatgacttaaaaaccacggtgtccccgtcaagtttggcgcggtctaatcttcccttttatcggcgccctgtggaaaacaaagaatggtatcaagcgcggagcgcgtcgtttacagctaattatcatatgaaaccccccccgaagagtgcctttggggcaaggatataaccacccatagataacagaactaggagatcacttcccaaagtttgcgtccgccagtgggattcccccatacaagcgcgctctgggtcctggggtcgacaggggacccccagcggcatatacgcaaacatcacagagaagtttatgccttcccccttttgtagagggggacttggcaaatcattgtcccncaaaattgttcgtgctgcttagaattccccacaacttcattgaggcgcattctcgacactgcgtagaaaacgactcgatgaagccccccagacgataaaacatggtgagacacacccacctcgtcatcgacccaacattaccaccggtggtatctcaccagggatacccccacgccgtgctgttacagcagagtccctacaagacagagcgagctcgcggcgcgcactacagcacatcagaactaacaaaca

SEQ ID NO: 666199 - DNA, 118 bp, Homo sapiens
atgagccgcctgatgagcaaagggaacccagagccgaactgtatccacatcatgggctgctacattcaggggaaccccaatggagagaagctgttccagaaccttaggaccctcatga

SEQ ID NO: 666200 - DNA, 182 bp, Homo sapiens
atgatgctacacatacttgctagtaagatacctcttacggacccattttactccctaaagctcatgtcgaagcccccctagctgtgtcaatcgtacttgccgcagtaatcttcaaactaggcggctactgtataatacgcctcacactccttctcaagccccatatataacacatggcctac

SEQ ID NO: 666201 - DNA, 634 bp, Homo sapiens
  misc_feature (5)..(5): n is a, c, g, or t
  misc_feature (64)..(64): n is a, c, g, or t
  misc_feature (101)..(101): n is a, c, g, or t
  misc_feature (132)..(132): n is a, c, g, or t
  misc_feature (157)..(157): n is a, c, g, or t
  misc_feature (205)..(205): n is a, c, g, or t
  misc_feature (213)..(213): n is a, c, g, or t
  misc_feature (217)..(217): n is a, c, g, or t
  misc_feature (222)..(222): n is a, c, g, or t
  misc_feature (239)..(239): n is a, c, g, or t
  misc_feature (242)..(242): n is a, c, g, or t
  misc_feature (244)..(244): n is a, c, g, or t
  misc_feature (247)..(249): n is a, c, g, or t
  misc_feature (252)..(253): n is a, c, g, or t
  misc_feature (264)..(265): n is a, c, g, or t
  misc_feature (269)..(270): n is a, c, g, or t
  misc_feature (272)..(272): n is a, c, g, or t
  misc_feature (283)..(283): n is a, c, g, or t
  misc_feature (286)..(286): n is a, c, g, or t
  misc_feature (289)..(289): n is a, c, g, or t
  misc_feature (306)..(308): n is a, c, g, or t
  misc_feature (312)..(312): n is a, c, g, or t
  misc_feature (319)..(319): n is a, c, g, or t
  misc_feature (328)..(329): n is a, c, g, or t
  misc_feature (342)..(342): n is a, c, g, or t
  misc_feature (351)..(351): n is a, c, g, or t
  misc_feature (380)..(380): n is a, c, g, or t
  misc_feature (385)..(385): n is a, c, g, or t
  misc_feature (416)..(417): n is a, c, g, or t
  misc_feature (420)..(420): n is a, c, g, or t
  misc_feature (425)..(425): n is a, c, g, or t
  misc_feature (435)..(435): n is a, c, g, or t
  misc_feature (439)..(440): n is a, c, g, or t
  misc_feature (448)..(448): n is a, c, g, or t
  misc_feature (453)..(453): n is a, c, g, or t
  misc_feature (455)..(455): n is a, c, g, or t
  misc_feature (461)..(462): n is a, c, g, or t
  misc_feature (466)..(467): n is a, c, g, or t
  misc_feature (481)..(481): n is a, c, g, or t
  misc_feature (499)..(499): n is a, c, g, or t
  misc_feature (507)..(507): n is a, c, g, or t
  misc_feature (515)..(515): n is a, c, g, or t
  misc_feature (518)..(518): n is a, c, g, or t
  misc_feature (534)..(534): n is a, c, g, or t
  misc_feature (539)..(539): n is a, c, g, or t
  misc_feature (562)..(562): n is a, c, g, or t
  misc_feature (567)..(567): n is a, c, g, or t
  misc_feature (574)..(574): n is a, c, g, or t
  misc_feature (618)..(618): n is a, c, g, or t
tcccncttagtctgattcacacgtttattaacgtttaatcctgttttcaaagtccaagattganaacttgcaattaaacactgagcaagccacatgtttangtaatatttcttttaaagtcttaaagaaaanagtttgatacagggcctaagttttnagtggcatatatactattaacacatgttctgaaatctggtaggtcacntcttgtcntgtnttaanttttaattttatttatnttntnggnnnttnntgggctttttnntttnngngtggggttgtnggnttntttgttctttttttttnnntgtngttcttnactttgtgnngttctcagttttnttccataantcttcgaacagtagtcctgcttagtttgnctgantccttgatttttaatttggcttttcatgggnngcncacgncaccggcgcncggnnggttttgnggggntntgctgnntttnncttcagggggggtnttttgtgtgttttctttnttgggttngttgcgtnttnttctgtgcgtgctttngctgngcttcgtgtgtttggtgtcttcnctggncccattnacctcattcttagtatcactttccttcgattctgtgtttgtgtnttcactctgcttttct

SEQ ID NO: 666202 - DNA, 977 bp, Homo sapiens
gctcacgttcaggacccaggacaaaaatccgttggtggacatctcagtgctgagcccctggtcttagcagaagcgtgatggttacagagctagtcccagcaaagctactctctctgctgcttagaactgtggacacgtatgggaacgactggaagcacccgattgctttcattgttcagaagaagcccaggagactatggaagatgaccagaactgggcaaacttgatgtgtccaaaacttggcctcaggatgatgcttgtccatcctccaaggcccttcatggccagatggggaaacgtgaggtctcagagaggagtactgcgtctatggtggcatagccattggaaccccttagagacacttatcagagcttccttttgtcgcaagtataacagacaacagaagagtaagtctcttcagaagttctctcagaatgtgtttaagtctctttctcccccagtagtttggtgaaaaagcaggggtactgtgtacgtgttgtctagccagtagcacaggctgcacgaactacagagacagagcgaaagagactcacgggcagacttacctgtcgactagggacatccttgcgagagaagactcgatcctgctctgacctgtgaacggacatccagtagacgtgtcaacgaagcgccatttggcacacgcttgtgttcgccgcgtgctcgcgttctcagtattcaccactcattgctacgaaagccacactggcttacctgttatatcccgcgcagggtagacacccatggggctccttggcacattgacacgcgttggatacagcgcacaccttgtgtcgggtaaatccctttgtgaaaattcaccactgcaagcacgggtatccattggtggattctggctccttggagccccagttttaggtccgaaggctaaggtacacttaaggtgccacgaaccgagtggtcatgtaaaagggatctcacaagtccacaaggag

SEQ ID NO: 666203 - DNA, 451 bp, Homo sapiens
aataaaaaaaggagaaattcatagcagcattattcacaataaccaagaaatacgtacaacccagatgttcatcagtggatgaatggataaacaaaatgtggtaatatgatttggatatttgttccctcaaaatctcacacggacatgtgacccccagtgttggaggtggcgcctagtgggaggtgttggattatggggtggatctcatgaatggcttggtgtcctccacatggatatgagttcatcctatagctagttgtttaaaagagcctggcacctcctccctctcccttttgttccctcttgccatgtgatatgctagctctccctttgccttctgccataattgtaagcttcctgaggcctcaccagaagcagatgctggcactatgcttcttgtacagcctatagacccataagctaaataaaccatttttaataataaattaaa

SEQ ID NO: 666204 - DNA, 861 bp, Homo sapiens
  misc_feature (1)..(1): n is a, c, g, or t
  misc_feature (62)..(63): n is a, c, g, or t
  misc_feature (172)..(172): n is a, c, g, or t
  misc_feature (187)..(187): n is a, c, g, or t
  misc_feature (200)..(200): n is a, c, g, or t
  misc_feature (208)..(208): n is a, c, g, or t
  misc_feature (230)..(230): n is a, c, g, or t
  misc_feature (238)..(238): n is a, c, g, or t
  misc_feature (244)..(244): n is a, c, g, or t
  misc_feature (251)..(251): n is a, c, g, or t
  misc_feature (260)..(261): n is a, c, g, or t
  misc_feature (292)..(292): n is a, c, g, or t
  misc_feature (314)..(314): n is a, c, g, or t
  misc_feature (332)..(332): n is a, c, g, or t
  misc_feature (360)..(360): n is a, c, g, or t
  misc_feature (366)..(366): n is a, c, g, or t
  misc_feature (370)..(370): n is a, c, g, or t
  misc_feature (373)..(373): n is a, c, g, or t
  misc_feature (435)..(435): n is a, c, g, or t
  misc_feature (449)..(449): n is a, c, g, or t
  misc_feature (453)..(453): n is a, c, g, or t
  misc_feature (502)..(502): n is a, c, g, or t
  misc_feature (515)..(515): n is a, c, g, or t
  misc_feature (560)..(560): n is a, c, g, or t
  misc_feature (620)..(620): n is a, c, g, or t
  misc_feature (631)..(631): n is a, c, g, or t
  misc_feature (665)..(665): n is a, c, g, or t
  misc_feature (671)..(671): n is a, c, g, or t
  misc_feature (682)..(682): n is a, c, g, or t
  misc_feature (710)..(710): n is a, c, g, or t
  misc_feature (721)..(721): n is a, c, g, or t
  misc_feature (771)..(771): n is a, c, g, or t
  misc_feature (798)..(798): n is a, c, g, or t
  misc_feature (860)..(860): n is a, c, g, or t
nctgcagggctggctcctggcctctgtcctggcttcatggtcctgacagccctgggccaacnncaagcgcagggaacatacagtagcaccagcctgtaaaagtcgttctccttggcctggaactccttgaagaagggatgggaccagtgggcatccttcagcagggacaggnatcggtttgtcaccncagggggcttgcncaggtgcngggacaggacgaaaaggttaancaacgtcnccgggnagccacnatccttgtnnagcgcctacagcagcaggcccacaacggccncccaacggccctgggccatgtngcaggccgcctgcccatnaaacagcagcagggtgggcgagcacttntaagcnaacnccnggaagaagtagtaggcatccagcaacatctcaccacccgtagccaggctgacccaggcagtngcgaacagggtaanggtngcatcctcgtccaggtcctgcatacacttcaccaccatccgggcaaagnccaggcggtccancaacaccaggaacagcactatcatggctgttcactccaggctgtncccctggtgcagcgcacgcagggcggcatccgggttctggtcgtggagaaagaaggaggnggccatgagcnggaaggtggtgttggtcacgtccacgctcctccncatctnttggtccagcncggccacgatgctgttcctccgactctngtgggcgaggnagttagcaaacatgcgcacggcctggagctcaggggccgaggagggcttnaactcatccaggaccacaccgaacttnctcttcgccaggtacgctctatacaggaagacgtccctcttcacgtctctttctttggcttna

SEQ ID NO: 666205 - DNA, 156 bp, Homo sapiens
gggcagggttcagaaagcagcgcctgtccaaaagctcagaagggtcaaaagctccagcccagaaagcacctgctccaaaggcatctggcaggaaagcataatgtagcaatcactaacaagtacataacaggttcttttttgacctagttgaacaac

SEQ ID NO: 666206 - DNA, 281 bp, Homo sapiens
  misc_feature (41)..(41): n is a, c, g, or t
taaaaacagaactatgctccagcagttccactactgggtantatatatatctccaaaaggaaagaaatcaatgtatcaaaaagatacctgcactcccatgtttattgcagcagtattcacgatagccaaaacatggaatcaacctaagtgcccatcaatagatgaaaggctaaagaaaatgtattattcagccataagaatgaatgaaatcctgtcattggcagcaacatggatggaattggaggtcattatgttaagtaaaataaaccaagcacagaaac

SEQ ID NO: 666207 - DNA, 284 bp, Homo sapiens
ttatcagctcggccctgtgtaggctgcagtgcagagccagtgggagcatcatgtagtgagacagcaaggtatgtccatccccctaggctccacttgcccccatagaagacttgtaggcccaagaagaactgtctgacctgaattctgcagcacagtcttggccatcggatgggggtgatctgacctgaacactccttggtttactggcctctccagtatcccaactgagccacgcctgcttgcagtgcagccttgggtgccctggtggcccacatcacagctcc

SEQ ID NO: 666208 - DNA, 834 bp, Homo sapiens
gcggacaagcgcacagacaagatcttcaggcatgatggacaccaacctaatgacggtcaaactgtccttggaacgtaattcatcagagcgtgccaaagagctgacccctccatcgtccgcctgctgcagtgcggaccccagcaagtgccagatcagttctgagcgagctggaccctggacagttgcagagaaacacaggcttgtcgtgccgtgttaaagctttgcttgcaagagtggatgccccgcaattcgttcctgctctcccgggccccgggcctggcggcagtgcgttgcacctgtgccggtccctggtggcgtgctgcgctcccgtccttccacgctgatcggcaactgctgatcattcctcccgctcatcgcctggcccggtcccttccagggctaactcccagggatgtggtgacatgcagggtatcaatgtgttcttggttccaggcacctcccggctcacggggagctcagaggtccatgccgaggagaccaggcaggacctcccgaggtctgcgccccggccggtccatgcgtaatagtgatcccaagtgactctgtgggcacagtgcgtgcggacgagtgcgtcgggagggtatacaggtagcccctgcccgtgcatggtgtgcctccctcgttcattttctccagcacaggcgcttgcacgtcctagatactagtggtcccctttcttttaacttatctacttgatgcatggtgccgctggacgtagtatccgcgtacggtccagtattcaatgccttctgtcctggcctcgaagcgcagccttcgtgtgtcgccgtgtccccttccctggctgttgcgtgg

SEQ ID NO: 666209 - DNA, 311 bp, Homo sapiens
tccctagcccctcccctcttcaggggtctacatggcactgtgaggaggggagattcgagtgtggtgcggggactgagtgtggctggtgctccccaggcagttgagggtctctctcttcctcttgtgctcttgctggggctggtggtccagtggtcttactccttggaggccatgtgggccatgaggtccaccaccctggttgctgtatcccaattcgttgtctttccaggcaaatgagcttgacaaagtggtcgttgagggcaatgccagccccagcgtcggatgtggacgagtgggagtcgcttgtcgtc

SEQ ID NO: 666210 - DNA, 174 bp, Homo sapiens
cagtaggaacagcataggattgtatgtgggaggtggataggtcggtgatgtgtggagcggaaaagcaggttggtaaagttcccttcttgggacttagttcctgagagtcaaggtggatacaatgtagatgcacgaatggttcacgacgtgacaaactagatggttcctcaatcg

SEQ ID NO: 666211 - DNA, 289 bp, Homo sapiens
tcatgttcaattaaattcattctctctcaactctagtaggggctgaagacattgaaacgagtaagaatctggcggccacctacctagcacacagtgtagtgttaatagcgattcatcgaactggcctgtgaatgaataataaaattcattatgagagcattatttagagaagtttggttttatgaagaggttcacaagctagacagaaggaatcagggtctaaagctgaagaggccagtcccaggagaccagttaaggagctccagggaagtgggaaaaacagagaaat

SEQ ID NO: 666212 - DNA, 212 bp, Homo sapiens
tcgtctctacacgatccccccctgaaacccagtccagcaatacgtggcctcttcttgaccaggctcgtactcgctcgcgatagccctggccgcctcggtcggttttttcgctgctatccaagctccattgggtgatccctttatgcccatacccgcatgtccggcctacgctgtgaattcctggcggtgcgttctgagtccgtctcatcgcc

SEQ ID NO: 666213 - DNA, 534 bp, Homo sapiens
  misc_feature (534)..(534): n is a, c, g, or t
ggtctcgataccgggttcgagcgccacctgccagccattcacgcccaggacaggcagcccgagctccagcgcctcggcctgctcgccgggaggtatgctgtcctcggccgggggtgccccggagtgcaaggacgacaagaaagacacctgacgtggtgctggctgagtggcaagggcaccagggtggcgcctcgtgtccgaagggttgtgacccacggggctggcacaacggccggattagctgcgtgacgagcgtggatttaatgtggccatgtgaaccagcaatccggcatggggggcccggggaaggcacaggctcttgagagcgtcggggacattgcagtgacaggttatcagtcaggggggcgtccaagcttccaaggcttcctgggccgcacaggtttgcgccccaaccattacctcccacaagatgatagaggctctggaggccatgggtggcttcccggatagtaagcaccatacaaaagccagtagcccataccacgtagttaccctcttgcctcccaggagagn

SEQ ID NO: 666214 - DNA, 343 bp, Homo sapiens
  misc_feature (70)..(70): n is a, c, g, or t
  misc_feature (93)..(93): n is a, c, g, or t
  misc_feature (95)..(96): n is a, c, g, or t
  misc_feature (152)..(152): n is a, c, g, or t
  misc_feature (159)..(159): n is a, c, g, or t
  misc_feature (161)..(162): n is a, c, g, or t
  misc_feature (216)..(216): n is a, c, g, or t
  misc_feature (233)..(234): n is a, c, g, or t
  misc_feature (237)..(238): n is a, c, g, or t
  misc_feature (257)..(257): n is a, c, g, or t
  misc_feature (308)..(308): n is a, c, g, or t
gctgacggtgtccctggggctctgcgctcgtccggccggccccggcctcgccgccccgcgcagaacccancccggccccgccgacccgcctcnanngccggctccgcgcccttccccgagggctggaagaagggctgtttcgccctgcaaanggtggananngagctgaccgcggactcggtggaaatggtgcccgctgcaagagctgcaaagcanctgctggcgtgcggganntannaaactgcggcggccggagnaccggcctgccggcccccaaaaacaaaagtgtcaaaaaccggtggctgganaaagccctcttgggcttggcaaaaagccaaatgga

SEQ ID NO: 666215 - DNA, 356 bp, Homo sapiens
caggcacacagtgtgtgcccctcactacaagtctgagttgcagggctatagctgaccaagtagcagagaagtctttatatccaatagactgctaacagattaggatcgaatacttacaatgtgagtgaatgctatgaccaggcctgacacatcagaatggaaacatacatgaaccactcctgtgagggctggagccttggggttcaggaggaggatacaagactacaggcatactgtcaggcttgctcgggactaggcacacacaggatggcgttataaagagtgtgctgcacgactgacacgccatttacatcagcttcatcactttgcttgctctctgtaacatcctattctcc

SEQ ID NO: 666216 - DNA, 1394 bp, Homo sapiens
acagagaaacgggacggaggcagagtactgagtagagatgcgggacgtcaaagcaacaaggtagcatccaacacgagacccgacactcaaaataaaaacaacgcccagagacaggcaaaaagagacaaaagaaacgaaaaaaaaaaagacgaaagacctggacagcacatcgacgaaacgcccctcatgcagcacaccaaacaaagggaggagcacaacgagcccagcacgccaccgcgcaaacacccccgcggcacaccacaacacgcaaacacgcagccaccacaccccccccggcgccaccgcaacagccgcgcaccccacgccacccccgagagagagcacccgcacgcaacacaggagaccaagacacagacggaccagaccaaaccgaggcatgaacctctgcacacggccacaccgcgccaagacacatacacagaacgaacccaccgaagcggcaaaacgcaccaacaccgacacaaggcaacagaccccgccccaaggcaacgacaaaagcagccccacgctcacaccgactgaccatcacagcccaactgccccagacagcgaccgagacccccaccgggacgcgccgaacaacgcgaccggtgcgcacgagaagaaacgacgcaagcaccatgcaccaccaagccagctcaaccccgccaaaacgccccaccccgcacccacccaacgcgggaacaccacaacgcaggccaccgccccccaccaccaccacccgacaccagcccccacaggaacccccaaccgacagcgacccaaacaccagcacgactgtagaacacaagactcccgcccgcgaccagggcgccgacaccagccgagcacagcgccaccgaccaccgccacgccaaaagccacgcgacgcaccagcacgaagcaccagccagacgaccacgccccacgccagtacacgcacaagagctacgcgtcacacaccgagccccagcgcaacaccacgccaacagcgcacgaggagccgccacagcagccgaccacacacaccccacgaaccctaaccaagaccaaacgacataccacaccacaaatcaagaagcccgagagccaccaacacacgcaccagccgaggcagcacatcccagccaccgcgcacaagaaccgcacccaagagcagagaccgagagatacaaacgagagacaacagacaagagaacaggaagagacacgccaaacaggcgacgggcggcggaggaagcgggaggagaggaagacagagacacagagggcagagcaagagagagagaccgaagagagcgaggaggcagcgcacgctccaggtcggcacggcagccacgcaagaggaaaaaggaaaagaggcggagcgcagacgcgtaggagagcaaggtaag

SEQ ID NO: 666217 - DNA, 214 bp, Homo sapiens
  misc_feature (27)..(27): n is a, c, g, or t
ggattcctccacgtgcgaaatatggangtgtgtgtatatggatgtgtgtggtgtgtggatatggatgtgtgtggacatggatgtgtgtggtgtgtggatatggatgtgtgtggtgtgtggatatggatgtgtgtggatatggatgtgtgtggtgagtggatatggatgtgtgtggatatggatgtgcatggatatggatgtgtgtggtgcgtgg

SEQ ID NO: 666218 - DNA, 274 bp, Homo sapiens
tttattttttttttttaaccccccaggggcccccgcgttttttttggggccaaacccccaaaccatttttgggggccacccattgttttttccccttgccctgggccttccaaaaaccttaagttggcccccgttttccccccctgggttttgggggttttttccccaacccgggaaaatttttttttaaaaaattgggacccaaaaagggggaccccctccccttggtgtttcccaaaattacccttggggggtttttaacccccccccccca

SEQ ID NO: 666219 - DNA, 183 bp, Homo sapiens
  misc_feature (81)..(81): n is a, c, g, or t
cctggctctgaacttaggggaaagatgaaaaattataaccaacgcataacatagcaagggactaacccctgataccttgcngcataatgaattaactagaaatgaactttggcagaggagagctcaaagctaacgacccctcgaaaccgagacgagctatcataagttcagacgccagggggt

SEQ ID NO: 666220 - DNA, 161 bp, Homo sapiens
tgcctgtatgactcagaggatcccgacccgatgtattgacttagtgattaaacttctttattgataaagtacctaatcttgtggtatgtctttatcagcagcatgaaaatggactaatacagttcttatggcccagaccagagtcttgcagagctgctatg

SEQ ID NO: 666221 - DNA, 687 bp, Homo sapiens
tttgatgcaatgcttgtgcagtacagctcagggcatgctaaactgcatctcaggatacgcaaagtgtcacaaggaacgtgtgtctgaacctagagttatttcagtcatctttgacgtaggttccatgtccgaggatgcgtgcatactcgacgtaagtgagattcacaagtttagcgataggtgatgctctgtgcagctcatccagttactcactgtagtacgatcagtcatggtagcagcagctcccacaagtgaccgtcctgtatggacacacgctcatattcgtatcagcaagctacgccctttctgatgacatcttccggttatgagccatccatcgtctgaccagacatggtaaggaacacggtaacagtcatacggcatcatgcatcattcctcacggcatctagatactccccagttggacgcttccacaattaagctagcacaccatgcacatctactctgtagacaaagcgtgatcagctccgtccgtgcatattcgagtctgatatgaagtcctgagtctgagtccggtcgcacataccatgcacattggacattgcacgcgcaggacgttcattggtcatggccagtgatgatccgccagacatggtgctgattcagtcccgggttacagtccacaatgcgcgttcctctaaacgcgtctatcacacgccatcatcc

SEQ ID NO: 666222 - DNA, 550 bp, Homo sapiens
gcgaagctgagaggtgctgtatgtataacacctgatcctcctcagcagagggacctctgcaaaggcagactgacaccacttttcgaagcctcagcaaccgcatttaagcagttactggttttcactgttgcctgataagctcaatgccctccgggtgcaggaaagatctggaaagcaaaatatgaaatgcacccatgtactgcctgccgcggttagggtttctgactaaattagttcctgtggaagcagcaagcaatgcttccctctatgctggaagctgtctgtgatagtcaccataatcaatgagaaaagcccagggtttggggattgccccagaaaaccagccatccatccccaccaccctccaggatggggattcagaagcactcaggaaagtgcccaagatggcggcccatcaagaagtcagcaccaggccaaaggttttccccttgcgtggcctcgacggaatcctgaacagctagcagtcgggtgctgcctgatacatgaattgctgagcttaatgttcaaataaactagtaaaaatcctaaa

SEQ ID NO: 666223 - DNA, 253 bp, Homo sapiens
  misc_feature (8)..(8): n is a, c, g, or t
  misc_feature (93)..(93): n is a, c, g, or t
  misc_feature (118)..(118): n is a, c, g, or t
  misc_feature (164)..(164): n is a, c, g, or t
  misc_feature (179)..(179): n is a, c, g, or t
  misc_feature (241)..(241): n is a, c, g, or t
ccctctgngcgctggttccactcctacaggtccttcttggccttctcccgccattcctgtccgtgaccttagatgcagcatccagctcttgcngccgtttcctctgctcctctcgccncttgcggatggtctcaggctcctgggtcagcctgtcagcctgggcnatggctgcgtagccntcagcaggaccgttggcctcctgagcatctcagtggggagatcagtcatggccaggagggtnggcaaccaggag

SEQ ID NO: 666224 - DNA, 547 bp, Homo sapiens
tgcgtgttcttctatgggttgctctgcacccttttatcttgggagaggctctcgttatatatcttcttgcttggaaaacaacgttgtggctctgcccataaacttccgtatagaatagctaatggaatatattgttcaaaaacttgtgaagcatgtccctatcctatttaaaggaaatatatttaatatgccatctgacatgtagagaggtcatcaggtcttgtggttactgcaggtaagcgcatcacatgaagaagggtgaatggagagatagggatgtgcgtgaatcctgcagtggttacttcatgaggttttgaaaccggcaaatcagcacctaataacttcaaatcctaggaagtagggtggaacgaagtctatgtatgaactcctgagaggcctaagcttgatatagctttatgaaccctggcctagtactgaagagaaataacttctccaagttcccccttgcttgaagttgccttcttctacgaggatttccttggactagctttattaccagaggatttttgtacaagcacctctagtt

SEQ ID NO: 666225 - DNA, 282 bp, Homo sapiens
acaagaacagcagcagtgatactagagaggtcacactctaagtggagtcacgagcgtgacaccgcatataaggtcacgctcgtcacgtcctgcagaggcgatgataaacatggtcacacgtgtgtgtatcaccagtgggtcacctgcttgtacattcctcccgtgacagatagtgtcgcacatcttacctgagcaccaggccatgaaaagtcttggttcccacaatgcgatatattggaattatcacctcaggttatgacgtaaatttcgacatccatagtc

SEQ ID NO: 666226 - DNA, 1223 bp, Homo sapiens
tcaaaacgaaatcaaaaatttatgcttttatttaacacatggtgggcaattggggaagtcacagtcacatggcttccctgggggctcggggggtggtgtaagttggggcgccctatattctctgagccagtcaaggagacactggaggaattttatagccctcaattgtgcagcacacgtgaggacacgtggtgtgccagaaaaaacaactcacgtgggagggggttccaccaaaaccacaaccatagactacactctccttatagaatgtgtgacagaagagacaccatattcgtgcagagagactcctctagatagacaagcgcgcttcgacaagaagagagacagctctatttgacgatttggagagatatctctcccacaaatctacagagggagagagagattctctccaaagcgcttacgccaaggcgggatacaaagcgcgagttattgtgagcccacgagagaagaggagcttgctaatgagggggccctcgcagtgacacaacacacaggagtggcaaaacagagacagacaagagaagagactctcacaccgtgggggaaaaacacccttgtggagggcactcaccaccagagcgcccccgggcgaaaatgtgggggccacactcaggacgaaaaagagagaggagccaagttgagcacagcggtgggggaagagcagcttgagaagaaacatctccactactaaacagcgaaacccacaagaagggacaaccccaggagaacaaaccaaccgaaagagcaggcgcgagggaaaaaacatcgcacaaccaacaacagaacacaacagaaacgagacagacaataataacacacaccacgacaggagaagaagacgaacaacaacccacacagagaggagccaccaaccccaaccgagagaacaacaccaccactccaagcacgcagagaccaacagcaaaacgacgagcaagcacaacatggagggacccacccaaacgacgacgaaagcaacacaacaagtagagcagagacccaccacacagaaccgcacccaccaaacgtgagagacaagcggagaagcaaacagaggagcacacacaagaggagccaacacacaagcagaatcaaagaagggaaacacaccctctgaagggacgacacacccgaagccacaccaacctagagaaaagaaacgccgaaaagaacaacagtcacaacacaacacgaggcag

SEQ ID NO: 666227 - DNA, 1112 bp, Homo sapiens
gtgaaggtcctgacatgcctccgacggaaggagttattaggcccatcgagctagaaacgagaactatggtagtgtgaatggactagtcgatgctgacagtattgtcatggcctatagggtgatatggaagatccgtagagtcgtacgtgtgcggcataggcatgtgattatatggaacgatgtgatacccgatgtatgcgctatggcgtccctcaacaaatcgagtgtacttcttgggggtacgatatcggattgcgtgtctaggcagcatagatatagccagggtctagtagagacactgactcgcggtgtcaatgacacttatgcacagtaatgcatatctgcgagcagcgaacctgcgaagaacaggcagagccattcgctccatggacagcggacaggtggccacagaacatgggacaagcgatcgagcggtagcagcatccttaggtggtttacaccaagataactaagaactctcagaccaatggtgggtttgcccacacacactgtttggaatccaggagaggcacggcaatggatacccagagaggcatttgctttcaaaccctcatcgtagagaacggtgaacggcgcacattccattcgccacatggcccactagtgcccaaccgaggaacttcatccactggctaggggataacccacgggataaagaggccacccctggaatgccccatcaatactcagtgacacccaactgtgatgtgtaaattacccctttgtacgccatcctacacacgtcaacacttggggacacatgtggaaagagtttcacacaataggtcttcctaggagaaagaaccgccatgcacacgactactcaaacaaacatcaccaaaaaccataagatgtgctgcgtcaaccgcaatcagattcagaatgtcgttaattccacgaacacgaaccggaggaggtggcccagcaaaagcgacgtatgtacagtgccatattacacccaacaggaacacgatgagagtgagctcagcacaacgactaggaggcgaccacccgcaatcaacgactaagttgagaccaggataccaataagaatacacataaaacgcacccagtaggcaacacgacgagtc

SEQ ID NO: 666228 - DNA, 337 bp, Homo sapiens
  misc_feature (68)..(68): n is a, c, g, or t
tggtgtactgcaatatgacacacattataggactggctctgaggtatcctctggagaagagtatctgnagcatccctgagatactttctacttgtgtgattttcattacaggagtacagtactttctggtcacctgagaaaaccacccatatttttattagccaaatatataattctcgaatgcttagaattcatttcttaatgatttcactgttgtgcagtatagactgtgaattgcctactaaggatactgttaattatagtaaactgtggaatctagattaaataattacgccctactttttttcttggcttgtggatgtgtagaccacatgat

SEQ ID NO: 666229 - DNA, 353 bp, Homo sapiens
  misc_feature (317)..(317): n is a, c, g, or t
ctcgctctccttttcttgtctctgctgctttggggggctcctggggctcgctgtgcatgagctgggccctggtgggcttggtgtgcaggacgtgaggcctcctccctggtggcggtggtcgtggtgcgtgcaggtagtgggcgtgagggcccctgctgctgtgggaacctcggccacgggagcggcagctgtggggtcttctccactcatgcccaactcgttgactcgggtggggtcgacgcggtagatccaccgttggtagaggtagattaagaaaaccacatcgtcccgcaggcagtcgatccggtacataacgngcatcttgatgaccaaggcgaacaggtcgtcgatga

SEQ ID NO: 666230 - DNA, 481 bp, Homo sapiens
tccgtatccaacagccagctatattttagtagagaggttcacatcttgcagatgtcttgactcctactcctgatcaccgctcgctcccaagtgctggattacaggcgtgagcacgagccggttatatgttttatacttacaacacatctcattcgagtagcacatttcagattgtttgatagtcatgtgtggctaattggttacttgtattaagacagtacatgcttttggtgagtatgtaatgcaggtgtgggtatatatcgaggtcaaaggatatgtgtgtatgctcagttgatattgtcaaatagttttccaacgtgattgtactaatttatattcctcctagcaatatatgagagtcctggttgctccacatttttgcccttagctattctgctgggttagtagtattatctcattgtatgattttaatttttcattttcctgatgactaatatgtcctttttatatacttattagg

SEQ ID NO: 666231 - DNA, 443 bp, Homo sapiens
cccatttgagcagataggtattgatgatgccgttggtgctgagtagccccatccatgcgtacacgcgtagcaagaatgatgtccaaaagggcagcataatcagcagcagcaaggtattgcgaatggatggattggcgcgcgaaatggcatacgccatcggatagccaatcagcaggcaaatcagcgtggttaaaagcgcggttttaatcgacagccaataagtcagcacgtaaatgttgccgccggaatcgcccggagagggggttgatgatgtccagcaaggagggccaaaaatccacgaaaatttcttggtagtttttggtgaaaacctgcagtgcgcctttttcgtcaaataggggcgtgaacggggggatggtgtaggtttggtcggcgaagctgattttgaacacgagtcgacgcggccgcgaatttagtagtagtag

SEQ ID NO: 666232 - DNA, 308 bp, Homo sapiens
  misc_feature (90)..(90): n is a, c, g, or t
  misc_feature (108)..(108): n is a, c, g, or t
  misc_feature (113)..(113): n is a, c, g, or t
  misc_feature (117)..(117): n is a, c, g, or t
  misc_feature (122)..(123): n is a, c, g, or t
  misc_feature (135)..(135): n is a, c, g, or t
  misc_feature (138)..(138): n is a, c, g, or t
acacatcatgtgcacttatgtactaaagacgagctaagggaaatcagtctatccactaacatcaagctcaaagaagtataagagatgctntttcatgaaaacatcctnatgtngatnctacnntatgctgcttgncangctagaaattccaaactccaagaaggaacaaggaaaacaagaatcctggttgcactgctgttattttgcatcgaatcaaaactctagggttccatgctgtcattatgttaacaaagcggcagtgttctagagcaaagcgcatgaggcctaatacccattctatggattgt

SEQ ID NO: 666233 - DNA, 478 bp, Homo sapiens
ttagcaaagcaccataagctatacatattctggtctctcctaagcttttacaaaaatttaccgggatttacccggggaacataaattcatctacaagagacattagagacgtttcaaggactaattctatctcaaattcagaataactgctagtaatttatcctacctcacttaaaaacaatctttgaaccaagtagtatcatgaggacaaatctcatgagtaccaattcaagcagactatttcagcaagtggcttctcattggccacaggtaggacaaaactaatgcttcaagatgtctctagccttgagagagtcgggtatggaccatttatgcctctcacaataacacacctgggagaccacacggtcagagaccaggtctcacaatgggcacttctgtggttccaacatgctatatgtccttaagcaaattctccagaaatacaatcttagacacataggttcacacagaagct

SEQ ID NO: 666234 - DNA, 582 bp, Homo sapiens
taagctcaggccagtgaagactgggatctatcagaactgcagaaagggccctgaatctagacacaggctggcagtgctgggtggtggcaggggatgaatgcaatatttcttgcttagcgtctttatcccgctataccaggttagcgagttttatgcgccgagtattcccagccactccctgtcaggcgagttccaggatatccttaagaacatttgtgctgaagcctagttctgctgaacccactggaaggattccttttgctatctgcgccttccactgaagacacagcccaagtcctgtcacatgtccctgctccaccaccagcctcctttggcagagccaagcccagatgcttccacttaagcattcccaaaaagctcgagcccttctcaccaaaccacagacctttaagcaaggctccatgaccccaaacagcatttccagcaacatatcacaacagcagggcattcagtcagatagctgcacactgtcctctaaagaagcaaagagcagcaacaggcactgagacctcacctccgggtgccccgaagtcagacttcctctgagcctagctgtcccac

SEQ ID NO: 666235 - DNA, 225 bp, Homo sapiens
  misc_feature (191)..(191): n is a, c, g, or t
ttatgtctgtgtaacattgcttggttggtgtagctatggaaactgccacattggttatgtgccatcattggttaatgcaattgtgtcacttgacaggagatttgacagaatactgatcaaccttcaaatagacaaattgagacagcccaagggaatctgtgagcaatttaacaagcaaaccggcgacaccnctttgtcttccaccatacattagtggtacttggg

SEQ ID NO: 666236 - DNA, 276 bp, Homo sapiens
cacctcttacgagttccttgtgggtacagagtcaagatcatgagttcgtgagcctggtgataggttaaagattggtctacgtttggaagcagaagagagcacggcgtaaggaatgtccaaataatcattatgccggacctttatctacataattatagacgctgttgcgagagtgcgctttcgcacccttatgtcctgcggtgaaggtttggcagcttcggtaattggttggactgagcatcccttccgttgagttcatgaaacttcgtggttttc

SEQ ID NO: 666237 - DNA, 846 bp, Homo sapiens
accctttttcgagaatcgcccccattcgctatgggggaagaatccccttatttattcactgcctatatttaaaatataataggatttgtgaataatatttggacaggtttgtgcatcctaaatgtgaccttattcacttcatttcttgaatgggaatgcactgaataagtgaatagggtcatgatttcgtgttcatgttcatggataaatgcggtgtagagaggatgctactcctcaaggtgattctgaaggcaccccaaggtatagtctgataatttaaagatttactgcagaatatcttgtactttactgtgggttatttagttacatctgttaatttagatgatttctttgtgtgctctattcggctagactaggtgattccttccatccgttctaactgaactcatatagtaggtttgtgttgtaacattgtgagttaggatttatacacttaatctcagacgaattgtatctctttactgtacatactgtattcctattaaggtgtcttgaagtcttgttcgtcatggctgtactgtgtctgatggcttggacttagagattcttgatgcactaaatgagggtcactgttgatcagtgttgctagtagcttgagcagctcttcataagaagcatattgggttgtgaaaggtgtttgacccatatttttcggaatctcatttaatagatgtatggtaccatttaaaagtggtgtgtatctgaactctactgatggggataacatacactgtaatggggtcaaattaccttaaccattccaaatggctttccctgtatctcagcgtcctacccagtgcattactcatctgaggcaatacctac

SEQ ID NO: 666238 - DNA, 151 bp, Homo sapiens
caaaaaaaaattaaagcgttgataatagctttttgcttaaaattgggtaataattgaaatttaaaggaagaaaatgtagtaaagccaatgaggtctcaaagttttataaatcttgattcaataaatatcaggtgaatttaggaaattatta

SEQ ID NO: 666239 - DNA, 174 bp, Homo sapiens
gaagaaggaggttcctgcctgtgccagaaaacccttaagaaaaagcgaagggaatttcgcagagctgaagatcaagcgcctaagaaaagaagtttgcccaaaagattgcttcgaaagggcaaggagggaaggcttatctttttaaaaaggcaaaggcacttttcacaagggggt

SEQ ID NO: 666240 - DNA, 194 bp, Homo sapiens
ggctgggactgcgggcgtatgctaccacgcgtggctgatttttggtatttttagtagagatggggtttcaccctgttagccaggatggtcttgatgggaccagcgtgatgtatgcggcttgttattgccatgagcatcatgatgtgaggcgtgaatcgacgtggaggctgacagtttgagggtaggggctctcc

SEQ ID NO: 666241 - DNA, 317 bp, Homo sapiens
tagaggatcccctaggctgcgaaggaggggtaagtaaaaccaaccgtgaatgtgctctcaggaactgagtcaccaggggggaagacagaccttatccaaggagctccactaagaaacagaactgatgagaaggtaagaaatgcggttgtcttacggcaagtcacaaaagaatatgatgtgctctggggtaaccatggcaggcttccctgaggaagagacccctgaactgacacctaaggactgattcagagttaatgcatgatacagccccagatggagaagcagcatgtgcaaacgtccagaagatacctacagca

SEQ ID NO: 666242 - DNA, 210 bp, Homo sapiens
aggctgggcacacagaccctgtctctaagaaaaaaaaattttgaataggctgggtgtggcggctcacgcctgtaatcccagcactgtgggaggctgaggtgggagatctcttgagccctggaattcaagaccagtctagtctgggaaacacagcaagacccgcctcgctgggcgcggtggctcacgcctgtaatcccagcactttgggag

SEQ ID NO: 666243 - DNA, 518 bp, Homo sapiens
atatgttgtctctactctgaccactgaaaatgttgttcatatggtcacagctacatcattctcctgttctttgccctgctaagaatgctgtccttcacttttttttcaaatcctgatttttaggaatagtcaagttcccctatctcctttgagtccacttttgctttttctttttttcaccatagcaatacttactatctttaccactcactgctctattttgagatatatagtatcttgtattattaataaaaatgccctgtttgcataccttctcttctttgtatactgtaaactcctgtataataggaataatagctttgatttttgtagttactctttaaggatattttcattgaacttgtaatatatccagattaacatatgggccaagtgcagcggctcacgcttgtaatctcagtactttgggaggctgaggcaggtggatcacctaaggtcgggagttcaagaccaggctggctaaaatggtgagaccctgtctctactaaaaatacaaa

SEQ ID NO: 666244 - DNA, 312 bp, Homo sapiens
cggtgtatcatgtttcccccgagacagagtctcgcttcagcccaggctggagtgcagcggcccaatctcaattgctcactgaaacctccgtctcccaggttcaagcaagttctcctacactcaagcaccatacacatgaagatacgctgggactacaggtgtgcaccacaaagcccggctaatttttgtatttttccgttgagacacgggctttcagcgtatgttagagccaggttggtctcaaacttctggcctcaagcaatccagatccacctgcctcgacctcccaaagtgctgggattacagcgcgtg

SEQ ID NO: 666245 - DNA, 843 bp, Homo sapiens
caatcttgaatcatgaacgctactaaccagagactggctcttatcgcgagattttattccctcaaagttggccccaccgttaaagccacagctgcgcctgcagtgagcaccgcctgaaactcaggaccttgagtcatatacagttaccaaacgggcttggggaagggaacatatgggcaagatagactcctgtctcaaagacataggagtgttcatctgactcaagacgctgcgaagttaagtgcctgccggcagtataatgaaccaaccattatgctggcgtcttaaaatcctagtctggaggagtaaatggaggtctgaacgatttcaaggataaaccgtgtgaatttgaaaccagctgggttgtggaaattaaagtgtggagcggtcacatgtggaacgagcatagagtgtatactagtgggaaatagcctagcggaggtggatggttgatcatactcaataggagttcactggtcccatgtgccccatggtcacgagaactaccgtcggttgggcaagtcaggagaccgttccacctccaggttcagattggagaaagctggtggtcttttcgccagtagactccttgtcttggacacattggctgctgcagcttaccggaattccttgggttaaacccggatttgggcctggtatacgattggcacaggtgcctcccacgagttcccttcattcgtcagaaccacttaccgctccagccagtgcttggaggcaccgggggagacacctgactgacgtttttagaggttctcacatagggtgggtgggagcctgggccaggcccaccgtgcgtgacactcccccatgtcccttcccccc

SEQ ID NO: 666246 - DNA, 468 bp, Homo sapiens
  misc_feature (6)..(6): n is a, c, g, or t
  misc_feature (24)..(24): n is a, c, g, or t
  misc_feature (49)..(49): n is a, c, g, or t
  misc_feature (59)..(59): n is a, c, g, or t
  misc_feature (102)..(102): n is a, c, g, or t
  misc_feature (109)..(109): n is a, c, g, or t
  misc_feature (326)..(327): n is a, c, g, or t
cggccngggggggggtttttgggntccagcgggaagactgatgttgggnccatcgggtncggattggtgctaatttaaaccaaaagggcctctggggtcttntggtccnatattttacaatttagacttctgtccaacactaatttattttgtcttgagttgtactgcgagagaagaatatggggttttgtatgcccgtgttccttaaagccaagggtttgaaagccacgctggtcttctgagattccaagtccttccccagctgacatgcccgtagccccttccgactcagtggggcgagcgctcaacacggatcgccccccccnncccagttctccatatcagggtagaagatctaggcactacatatgtaattggtaaagaaaaggcattttcttaagagttataactatgtaaacattgtataatgatatgaaataaaacgcacatttaggacattttctaaaa

SEQ ID NO: 666247 - DNA, 275 bp, Homo sapiens
  misc_feature (2)..(2): n is a, c, g, or t
  misc_feature (4)..(4): n is a, c, g, or t
  misc_feature (11)..(11): n is a, c, g, or t
  misc_feature (16)..(16): n is a, c, g, or t
  misc_feature (38)..(38): n is a, c, g, or t
  misc_feature (48)..(48): n is a, c, g, or t
  misc_feature (56)..(56): n is a, c, g, or t
  misc_feature (60)..(60): n is a, c, g, or t
  misc_feature (77)..(77): n is a, c, g, or t
  misc_feature (83)..(83): n is a, c, g, or t
  misc_feature (93)..(93): n is a, c, g, or t
  misc_feature (96)..(96): n is a, c, g, or t
  misc_feature (104)..(104): n is a, c, g, or t
  misc_feature (108)..(108): n is a, c, g, or t
  misc_feature (113)..(113): n is a, c, g, or t
  misc_feature (115)..(115): n is a, c, g, or t
  misc_feature (119)..(119): n is a, c, g, or t
  misc_feature (130)..(130): n is a, c, g, or t
  misc_feature (147)..(147): n is a, c, g, or t
  misc_feature (155)..(155): n is a, c, g, or t
  misc_feature (158)..(158): n is a, c, g, or t
  misc_feature (167)..(168): n is a, c, g, or t
  misc_feature (170)..(170): n is a, c, g, or t
  misc_feature (178)..(178): n is a, c, g, or t
  misc_feature (180)..(180): n is a, c, g, or t
  misc_feature (186)..(186): n is a, c, g, or t
  misc_feature (210)..(210): n is a, c, g, or t
  misc_feature (215)..(215): n is a, c, g, or t
  misc_feature (233)..(233): n is a, c, g, or t
  misc_feature (260)..(260): n is a, c, g, or t
  misc_feature (264)..(264): n is a, c, g, or t
gnantaataanccaantaatcttggagagggccccaanttgggtcccnttgaacancaanatggcgtcacgcattantatttncctatgattnccngcaatganaggngattncntctnccacactgtgncttaacttactcagacntggagacncgnatttttaanngnaatacctnanaggcantcttttattatctcttttcttacntcaanctttggttccaccttaanagtgttttcctgatgctttcccaagtncagntcattggcctc

SEQ ID NO: 666248 - DNA, 945 bp, Homo sapiens
gatcctctgagatggccccagaggctgatccagaatgcaggataacaacccattcagtttccagtcggatgtctactcctatggcatcgatattgtatgaactgatgacgggggagcttccttattctctatcatcaacaaccgagatcagatcatcttcatggtgggccagaggatatgcctccccagatcttagtaagctctataagaactgccccaaagcaatgaagaggctggtagctgactgtgtgaagaaagtaaaggacgagcggcctcattataatcacccagatccatgtcttccattgagctgctccaacaactctctaccgaagatcaaaccggagcgcattacagagaccatccatgacatcgggcagaccacacatgaggatatccatgcttgcacgcatgaccacgtccccgaggctgcctgtctctctagttgacttagcaactgtattcaggctgccaggggcaggaggagaagccagaaggcaaccactatatatgcatccctttctacagaggaagacaaacaatgtagcagagaagatgcatgctaagggacacattctagatgctcaaagggccataaaatcatagatagactatacatacatatccactatagggacctgggagaaggcagcaaatagcagagaaggagagatcaaggagcacccaacacatccacaagcacaagacaacacaagaggacgcacacaagcaaatgaggaaacaaaagacaggaccaacacacaagagagaaacaaaaaaaagagaagaaagaacaaagcagagaaacaggaatgagaagaagagacgtacaaggcaacccacagagaaaactggacagacaaaaaaagaatcggcaaaccagagaaacagaaagaaaagaagaaagacaaaaacaacatacgaggattcactagggctcaaaaa

SEQ ID NO: 666249 - DNA, 358 bp, Homo sapiens
gcttgccctgcgatggcaatggcctttttttcaaaatactaatttgtgggcccatttgtttaaaattatttgaaggcagttcagcctaatttcagtgttttctttttggggtagatgagatggattttttatatttttgggaggactttttaatgagagaattgtccaatttggaaagatttatttagccttaggttacatgggcagtttagcttaagtaaactgtatatttattatccaaccccagctgtaattggaaaagttgagaggaaaagcctgagatccccaattagggggaaaaaaaaaaagggattttttaatttggtgtatttaattccttgtcccaggggggaaatga

SEQ ID NO: 666250 - DNA, 450 bp, Homo sapiens
ccattgccaaagaagaaaaccttagtatgcaccagatgctggatcagactttactggagctaaacaacatgtgaaaccctccttagctgcggccacattctctccccctccccccatgtttaattttgtctttaaacacatgcttaccgtgaaaccccttcaatgcgtttttttttatatatacttttaccactgtcactgaaacatctgccgagagccagctagggcaggagttggggaaagacgcgcagaaaggcaagcccgagtcagggcacttgttatttaaatgtgccatttcccaggttgccacccttcatagagttttaggcatgcagtttgcttagccagtgtaggaagcctcatgagaacagaaaccattaacagccagaagtgccaatggtgggatcagcaggaaagacctgatgttggagacaatccgggttgcggatt

SEQ ID NO: 666251 - DNA, 325 bp, Homo sapiens
  misc_feature (293)..(293): n is a, c, g, or t
gaatctgagctgaaaagggagatctgagaaaggagcagcacagggagtggattgatgggaatagtaccagggagggtgctcccctcagggcagaccacagccagagcaaaggcttcacctgcttctgccaatctgaactctgagtaccaagagtcaacttaagatagtgttcctgggatctacaagtggggttcaagtatcgagtggagaataaaaagttttcccggtctgggcgtggtggcacacatttgtgggtcccagccaatcggggaggcttgagccccagatttttnaggagtgcagttgagcttaaggtttattcccc

SEQ ID NO: 666252 - DNA, 201 bp, Homo sapiens
ggagagcatgtaacaaatactaatgtatgcaggcttaaaacctaatgacaggttgataggtacagcaaaccatggcatgtatacctatgtaacaaaactgcacgttctgcacatgtatctcagaacttaaagtaaaatttaaaagaaataataattgctttctagggttgtttcactacagaaattggacatgtactttca

SEQ ID NO: 666253 - DNA, 526 bp, Homo sapiens
  misc_feature (35)..(35): n is a, c, g, or t
  misc_feature (470)..(470): n is a, c, g, or t
  misc_feature (524)..(524): n is a, c, g, or t
aaatcagggccctagaatggaaaggattaggtaanagacccatagtgcagatcctactgatgggtgaaagaaagtatatatttaagagaaaatttaaatcccctaatgaagtggaatcctccaagccccagggggcagcaaactttggtaagagtattaagtaaaatattttaaggtgttggtgggccctcctttgtataatcctccgtcttttacaaagcttaaaatatagaaccgtgcggctgagtgtggtggttaggcctgtaatcccagcgctttgggaggctgaggcgggctgattgcttgagatcaggagttccagaccagccttggcaatattgtgaaacaatatgtctctacaaaaaatattaatacaaaaaaattagctgggtatggtgatgcatgtctatagtcccagctacttgggaggattgcttaatccagggaggtggaggttgcagtgagttganggttgtgccactttactccagcctgggtgacagagcaagaccctatctcaaaanaa

SEQ ID NO: 666254 - DNA, 427 bp, Homo sapiens
  misc_feature (285)..(286): n is a, c, g, or t
ccattgccaaagaagaaaaccttagtatgcaccagatgctggatcagactttactggagctaaacaacatgtgaaaccctccttagctgcggccacattctctccccctccccccatgtttaattttgtctttaaacacatgcttaccgtgaaaccccttcaatgcgtttttttttatatatacttttaccactgtcactgaaacatctgccgagagccagctgacatgcccgtagccccttccgactcagtggggcgagcgctcaacacggatcgccccccccnncccagttctccatatcagggtagaagatctaggcactacatatgtaattggtaaagaaaaggcattttcttaagagttataactatgtaaacattgtataatgatatgaaataaaacgcacatttaggacattttctaaaa

SEQ ID NO: 666255 - DNA, 1270 bp, Homo sapiens
ggatgacatctcccccgactggtctcctgagcagtgtctgcggagccatggagccggccagcccgacccgacccgactcgctgcgggcacacgcacccaacgcactccgggcctgcagccccgccgccgccatctgaggagccttggggacgcgaagggccagcctgctgctgctgtcgcgcttttcccaggcccctgagccaagtggggcacttgtgacctggccggcgctgtacggcctgctgacctatgtgacctggcgcacctgggaccctgaaccagaaccacagtgcactagctgcattactagtcacagccctcagactgaaaacctgcctgcctcgaggccttcgttgccgcaagctaatggcgcggcagctagctgcgggcctggctggtgctagggggctggagccctgacagacttggcctggcaacacacagttgccacggcaccacatctccagcagacggcaccagagacgctgcggggagaggctactgcagaagctgacggattcatgggctgagatctgcccattacgcggtttgcggacctgacgcacctgctggctctcttgggataccctggaggacccgagttggccccgcaggcgcttgaccccttgacactttacaatctgcccgggagagcccatcctctcgatggacgccgggatagattcttgggagcaggggtgggtcatcactgggcttcctacctttgtgatggtgccttgaaccccgggaccggtacaccccaaaagccggcatactttccctcgtatcgttttgaccacgagagaactccgccttatacccttggcgtcccaaagacacatgggatgtactccgcaagttgatgatgcacgcaagagatgaacaccaaccagggcaaaggtaccccacataggaacgctaagaagtcaacgtatcccgctatgacagtcatcatagaacatacttgctggggcccaagcccgcttgtacccaagagttcacacgacacgtggcacgtaccttggttggacgttcaacgcgcgtcccagagtccactgtgccccttgagagaccctgtatgcccaccagcaaagtgcacagaccccatggctaggaggtacaagaagtggccagcaggaaagggccctcaggaggtggctagactcgggcaccgatataccataacttggctctggggactaagatgcacgaacgcgtcgagaagagaggccgagaggacggaaagaaccagaggtgaaccgcaggcggg

SEQ ID NO: 666256 - DNA, 581 bp, Homo sapiens
  misc_feature (4)..(4): n is a, c, g, or t
  misc_feature (15)..(15): n is a, c, g, or t
  misc_feature (31)..(31): n is a, c, g, or t
  misc_feature (48)..(48): n is a, c, g, or t
  misc_feature (60)..(61): n is a, c, g, or t
  misc_feature (71)..(71): n is a, c, g, or t
  misc_feature (77)..(77): n is a, c, g, or t
  misc_feature (84)..(84): n is a, c, g, or t
  misc_feature (98)..(98): n is a, c, g, or t
  misc_feature (119)..(119): n is a, c, g, or t
  misc_feature (121)..(121): n is a, c, g, or t
  misc_feature (128)..(128): n is a, c, g, or t
  misc_feature (151)..(151): n is a, c, g, or t
  misc_feature (464)..(464): n is a, c, g, or t
accnaccaaaaaganataagagttttatttncccttaaaacagataantaacatgaaaannatggattgancctccnttccaancccaaagggtgacnttccttccttcctttccaaancncctaacnagattgcctgtaatgtgccatcncaatctgattgaatctgattgaattcagtaataaacctgtttcttttttttcctacgtttgtaaagagaattcactggattgacaggagattttagttttaattatttccccagcatcagtagtactttgaaaaaatattctacctctggcactacagaaataaaaatttttaaagttttaccttgaaaagtaaatttttttaagtttttaaagtttctttaattttaaattttttaagtttaagtttttaaaatcttttttaagttttgttaagttttaccctgcaaagtaaaatttttttaagttttaccntgaaaaaatttttttcattgagtgttttgtttagttctaactgtatggtagctaacagtataagttttggagtcagaatgattgggtaagctcgtgccgaattcctgcagcccgggg

SEQ ID NO: 666257 - DNA, 483 bp, Homo sapiens
atgcttcagaaaaatgtaatattgaaatagtcccagagaggtagtacaatgtggtgattaagaacgcagaccctgggaccggccgaggttccagtccccactctgccatgtataagctgagctttcttgagcaaattccttaacttttccatgtctcagtttcctcatctacataatggggttaataacagttgctgtctcctggagttgttgtgaagattaaaccagtaagcctctgagtgaagtgctctgaacaacaccaggatatggctaaggactttgtaagtattcactgttaccaaaaatgctggttattagctgtcactttggacaaccaatcatagttatagaaataaaatagaatgtaaatgttgttaatcttcccaatatgaaataaaatcacatagtcaacaaacattcgggactgattgttaatttcctcaccttttatggagagtcactagtagacagtgcctagagtgg

SEQ ID NO: 666258 - DNA, 375 bp, Homo sapiens
  misc_feature (354)..(354): n is a, c, g, or t
  misc_feature (368)..(368): n is a, c, g, or t
tgagacagggtctcactctgtcacccacgcgggagtgcagtggcatgatcgtagctcactgcagaccagctctccctgggctcaatcaatcctcccacctctgcctcctgactaactgggactacaggcatctgccaccatgcctagctaattttctcttattcttagcagagatgaggtcttgctttgttgcccaggctggtctcaaatttctgagctcaagaaatctttccaccttggactcccaaagtgctgggattataggcgtgagccaccacacccagcaactagttatttttaaagatttatttttttctttttccttttttgagacgaagtcttcactcttgtcgnccaggctggagtgnaagcttc

SEQ ID NO: 666259 - DNA, 471 bp, Homo sapiens
acctgtgttcaacgacatggacaggactatttcgatacgtctgttagacaggactctcaagacaggcacaatggctcacgccatgtaatcccagcactttgggaggccgaggcagttgtggatcacctgaggtcaggagttcgagaccagcctggccaacatggcgaaacactgtctctactaaaaatacaaaaattagccaggcatggtggtgcacgcctgtaatcccagctactggggagggtgaggcaggagatgcttgaacctgggaggctggaggttgcagagagccgagattgcaccttgcacgctgggctgggcgacaagagcgggactctgtctcaacaaaaaaaaaaaaagggccgggcgcggggcctcacacttgtacccccaaacatttgggcaggctgaggtggttgcaccgcttgcggccaggctttcgaacccagactgcccattttggaaaacccc

SEQ ID NO: 666260 - DNA, 714 bp, Homo sapiens
tgtggtgagcactggccccgcacagtgcacaggcagagtacaagtcacaagctgagggagttgtggattcaggccacatgcccaccccagcccagtcaaaatggctgaggggggctgcaccagcccaagggccccatggggatgcctgggcaccaaggtaaataaagttcctagttcctggaaaagttgtaaagcaggctatcagctcacagaggagctacaaacatacctcacttcatcaaacaagctgttcatttcaccaattagtcgctgattttcctgttcaaactgtgaggaaacagacacactcaggatgacatcatactgaacttaggcaagagtctagcaagaaagcggacctacgctccaggaatcactgccgaagcccccatttccagctgcggcaacgtggcagccggtgctggacgaccgttagcattagtgtgaacaacgtccctgctttcaggagaaagttttaaaaaacagctgtgctgcctggtaattgacttctccatctcaaccactgcactccagggtacaagctgactgctatggctgtagctgtatctacctacccgctctcccctgggatcccacggcctgcttcctgactctagtaccattattaagaaaattcttttgttgttgttttctctcatgaactatactgaaggactatacatattttttaatatggagaaggatctggtgtgg

SEQ ID NO: 666261 - DNA, 4631 bp, Homo sapiens
  misc_feature (15)..(15): n is a, c, g, or t
  misc_feature (4462)..(4462): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 666262 - DNA, 4735 bp, Homo sapiens
  misc_feature (15)..(15): n is a, c, g, or t
  misc_feature (4462)..(4462): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctctgtatttttagtagaaacggggtttcaccatgttggccaggctggtcttgaactcctgaccttgtgatccacctgcctcggcctcccagagtgctggaattacaggcgtgagtcaccgcatccggacaagggcgtttcttatataacagcagctacttgggaggctgaggcacgagaattgcttgaacctgggaggcagaggttgtagtgagtcgaggttgcgccactgcactgcagcctgggcgacagagcaagactgtctc

SEQ ID NO: 666263 - DNA, 806 bp, Homo sapiens
caccgcgcatccggtcccctgcttggaactggctgtgaaggacccagtgagagacagagatgcgaaccaaccaataacacgtcacagccctgtccccgtgtgtgccctgagactagacacagcatgcctcacgctcccaggaatgcatgtggtttcctggtgcttcccacggaggagtccggcagccagacttctggaggaactggttgtataggaagatcctagtgagcaatattcagcctactgcctcggatctctccagccgaagtctgtggactgcaagtctttgctgatgcttcgtgggctcccatcagcctctaacatccttgtctgggtctaccagggaacgcttcagtttccttggggctgctggtttcgtggtttgcggggcctggcagaacatcatcttctccccttggcagtgtccagggccctggatggtcctcttaccaacttctggtcttccaggctctcaaatagctgggaaccagaactctcagcgtccagctctacgcagttcatcggttttggggccacgatggcagacctctgacactcccacgccttgatcctcctggaacgggacctggttggactaactggtaacctgggacccttgacacctgttatgggcccagcgcgcaatggttctcatgggaacgaagattccacgctgggggcattttccatgcacataactactgccccaatttcacactctacttccttaacaactccttggtgagccaccagacatgttatacaacacacgtctcacatcactgccataaactgcgcatcaacca

SEQ ID NO: 666264 - DNA, 394 bp, Homo sapiens
acatcatacatttaatttctaataatttaattacatacatttaatttctaatcatcagagaaatgcaaattaaaatcacaatgagatatcatttcacaccagtcagaatggctgttttttaaaagtcaaaacataatagatgctggcaaggctgtgtagaaaacggaacacatacactgctggtgggaatgtaaattagtacaattataatggaaaacaacatggagatgtctcaaagaacttaagatagaactaccgttcgacccagcgatccattgctggtatatacccaaaggaaaataaattgttctacaaaaaagacacatacacttgtatgttcattgcagcattattctcaataccaaagatatggaagcaactgaggtgtccatcc

SEQ ID NO: 666265 - DNA, 4408 bp, Homo sapiens
  misc_feature (11)..(11): n is a, c, g, or t
  misc_feature (44)..(44): n is a, c, g, or t
  misc_feature (46)..(46): n is a, c, g, or t
  misc_feature (4239)..(4239): n is a, c, g, or t
cgagagggcanaaaaccttcgggctaggtacgaggcctgggtgntngggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 666266 - DNA, 4287 bp, Homo sapiens
  misc_feature (15)..(15): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagatctaaaaataaataattagcaggcaggtattttatttccataacaggattcctttttgaaaacagaaggagtcacatgtgaccctgcgcttttgctctgtgtccctgtactggggagcagtcactgcctctgggcccagtggccatccggacacacctccactggggcacttaacactggcattttgcctg

SEQ ID NO: 666267 - DNA, 81 bp, Homo sapiens
  misc_feature (54)..(54): n is a, c, g, or t
gacccaggaagaagctgtttgaatccagcaggctcagctggaggctgagatcanaacctctcatggaaagtggagcgtgca

SEQ ID NO: 666268 - DNA, 4572 bp, Homo sapiens
  misc_feature (15)..(15): n is a, c, g, or t
  misc_feature (4403)..(4403): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgccatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 666269 - DNA, 922 bp, Homo sapiens
gctctcggcttgcggctcggagcgaggccaaggtgcaacttccttcggtcgacccgaatccgggttcatctcgacacgcaagaccgccttccactcgatgtccgtctgaaattcgactcctcaagcagagaattctaaagttccgttaataccatgaagtgtagcaccgagggggctgaaaggtcggggccgagttttctgccacttggtcccacaagatctgggctcccctgggatctagttgttcctcaatataaaacgtgtcggtggagttggacagtaagccgtcacggccaatcgagagttgacctagtaaggagtggcattgacggaatgtagcggcgctgataaacatgactcgagttcatgagacaacggatctaggcccccacgagtgcgggatggtggggtaggcaatacgtgccatcattgggccatgaatcaatcaaaagctccttctagaggtataccaccccaaggagcaccacgatagttgcacaaccaagacaagaacattagtcctagacgcttgtgggaactaatcgattgtgtttagtatgatgatgagtccaaactatgtggctgctgaacaatgatggttgcgtaactgaataagctttaatagtcaaggatgtaagcttccttgcgtagagaaatctctactctgaaaacgcagagtctctagtaggggacattggcaccaagttccaagtggtgagccttcgcttaaatggtgcgattggggactcgtcctgtctagttccaattgaaccaattcgattccggaagtgcaccaatttaaacagtctgggagctatgatgtgaaattgccccaaagcccaggttaaaggcaccacagcggaaaaaccaatttccaacttaacagggaatccatttgaaccaactgggtgggaaccaaaag

SEQ ID NO: 666270 - DNA, 1197 bp, Homo sapiens
agctggtggtcatcaagcagaacggagctgtcatcaccaacaaagggcggaagcagatccgagagcgcgggctagcttgctttcagaactgggtggaagcagccgatgttttccaaaacttctcggggtgaccagggcagttgctggaagttcagggcaactatcttcaaaaagggcttagctggttcccttctctgctgaggaatgtcattgtagagtcaccatgctgtgacagagagcataaactgctcaggaaagaactacgtctgccccctgtgggtcctagagctccgttgaatgtttatttcttacacctttctccaccggtgcctaggatccaggacacatcagccacgagttaacagaactctatgcaagatgctctttcctacaggaaatttctttgataaattgacctatggaggtgatacattttctgatgacatttttgtgatgctttggtaaacgtatttattactcaggtttgtagactgtgtaatttaataaaccaacactcacactttgaaaaaaaaaaaacaaacacaaaacaacacacaacaaaacaacaaaaaaaaagagacaccacaaaaaaaaaacaccccacacacacacagcaacacaaacggcggggccacataaacatacacccgcgagggccacaaagaggcgccacacctcctttcatagaacaacataggtgcccaatcaatgagcagctatcatcacatacaaacgcgcgcgcggcactcctatcacaaatataccgtggtaagagacatcagtcgtccggagtcattctatgagagagacaccacccatgtggagggcacaaaatcaggcgaccacctcccacgataaatcactccggaggaagatacaacaaccgacgacgatgggatcgccacacccacacttattgtggcaggacaaaataacgctcgctcggttgttttcaaaatcacgcggcggcggactacgtcagcctaggtgcacgcgccactggtaggacatggcgccgcgggcggctgggggaggggccgtgctagtggcatgtccgtggcaacgatgatgcagcgaaggaacgactcatgacatcggtacgccgactgcattcacgaacgcgctatgtcaccaccaacgcaacgcgctgtcattaggcatgacatagcgtcatcagccactgccgaccgatcgcca

SEQ ID NO: 666271 - DNA, 3917 bp, Homo sapiens
  misc_feature (15)..(15): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgccttcataaaaagaacagattacatattaactattagcacttggtaatctaacaggactgttacacacttctaaagaatcctatc

SEQ ID NO: 666272 - DNA, 4318 bp, Homo sapiens
  misc_feature (15)..(15): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaactgtgaggaaacagacacactcaggatgacatcatactgaacttaggcaagagtctagcaagaaagcggacctacgctccaggaatcactgccgaagcccccatttccagctgcggcaacgtggcagccggtgctggacgaccgttagcattagtgtgaacaacgtccctgctttcaggagaaagttttaaaaaacagctgtgctgcctggtaattgacttctccatctcaaccactgcactccagggtacaagctgactgctatggctgtagctgtatctacctacccgctctcccctgggatcccacggcctgcttcctgactctagtaccattattaagaaaattcttttgttgttgttttctctcatgaactatactgaaggactatacatattttttaatatggagaaggatctggtgtgg

SEQ ID NO: 666273 - DNA, 3965 bp, Homo sapiens
  misc_feature (15)..(15): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctgggcagggacgggagcacaggtgtttttatcacacaggattttggtttgagcagccctgaaatgcccccctcttcccacgtgctctcctgatcctggctgtaactatgggtgtcgttccatctgtgcttaccttgaatagatggcttttgagatccaccagaagacaaatgggttatatttccctctgtttggccatcatttggctcctgcacattctccctcacacaactctcggaatcactcccttctgtcccaggtttaacgggccccgagcaagagt

SEQ ID NO: 666274 - DNA, 4393 bp, Homo sapiens
  misc_feature (4224)..(4224): n is a, c, g, or t
cccctccccaacccagcactaaggagcaccctgctctggtctccgccaccacccagcgcctcctggacccatccccccaaacccttgaacgtcctcaggacccccaggcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 666275 - DNA, 323 bp, Homo sapiens
ctgtaagaactgcaacacgacatttacttttatggaggacagttaggagaaaatgctagtaagcatactaggggcacgctagagaacggtttcaaagtcaagattagcactttaaattttaaataataaattacgttcaggactgaggatcagtgattgtaaactgtgctttaggaagatcactctgaccactatcataaataatttgagaagacagataataaaggaaaactaagttatgaaacaattaaaataattccaacagaaaagaattgaacattgtgaccaggtgaagactggagcttctgcccaagtgggtgggt

SEQ ID NO: 666276 - DNA, 102 bp, Homo sapiens
tcagtcgcgtgtgctatacctggcccgatgtagcacacgcgggcaacgaccaaattcgaacgcctgccctaatcaactttcggatggtagtcgccgtgccta

SEQ ID NO: 666277 - DNA, 511 bp, Homo sapiens
tctctgccccaggtggtggttcaacaaaaggagtttaaattccattcccttcagattttaaacctttgggtttttttaaaaaggggtggtcattaaaaaaaaattttttaacagtttcccggggtggggggaaatgggtttttccaacatcgaaccggtccattgtttttttggctatgggggggtttggaacccccctttttttcctctttaagggcctcgttttttaaattaaaccctccctctttgcgcgaggaagaaaagagtccccacatggggcgcggggcgagatttaaagatacacacccttttgggggggtggctttttgttgtttaaaaggagcatacccttgtaattgaagggggcgccatctgctctttaggcggggggggggggtatatatgagggagcccagctaagtcctgggtgtggggtaaccacggacgcgtcgtaatatatctgtaggagcgtgtgggtgaaaagataggtgatatcctcgagtttttattt

SEQ ID NO: 666278 - DNA, 118 bp, Homo sapiens
aagctgaatcagacgggccgtgtcaatagtggaaacagagctactcctttcgtgcagagccacctctctatctgtttgggtcaagtatagtctgagtgcgacatgtagacagtggtgc

SEQ ID NO: 666279 - DNA, 631 bp, Homo sapiens
  misc_feature (139)..(139): n is a, c, g, or t
tctacaggagcttcaacaccgcatcttcatggaccagagatattggatgttccttccacagttcaaaagaccctttcgtcaccccacctggtatgacactagaaatggtattcagctatctggcacttctagtcagcanaccagtgtttgtgcacaaatgatcttttgaggacatagttttaggcggaccacaccggccacaatgggcacccccataaggcataggccaagaacataaccgccgaatgtaggtgaggaaatccaaattggtcacatacccaggggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcacagaaagaccagcagaggcataaggttcgcgaagaggttgttcccgtgggcactctgtcaacgaaggcttgaaccaacctacggatgactcgtgcttt

SEQ ID NO: 666280 - DNA, 87 bp, Homo sapiens
  misc_feature (18)..(18): n is a, c, g, or t
  misc_feature (66)..(66): n is a, c, g, or t
atgattactatggttatnattatcacgactatcgtggaggctatgaagatccctactacggctatnatgatggctatgcagtaagag

SEQ ID NO: 666281 - DNA, 103 bp, Homo sapiens
ctgtggtgcatgcatgtggacgactccggaataccggaatgagatttcagagatgaacgggcatccaagaaggtgcagggtgagatcgacaacatccagaaca

SEQ ID NO: 666282 - DNA, 310 bp, Homo sapiens
  misc_feature (125)..(125): n is a, c, g, or t
tgctgctgactattatagtgtatgcggggaaacgccatatcgggggcaccgatattaggggaactagtcagttgccaaagctccgatttggatgggtattactatgaagaagattattacaaatngcatgtgcctgtgactgataaccgttgtagactgtgcgtcgttaccttagaaaggttgccgtggctggcccagcttcggctcgaactaaggaggcttagagctgtgcttaggactccagctcatgcgccgaataataggtatagtgtcccaatgtcttggtggtgtgtagagaatagtcaacggt

SEQ ID NO: 666283 - DNA, 842 bp, Homo sapiens
  misc_feature (294)..(294): n is a, c, g, or t
  misc_feature (529)..(529): n is a, c, g, or t
  misc_feature (544)..(544): n is a, c, g, or t
ctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagaggttgtgaactcaccttganattcaggtccaaccaggcaaaaccccaaagagggaaggagtcctataggaagttcaacacccgctgaagatgtccaatgctgtagaagtgcatgcgattctgaggattatgatatagagacagaaaacaattcctctgaatctccaagacaaactgatgaagaacgcagctaaacttgtaaaatcttgacaagagccaagcttgaatgtgactgccagcaaaatggcttactganactaatagcagtggnctctataaatgtgaacttgtgagtttaacagcaaatattttctgataagcagcaatatctgaagcataagtatgatcaaatgtgtgtcagtatgcagagagttctctacatatgctctgataacatgcaaatgatgagaggatccctacattgtatacggatatagacagatttttggacctcgcaacaatgcagaaccatttatgataccttatgggtgacgcgtgagtcagtctctcaacagtaatctactattcagaccagggatgaaagatgggtctcggactgactagccagg

SEQ ID NO: 666284 - DNA, 176 bp, Homo sapiens
ggcagagccaataccctagagattttctgtaatattggtaatttggatgaaggaagctagaagaattccagggatgttttttatccccctatgggctcagtttcctggaaaaggatctgtcccctcctggtccttggtggatgtttaacccctattcctttcaactgctgcctggt

SEQ ID NO: 666285 - DNA, 741 bp, Homo sapiens
  misc_feature (615)..(615): n is a, c, g, or t
gcggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcggggccatgcggcagcgtgacctgggaggctggccggggcctggggccgcatgcgccgtgggctcctgtatgacagcgatgaggaggacgaggagcgccctgaccgacaaggcgccgccaggtggaagcgggccacggaggacggcgaggaggaccgaggacgatgatacgagagcatcgagaaccctggaggatctcagaaagtgccacttctgtgcgcgagttgggtgagcatggcgggcccccggntggagatccaaccacgcgcttatcgagaacttcctgcgcactcaggtcgcacagaccatgggcaccaccgtccttccacaggagcgcattcaggacgtttgccaagaagaaccgtgagaaccttgg

SEQ ID NO: 666286 - DNA, 302 bp, Homo sapiens
agcctgggcaacagagttagactctgtctctaaaaaataaataaatatgtaatataaaaaacaaatgaagttaattttgataatgtacttttctcaatatatcaaaagtattacctgcacagcaaaagaaataatcaacagagcaaacaaacaacctacaaaatgggagaaaatatttgcaaattattcatctgacaaaggactaatatccagagactataaggaactcaaacaactcaacgacaaaaacaaataacctccttaaaaagtaggcaaagaacacaaacaaacatttctcaaaa

SEQ ID NO: 666287 - DNA, 103 bp, Homo sapiens
ctggtgtggagtgaagtcatcctcatcatctgagagccttcaaacaggaagccacctggcatatcccggtatgagctggagggcatgctccagggaagaggag

SEQ ID NO: 666288 - DNA, 572 bp, Homo sapiens
ccctcatgacttctgggtcacctcaagcacatcagcaaggcagggttgggctgacagcaaacctagggggtgtggctgtgagctttgggaatatgtcatagatctggtccttgaatccagggcttaacatttcgtcagcttcatccagtacaaccatctgggtgtatgggggggctagagaagaaaaaaaaagccaatatcatagcatatgaggagggaacggtgggagagatcatatccaacttcgctgataaaaaacagagaggagccaagtagtcggctctcagagtacaaagacggatccttggcccaggaacttccggccaggcagcggggcatgtctcagtcccacattgggcagagaagtcagtcaagaggttctacaggggcgggggtccaccttatactcctagaaacacaaaacggcccccaaccccgttttctgggagcaggaagtcacacccataggctatgcacaggcgcacactcaggggggctaggcacgcgtggctcttgtgtggccttaagtgaaatttctgtggtgcttactcagcataacagagtcaggctgg

SEQ ID NO: 666289 - DNA, 188 bp, Homo sapiens
tttctacacagtgatttagtaataatttaacactactatagaaactgcagagcaacaggaagtggcttaatgatcctgaagggatttcttctgcatggtagctttgtgtattatcacagtcagattctattttcatgttgtgtgtaagcaagtttttttttagctgtagaaacttgaaccgggtaccg

SEQ ID NO: 666290 - DNA, 491 bp, Homo sapiens
  misc_feature (243)..(243): n is a, c, g, or t
  misc_feature (250)..(250): n is a, c, g, or t
ctaaaagccaccacttcctctctaaggagaatggccagcctctcccaaagtcacacagggaggtgatagcattgctttcgtgtaaatatgtaatgcaaaattttttaatcttcgccttaatactttattttgttattttgaatgatgagccttcggccccccttcccctttttgtccccaacttgagatgtatgaaggctttggtctccctgggagtgggtggaggcacgcagcgcttacctngtacacntgactttgagacagttgaataaaagttgcaacacaaacaaaaaaaaaaaaaaataaaaaaaaaaatttttgggggcgttggcctaagaaattttataaacatttgttgggggcgccgggccatgtaagggaaatgggcacttgtccaagaaaaccggggagctaggtggttgggtttttccaataaaaaaacggcgggggggccgggtctttctgacaatcaatggggttcggacgcccgg

SEQ ID NO: 666291 - DNA, 647 bp, Homo sapiens
  misc_feature (72)..(72): n is a, c, g, or t
  misc_feature (82)..(82): n is a, c, g, or t
  misc_feature (90)..(90): n is a, c, g, or t
  misc_feature (97)..(97): n is a, c, g, or t
ggcacgagggcatagctggggctctgcagcgcctgtgggagacgctgtgcctcccagtgcaggtctgcggantgatccctcnatcatganttggganagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgtggagattcccta

SEQ ID NO: 666292 - DNA, 1306 bp, Homo sapiens
ccggatgtgacacgacttaagtgactactctactcggttattcctgtagtctccttaccgcaattgttgtttacgcgaacactgctgcttttctggtacagctgttccctcctcgtctggtgtgtagcgaccccgccgtagaattctggtctctctgctgttgaaagtaacgcctgtcgatgagcgtaaggctctttcatacatctgccttttatgctccgtaattgtaggaaatgctgtcgccaatagggttttactaggtgtggttatataccccataatggatgttcccccttttggtaatgtgtatggtgagagtacagtgaacaactggaaatgcataacctggcctgttacgggatgcatacgggcgtttcagcatcctagacttgggatctattctgttgttgccaggaaacacagaccttctgccacattgatctgatcccctggtttccattcgcggcgcatcaccttgtcagaattgtaactgccaccatattcatccactcaaatcagcagtgcaaggtaattctaggaagtcaggaagcattaacccagacctgtgtacaacatttgtcaccgtgtacataaattcttgcctccactcaggtgattcgtgaacagctctcagactggcactaagctgtcgagcaatccatctggtgatagtgactcctacgatgttagaatctgcatgatctaagctcctgttacagaaggatatgaaagagttaacgaatgcagattcatggaaaagtttaggctatccagtggaaccatgcaggtagtaatgaaatcctcagatgagctcttcatcctcatttagttaagcagccatagattaaggaagtaaaagctcggacatcaggaactcatacggaagcatttggaacattaatactaaggaactaaaagcatctcaagaatatcagagggatcttgggaatggacttgactgtagaatcgttattctcaaataataatacaaaacaagtgctctggagaagagcagaaagtacatcagcagtcatcagaagctcaagataaatccgaactctggcgtgtcaaaggccgtgagtttagcaaggcagcaaggaacaagagaggaggagtgagagaagcgaatggtgggtaccagttagatatcgagccctttaaagtgattattatgacaatgtatgaaaacaaccttggattaaaactcagttctttaaattaaccagtcgacattaaaatgaatggtaaaagatctaaatgcatatggtaaatgactgctttcagattacaagataccaattactcc

SEQ ID NO: 666293 - DNA, 130 bp, Homo sapiens
  misc_feature (18)..(18): n is a, c, g, or t
gtctagaggatccctgtncgggctaagaatattttattgtggacctggagtctttgagagctgctagaagacaaccatggtagtaattccttctttccagcatagttccacaggtctgaaggaacccacg

SEQ ID NO: 666294 - DNA, 119 bp, Homo sapiens
actagaggatcccctctgttaactcagcagctttagggattgctagtggcaaaggcaaggcctctacaggtacccacaccatgcaaattgcatcctggggctcaactggggtaccgaga

SEQ ID NO: 666295 - DNA, 612 bp, Homo sapiens
cgtggtggctcacaccttctatcccagcattttgggaggttgaggcggatggagcacttgaggccagtagttggagaccagcctggccaatgtggtgaaaccccatttcttctaaatatacaaaaaatgttgctgagcgtggtgtcctgcctgtgtagccccagctacttgacgtcctgaggcaagaggctagctgaacctgggaggtcaaggttgctgaacctgagatgatagcgagccaaggcagtgtcaccgatcctaagcgtgtggaacaaagtgagaacttgtctcaagacttcatcaagtttatacatgcggacgtaattggagcttacttggtcaatgtgctctattgtgagtcgctattcagatcaataggccgtcttataacatcatattatctcggaaaaactctggcttaacctaacttaaattgtcttagagaacattcacttttctgcatgttgcgtaatttcgaaaaggtcggcaccgattgcctttaccacaagttgcgtatccttatggccaaaggtaatattaaagcggacatatatggttctggtctatattcattgttcacacttatttttatcctcttgtctgctcgcctcc

SEQ ID NO: 666296 - DNA, 1555 bp, Homo sapiens
  misc_feature (456)..(456): n is a, c, g, or t
gagcggagtaccagcgacttacatccatcagatgcttctgatgacagtccggtggtttgccttcgtgcgcttcaccaccggggatgccatgagcaaagaaggatccaatgcttgtgcccatcaatccacggtggcatcgagttgatgatacggttcagcgggtcttgcttgactgcgtccaaaaaccgtgtgactggatcaaggatcgcctggatgtaatggaggtctggtactgacactttcgcctaagggacgatttcgtagactcgagatgactctggcaagcgagcttgggtagagaacgattttcattctaaagtatgtcgagctgtgaactgataggcgagtggaggaggaccaaatgtgaacggacaggccccacgatcgggagtgaacccccaaggcaccctcgcactaaaacgcatctctcctattgaccgaaaatgcaatacttgnccctagcatccctccattggggcggattgaagggtacaccgtcggtgcacttctgggctttcacataaggaaccctaacccatggtctcgacccaaggggaatggaaaagtatgaatatgtccctatgggaaagcacgtggcgtatgcagcaccgcagattctataagaacatcgatggttgcccaaccggatctcgcccatctggttttctcggtgcttttacccaccttaataagaaaagactttttggggcgagttggttccgctaaatgcattacatattagacacagcattcactttgctaaagtccgagactataatctattttcgagataccattgccttatttgaatctacatttggggctatacaccctcccaatcctcaattccaattggagtccctataagaggccacacaaaagggtccccataaagaaatgaccttgcgcgccaacgggttactcctttggacgctgagagggaatgccgagtgataacccggaagtgtggctccgtctccttggcggagctggtggcaccgcgtgtatatccgcgggcccatttttgtcacctttgtgcccaggcagagaacacatgtggtcttctgggctctgggcgtagctaggcaactttgttgtgggaccctacaccgtgtgggcgttttcccagaaaacgcccgggggagctctatggtttgcgcacgtgttctctcgtgtgcacaccatgtgcgccccgggggtgcccttgttgtgcccacacgtcttgtgggctcaccttgggtgggcaagaaacaggtattagtccgagggcgccctccagctgcctcgataaaaagagcaacgggtgacgacgaaccaatatgtggaccgcaacacacctggtgttagcccgacggacacgtatattcaaaggtgacacgaggatatcaaccataacaactcatatagctcaagatcgctacgtagagaaagtgtcgggcgaccgaacagaacgcagacagtaatcagttgaagtcagagcatcgtaagctgaagagcatcaccactgtacgtacgtagtatatacacaattagttcggtttgttcttggagtagc

SEQ ID NO: 666297 - DNA, 167 bp, Homo sapiens
gtattacgggcattgaactggctgtggctataagattgccagcatcaccgacgtgacgccaatccgatggggctcatcaggcttggtagaagccaatgatgcagaatctcctgcattccagtggacctgggcacaggcttcaatattgtgttggatcatagggaccc

SEQ ID NO: 666298 - DNA, 236 bp, Homo sapiens
tggactcatttggcattcggggtggagtcccagtctatcaaacttcccaccacaagacctaacatctccagtgatctgagccaatcctatagaaggctgatcccctaaacgtctgatggatgcgtctccaatccaattacaatcatgcctctcagaaatgtaccagatagtcagaatcacactctctgcatatactgtgcttccatccaccaaacaaaccccactgacacggacat

SEQ ID NO: 666299 - DNA, 922 bp, Homo sapiens
  misc_feature (426)..(426): n is a, c, g, or t
  misc_feature (464)..(464): n is a, c, g, or t
  misc_feature (807)..(807): n is a, c, g, or t
  misc_feature (831)..(831): n is a, c, g, or t
agtctcaagaaaggggcatgagggcaccctcgtgcaagggaaagtctcatttcttgtcttcaggggtggttacacaacctgtatacaattgtcaaacctcatgacctgaacacttaagatctatatattttattctgttaattatatctcaatttttttaaaaagccaaccaatctaccttcccctgctaaaatgattacacactgatgaataatccaagatggaaacctagaggatgtgagaagatgttgtaagtgagatttcttgggagaaggtgatagctgcctccaatgtgcacaaatacgtctgtgctataagaatccctagaaagaatgttacagagagtgacctcgagtcaacacctactaaggaaatggaaatggaaagtactgtatatttccacttctgtgccagcagatctagggncatcaccggagaggccttttagagtgactagattttgntgaggtgggggagagatggggacaggctttgctagcagtaaatatggcgaccctcatgcctcatccagtggagaaggtggtacatggagatccttcctggggtatttgaggtgttcttcagcttgggagtcaaacgatggatgaaagatcagttggtaagtgtatgctgaaggtggagctgaggtggaagcatcatcaagtcagggatgctggattcgttttaggtgtcagaattgttcttgtgcattgtttcttgaggccagggatgttgggtcctgcctcagataggagatgaagttcatgtgtcaggctcctaatggagaaggataaatcctttatgttnacaattataagaaagtattgagancccaggaggcagagcttgcagtgagccgagatcacgccactgcactctagcctgggcaacagagtgagactctgtctcaggaaaaaaacgg

SEQ ID NO: 666300 - DNA, 203 bp, Homo sapiens
  misc_feature (23)..(23): n is a, c, g, or t
  misc_feature (52)..(52): n is a, c, g, or t
  misc_feature (59)..(59): n is a, c, g, or t
  misc_feature (63)..(63): n is a, c, g, or t
  misc_feature (80)..(80): n is a, c, g, or t
  misc_feature (94)..(94): n is a, c, g, or t
  misc_feature (96)..(96): n is a, c, g, or t
  misc_feature (100)..(100): n is a, c, g, or t
  misc_feature (129)..(129): n is a, c, g, or t
  misc_feature (131)..(131): n is a, c, g, or t
  misc_feature (139)..(139): n is a, c, g, or t
cctaggcaacagagcaagatccngtcaaaaaaaaaaaaaaccgggaaaattntctcggnagcnggtaagagtagttattngggttgtagatttncngtcnggaattagagaaagaagggtcatattttncnttatttcncgtatctaactctaagccggcttttttctcttctcacggattagtaggctctttagtttaacat

SEQ ID NO: 666301 - DNA, 371 bp, Homo sapiens
tatatctcgatcgttatacatgaagacgcatgatgcgtatgtccactgcagcactattcacaattggcaagacagggaatcaacctagatgcccatcaataatagactggataaagaaaatgtggtacacatatgccacagaatactatgcaggccaaaaaatgagatcatgtcctctggcagaaccttgtttttggtggggggccattatcctaagtaaactaaggcagaaacagaaaaccaaataccacatattctcatttataagtggaagctaaacactgagtacacatggacacaaagaagggaacaatagatgccacagcataacttaagagtggaaggaaggaagagggagaggatcaaaaaac

SEQ ID NO: 666302 - DNA, 831 bp, Homo sapiens
  misc_feature (426)..(426): n is a, c, g, or t
  misc_feature (464)..(464): n is a, c, g, or t
agtctcaagaaaggggcatgagggcaccctcgtgcaagggaaagtctcatttcttgtcttcaggggtggttacacaacctgtatacaattgtcaaacctcatgacctgaacacttaagatctatatattttattctgttaattatatctcaatttttttaaaaagccaaccaatctaccttcccctgctaaaatgattacacactgatgaataatccaagatggaaacctagaggatgtgagaagatgttgtaagtgagatttcttgggagaaggtgatagctgcctccaatgtgcacaaatacgtctgtgctataagaatccctagaaagaatgttacagagagtgacctcgagtcaacacctactaaggaaatggaaatggaaagtactgtatatttccacttctgtgccagcagatctagggncatcaccggagaggccttttagagtgactagattttgntgaggtgggggagagatggggacaggctttgctagcagtaaatatggcgaccctcatgcctcatccagtggagaaggtggtacatggagatccttcctggggtatttgaggtgttcttcagcttgggagtcaaacgatggatgaaagatcagttggtaagtgtatgctgaaggtggagctgaggtggaagcatcatcaagtcagggatgctggattcgttttaggtgtcagaattgttcttgtgcattgtttcttgaggccagggatgttgggtcctgcctcagataggagatgaagttcatgtgtcaggctcctagggtctgcgggccggtgctgtaggctggagtcttagcatgatgggggcggg

SEQ ID NO: 666303 - DNA, 420 bp, Homo sapiens
  misc_feature (129)..(129): n is a, c, g, or t
  misc_feature (140)..(140): n is a, c, g, or t
  misc_feature (145)..(145): n is a, c, g, or t
  misc_feature (159)..(159): n is a, c, g, or t
  misc_feature (244)..(244): n is a, c, g, or t
  misc_feature (297)..(297): n is a, c, g, or t
  misc_feature (323)..(323): n is a, c, g, or t
tgagacagagtctcactctgtcacccaggctgaagtgcagtggcctaatcttggctcactgcaagctccgcctcctgggttcacactattctcctgcctcagcctcccgagtagctgggaccacaggcncctgccaccangcccngctaatttttgtanttttagtagagacagggtttcaccatgttgcccaggctggtttcgaactcctgacctcaggtgatccacccgcctcggcctcccnaagtgctgggattacaggcttgagccccgcgcccagccatcaaaatgcttttnatttctgcatatgttgaatacttttnacaatttaaaaaaatgatctgttttgaaggcaaaattgcaaatcttgaaattaagaaggcaaaaatgtaaaggagtcaaactataaatcaagtattt

SEQ ID NO: 666304 - DNA, 254 bp, Homo sapiens
ctgcactgttgttgctgttgctgctgtaagggcatgggacccaggatagggtgctcgtgatagaaagcttgggagcctcctaccagttgcctggaaggaatatacagtagtcagtaggatgaaatcagatgacacaggacgcagacccatggggcttacgggcacgtgacggaccggactacgacacttacctggcagtgacggggacgacacaaggcacatgacggacacgacacgacgaccagtgactacct

SEQ ID NO: 666305 - DNA, 238 bp, Homo sapiens
cctaagtgcctgtgacggatgactagataaataaaatgtggtgcgcacacacacacacactctgcaataccattcagccataagaagaatgaaattatgccattcgcagcaacatggatggaaccagaggccattattttaagtgaaataagccaggcacaaaaagtcatgtctcatgttctcacatgtgggagctaaaaaatgtgaacacatggaggtaaacagtggaaaaatagat

SEQ ID NO: 666306 - DNA, 739 bp, Homo sapiens
ctcttggcagcgtgtagaagaaggaagtgtaggcggggtaagggaatgcaccgtcaggggtctctcacaacccttatcccagactctcctccccaacaatacagtacctggagatggagccctagggtaatcgcaaatcacggggatggcgtccgaaggctgaccaggcatatcagtgggacacacacgtatctgagccattaatgccgcgactcattccgactaacgttaagcggaatagaggctcaccaagccgtaacggggcgttcaggcccaggggaagactaggctccttatgacttcctgccttccaggcctcagattcatcgctagcccccgaggctaagcgccatgcctcatagttgacaacgatgtgaaactgggacttcacaggatgtcgcttcttgaggcccagatacgcagataccgcttaagtctcgtaagtgaggtggatcgtcagctagagatccttttacattctcggaactcaaagcagacatacgtctgtgggtaccctagtcagttgctgccagatatggatactggtgggcacctttgagatggcccaggttctctggaagtactctctcttcactgtcggtccataagcactatagcctcgttcagtggcgagagtttgctggccagaatcctgactgtcttgagcatctggctgcagctcaggcacaggctcttctgacttgagcagctggaacagatctggaactatgcccaggta

SEQ ID NO: 666307 - DNA, 977 bp, Homo sapiens
  misc_feature (893)..(893): n is a, c, g, or t
  misc_feature (897)..(897): n is a, c, g, or t
  misc_feature (907)..(908): n is a, c, g, or t
  misc_feature (917)..(917): n is a, c, g, or t
  misc_feature (932)..(932): n is a, c, g, or t
  misc_feature (938)..(938): n is a, c, g, or t
  misc_feature (941)..(941): n is a, c, g, or t
  misc_feature (946)..(946): n is a, c, g, or t
  misc_feature (960)..(960): n is a, c, g, or t
  misc_feature (965)..(965): n is a, c, g, or t
gtgggggacgtgttctgggcacgaggggggggggaagaggaaccctagtgggcgatgactctcttgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaaggcaaaacacctttacacgctagatggtggggacatcatcaacgccctgtgcttcagccctaaccgctactggctgtgtgctgccacaggccccagcatcaagatctgggatttacgagggaacagatcattgtacgactgaactgaatgcactgacgttatcagtgaccagcagcgaggcagatcggacccagtgcgactccctggcctggtctgctgatggtcagactctggttgctggctacangganaagctggtgnngagtgtggnaggtgaccattgggnacacgntanaagtntatggcaagaggtntacanagtagaaaaaca

SEQ ID NO: 666308 - DNA, 200 bp, Homo sapiens
tcaatgtggaatcaacattttgagcccggtgctgacatattcccatgtattacaggccctcgtgtactagtccactggtctttcttccacaaattcatatacagggctcaggaattttgttcccgctctggagtttacttcgggaagttttagtaaaccgtctatcctttggcccgtttgtttaaaagccccttgaggta

SEQ ID NO: 666309 - DNA, 457 bp, Homo sapiens
ggggggggctttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagcgatgagcctatcccctcagatgggcagtttgccctatcaggctattgcgatggaacagtgcgtgtatgcgatctgcacgcatactagtactcgttgagttagtgcctatactacgccgcccttagcccaccccc

SEQ ID NO: 666310 - DNA, 1346 bp, Homo sapiens
cctctcttactccattcacacgtttgcactaccccccacccagccccccaatcaagctgctgtatgtcaaagtaccccagatatattcatagttgctaacatccaaacggtcatacctatagcccttgataatacacttgaaccatctaagacgcgatggacacaggtgcacactaccctatactgcttgataagcatttctacacagttagccattctaggacatagtgccctactacctggatctacctatacaatatatctagttacatcggacttaatataacttggcatactacatcctatctactattatccaccatgcctactccaacgcgactacagatccttaggacctacttacttataatatacacaactacacgggcacacctatggcaggagcactcgatagatatcaaaaatcagatctatgtaggatttataacataacacatactagtcatgctaggcagactcccacaattatatcacaacctaccagacccttgcataccacattactaccaatataccaagcatataccatctcatctaccagcattaggtccacttacctagcacacgacttacacaacactccgcgactcatcgttacactcaaaacaagactacaaaaacatccatgggacctaccgcgacgatagcgcgacacatcgatggactactttccccactaaaaaacgacacatcacacttcccaacaccatacttgcacactttccacctatacgcacgccgcagagctcgacacgcgggacagaaccatacccccacaataccccttatcacatagagttccccgatcccgaagcaccacatcagaacgccaaacacaaacccacaagcaccgatcagcgcacacacacgcacacccaaaatagaccacaataggccgacgacaaggatacaaaagacataacacaaacgaacacactaaggacgaaaaacacccagtggacgcggagacacaagtacttaccgctacaaaaacacacctatagcacacacaaacacccaaaacaaacaaaaacaagtgccagcagcaacaccaccacctcctacccccctgcgcaccgccccaagcacaggaagcagacaagcgacacacccaacacaacaccaaactcacagcacccggggtaggtacacaagcaacccaaaaagccctcaaaacacaccgaaaccacgcgcgcccagcgaccacgcaccacacacgaccaactcacaaccaacgcaaaccaagacaaaaacaacgcacgcagcaggagcaacacgcaacggaaccaagcacgcaaagaaagacagaacaccgtgacgccaca

SEQ ID NO: 666311 - DNA, 1369 bp, Homo sapiens
  misc_feature (10)..(10): n is a, c, g, or t
  misc_feature (12)..(12): n is a, c, g, or t
  misc_feature (14)..(15): n is a, c, g, or t
  misc_feature (18)..(18): n is a, c, g, or t
  misc_feature (32)..(32): n is a, c, g, or t
  misc_feature (41)..(41): n is a, c, g, or t
  misc_feature (44)..(45): n is a, c, g, or t
  misc_feature (188)..(188): n is a, c, g, or t
  misc_feature (1285)..(1285): n is a, c, g, or t
  misc_feature (1289)..(1289): n is a, c, g, or t
  misc_feature (1299)..(1300): n is a, c, g, or t
  misc_feature (1309)..(1309): n is a, c, g, or t
  misc_feature (1324)..(1324): n is a, c, g, or t
  misc_feature (1330)..(1330): n is a, c, g, or t
  misc_feature (1333)..(1333): n is a, c, g, or t
  misc_feature (1338)..(1338): n is a, c, g, or t
  misc_feature (1352)..(1352): n is a, c, g, or t
  misc_feature (1357)..(1357): n is a, c, g, or t
agggacacangngnnaancggcatagcacttntttgcatantannacttgagactcataaatggtgctgggggaagggtgcagcaacgatttctcaccaaatcactacacaggacagcaaaggggtgagaaggggctgagggaggaaaagccaggaaactgagatcagcaagagggagcccagcatcnaaaaacaggagatgctgaagctgcgatgaccagcatcattttcttaagagaacattcaaggatttgtcatgatggctgggctttcactgggtgttaagtctacaaacagcaccttcaattgaaactgtcaattaaagttcttaagatttaggaagtggtggagcttggaaagttatgagattacaaaattcctgaaagtccattagaaaaaccacaggatgaaaaaaaaaaaaggccacaaagaaggcttcagaggtccctgctggcccagggacagatacctgtagtgtccagcattgcagtgaacatgatctactttcaaaggcagagggtttaaggggagggtgggtgggaatggtggaggcaaaggctctccccatccccacctcagttttaggtagggcttttaatttaacccaaagacatcgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaaggcaaaacacctttacacgctagatggtggggacatcatcaacgccctgtgcttcagccctaaccgctactggctgtgtgctgccacaggccccagcatcaagatctgggatttacgagggaacagatcattgtacgactgaactgaatgcactgacgttatcagtgaccagcagcgaggcagatcggacccagtgcgactccctggcctggtctgctgatggtcagactctggttgctggctacangganaagctggtgnngagtgtggnaggtgaccattgggnacacgntanaagtntatggcaagaggtntacanagtagaaaaaca

SEQ ID NO: 666312 - DNA, 1169 bp, Homo sapiens
  misc_feature (11)..(11): n is a, c, g, or t
  misc_feature (237)..(237): n is a, c, g, or t
  misc_feature (294)..(294): n is a, c, g, or t
  misc_feature (301)..(301): n is a, c, g, or t
  misc_feature (304)..(304): n is a, c, g, or t
  misc_feature (317)..(317): n is a, c, g, or t
  misc_feature (321)..(321): n is a, c, g, or t
  misc_feature (1085)..(1085): n is a, c, g, or t
  misc_feature (1089)..(1089): n is a, c, g, or t
  misc_feature (1099)..(1100): n is a, c, g, or t
  misc_feature (1109)..(1109): n is a, c, g, or t
  misc_feature (1124)..(1124): n is a, c, g, or t
  misc_feature (1130)..(1130): n is a, c, g, or t
  misc_feature (1133)..(1133): n is a, c, g, or t
  misc_feature (1138)..(1138): n is a, c, g, or t
  misc_feature (1152)..(1152): n is a, c, g, or t
  misc_feature (1157)..(1157): n is a, c, g, or t
cggctggtacnggccggagtcttaggatcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacaattgatccctcttcccgcgctcttctcgagattaangacaccatctatccattgtgtggaaacacttgacaccagcggggattgacagacacncaacatnatntcggaaaattccncacnatgccgtggcgtcctatagcggggtctacatccccacactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaaggcaaaacacctttacacgctagatggtggggacatcatcaacgccctgtgcttcagccctaaccgctactggctgtgtgctgccacaggccccagcatcaagatctgggatttacgagggaacagatcattgtacgactgaactgaatgcactgacgttatcagtgaccagcagcgaggcagatcggacccagtgcgactccctggcctggtctgctgatggtcagactctggttgctggctacangganaagctggtgnngagtgtggnaggtgaccattgggnacacgntanaagtntatggcaagaggtntacanagtagaaaaaca

SEQ ID NO: 666313 - DNA, 881 bp, Homo sapiens
  misc_feature (11)..(11): n is a, c, g, or t
cggctggtacnggccggagtcttaggatcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaaccgcagcatcgccgtacctagcgcgccggcagttgtcccggtagcagtgaatccctcgtcctgccgtcatcagacgataagcaccaatcgatcactgtgcgaaatcctgagccaggggagtgagaccagatcgtatggaagttaccaccaggcgatggcgtctgcgaggggtcacttccgcatcgttctggtgtagatgactggtggattagtgcgtcactcatgcacttggtcgcaaggttcttggcgcttcctctagcgcgtcctcgtgggatttggacaccgccgtaggcgccgtcgtggcgtgatctcatcacaccggtgcgaccatctcatctgaggggcgagattttgtggcggccattgaccgaacggaattgtcgcttgagagtgtcggcacttatctccatcttgaacagagccggtgacgagtgtgtcttcctggccattctcggatggatagaaagccgagtcaacgctaatgggaatatccctcgggttgttggtgccaagatcatcgactcgtccaaggtagtgcacgagactcacctcacgaagtgtggctgctctatgctagtcgcgtcgttcatcgccgccaatcacgcagcaaacgccctagtcatcgtcctcctggttggcctggggacatacgctggctcaaggcgttgatggaacgctgggctaaaactaggaaagctggaagacccaacgca

SEQ ID NO: 666314 - DNA, 287 bp, Homo sapiens
tttgagcaagcaggggaaagggagggttaatgggaaactggttttaaatgggaaaagaaaggcaaaaatccaaaggttaatagtatctggtaaaaattccagaaccacgacacaggggctcagtctgtaatcccagcacttggggaggcttaggtaggaggatcactggaggccagaaattcaaggctaagccggggcaacagagcaatatccggtctctggcaaaacaattaaaaaattagccaggcagggtggacatgtaccactaaattccagctggctcagag

SEQ ID NO: 666315 - DNA, 268 bp, Homo sapiens
tatgttcctagctgggaacagggctcacacctgtaatcccagcactttgggaggccgaggcgggtggatcacctggggttaggagtttaacgccagcctggacaacatagtgaaatcccgtctctacaaaaatacaaaaattagctgggcgtgatggatgggtgcctgcaatcccagctatttagggagactgatggtgggagaatagcttcgaacccagggaggaacgaggttgcagtcgagctgagatcacgcctattgcactaca

SEQ ID NO: 666316 - DNA, 370 bp, Homo sapiens
gcggtctacagggtcatacttatgcaggacatctgatatctcccccttaccacgtacagatctctccacagctgccagcagccctaaccttcgcgtctctccaccagctcagagtcctgtccccaccagcccccatccagggcaggagggacctttccaggtcctgggctcgccaccaccatccatgcttggatgccccacagcccactctgttctccaaagggtccctgcgggggcctggcctctccagaaaggtgtcagatggggagcgcccagggcccacgcacacagggtcactgagctacctgggtacctctccctgggaggagagccctagggactgctcagtccatcccactgctcctcgggt

SEQ ID NO: 666317 - DNA, 334 bp, Homo sapiens
gcttgcccttacagattgccaaatcaaactattatcaaatacagcctttttccaggcacctagttctcagactcttacctgctgagaatgaagtcttgacaatcaagatgactgctattatatcaattctgttcatgagaatcagactttatacctagcacaattcactattgtgtgggcgaggacatttaaagggcatatagaagtaaggagtgcaaaaatcagctagggttaacatctaagtgcctgttaatacaaaactagtccacacttaaagggcctatggttccagagaggtaggaaacattgagcctatgtgttacatcctcatccc

SEQ ID NO: 666318 - DNA, 406 bp, Homo sapiens
acagtgttatatgggcaacttcatagttgacctggtcttctattttggtcatccagcaatcaccaggtcgagtatgttagtcccctctgcctatatatcttcccacatattttgatacatacacgagtgtgctcaaacagctgctcataggtagctcgtctggtttcggaggtctaagatttgactctccttgcaaagtaatctttagttaattcattatgcagaagctatgcgggtcagtccttgtcatattacggttggttataatttttgttcttatgctaaaggtacgatatcaacagccacaggtttctattgctattgtatagactgcctcttagaaaatcatatgtctaagtttgtctggcagtaaggtcgcgtggatttgggctcgtgccgaattcct

SEQ ID NO: 666319 - DNA, 180 bp, Homo sapiens
tgaggaccagtctgttggggtccgaaaggaagattgccccgtgtagacacagctgcaccccagctgcagaccgtgggggaggctgggcacggaccggaaacactcgcatcgggacaggaccggttccgctccgggaagcagtgggcggctgtcagcacccagtccccggagagcagggat

SEQ ID NO: 666320 - DNA, 223 bp, Homo sapiens
agatggacaccctgacccttactgtgactcagctgggcctttggagagcatggggagaggccaggagcagacttatgctctgtttgggggccaatcgcagcacaggctcttcctctgcacataaggttccctctgtctaaaatactcttctcccatcttttgggctgactcctactgatcttccgtgtcactctgcagcttctcccaggaagccctcctggat

SEQ ID NO: 666321 - DNA, 444 bp, Homo sapiens
  misc_feature (8)..(8): n is a, c, g, or t
  misc_feature (26)..(26): n is a, c, g, or t
  misc_feature (154)..(154): n is a, c, g, or t
  misc_feature (173)..(173): n is a, c, g, or t
  misc_feature (190)..(190): n is a, c, g, or t
  misc_feature (192)..(192): n is a, c, g, or t
aacatagnatggatggtttcaagaanctcagtccgcctggtgttttggggagcctgttttcctatgtaatcctttaggggttgtctaaagtcttttattatggaaggttttatatccagagtagtcaattaggatataaactttccacacttcngtcgtgacgataaagccangaaggacaaccttgaancngtaacgttggtcattcaatatttgtacctgttttaaatctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagatg

SEQ ID NO: 666322 - DNA, 909 bp, Homo sapiens
tgattctgtctgtcttccttttgaaactccccagactgggtatatcgcgttctattgtcctctcccctgagaccgcattgctcctgtgtgtaactaatcaatatcggccgatgtcccctgctatattttaaaaaaccaccatgttggccaccaatttcttaacctcccagaggccgccaccaatgtgactatgtaccaaacacatcatttttttcgcgtcccgtcacccctctaatgactcatcagaattacctcggtcctaaggtcgttccccgcccatgtcattatttttctccaccgaaactccctcttctccaagcataaacactattggtggggcccccccaacaaatgagacacaccctgtcaataataacagtccgcgcaccccttggtcgcccacaggacgggggctgtcgtttattgcgccctttacgaaacagtgtatggtggtcataacaaggacgccactcgctgataagattttctggggttgctgcaagcaggggagaaaccacgctcttggtgagaagtcgtgaacccacatgggtggtaatatattctcggcggtgactcgcacctgaggactgttgcaggtttgcaccgttcttttcgacggagaattctgcggctagatatctttctacgaggcgtgtatattagagcggcgttaccgccaccttcatgctttgtgacaccaattgccagtgtctcaccatattcaaagtgcggggtgctctccctcatgaacttttcactctccccggggcttcatttaacacaactgaaagatcccctgggcgtatcatttatcgacaatccttcagcatccgccatagaatcggacgcctggttttatgacagttttgtgggcccgacggaaaaatctacattcccgcccacaaaaca

SEQ ID NO: 666323 - DNA, 872 bp, Homo sapiens
ggctgtgatcgcggcctcacgcgtgtgaatcctggcgcacaggacgtgtatcagcgcggggaggatactttgatacctgaattggtaagctgcctgatgaatattgcgagagccatgctctggaccccgtgagtgccccagacacatatgtttacggttgtgaactaaaggccagacaaagattatcagtctctaaggtggataatgatgacaatgagcaccagttatcgttcgaagaacggcagtttaggggcaggttgccgacagggatgagttcgcacatggttggacggcagaggccatgagattacgaaggtgccagtccaaatataaagtaacggtggaaacagttgtgaacagttgtctgaacaagccagaaggttttccctgggggggcttcgaggagtaacaccacacagggtggtcttaaggttgacagtgtggaatcaaggggccacgtgcattgtgagtggaacagcacttagtagctgtggaggatagatgcagagtcagaagatgacgaggaggaggatgtgaaactcttaagtaatatctggaagccggtcctgcccctggaggtggtagcaaggttccacggaaaaccagtaccacttggtgctgatgaatcatgatgacgatcatgatgacagaggactatgatgacgatgatgatgatgaccgatcgatgatgcggacgctgagacaagcgcccggcagaactcatatcgagatacccagccaacaggcccaaggtcaattacatgaacgatcaacctcctcaccagatcagggcagaacttcaaacgaacacctaaaccaaaggcatttgcaacataaggacatcgataaaagtgttcagggcaacacttgca

SEQ ID NO: 666324 - DNA, 484 bp, Homo sapiens
ataaaatttaaggaacgaagctaagtccataacataaaagtgcaaggtaaagcagcaagtgctgacgtagaagctgcagcaagttctccagaagatctagctaagataattcattgaagaaggtggtgctatagtttgaatgtttatccttctaaaccttttgttgaaatttgttccccagcgttggaggtgggacctaacaggaggtgtttgagtcatgggggcagatcccttaagaaggacttggtgccgtccttgtggaaatgagtgagttcttgttctgttggtttctgtgagcatctggcacctcccctctctcctgctttccctcttgacatatgatctctacacaccagctcccctttgttttctgccatgaggggaggcttcctgagctcttcattagaagcagatgttggcaacacattcttgtgcagcctgcagaaccatgagccaaataaacctcttttctttaaaaatagaa

SEQ ID NO: 666325 - DNA, 319 bp, Homo sapiens
tcctgggtacacaacctagggtcagttctgcaggtggtaaaccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 666326 - DNA, 1424 bp, Homo sapiens
  misc_feature (272)..(272): n is a, c, g, or t
  misc_feature (274)..(276): n is a, c, g, or t
  misc_feature (1168)..(1168): n is a, c, g, or t
  misc_feature (1175)..(1177): n is a, c, g, or t
gaattcggcacgagggtgggtggggagtagggagaggctgactaatcctttaacgatagaattacttgatgtctacatctgtactatgccaatcagctgttggacaaggtaacaagcaaggaagtggccaaggacaccatgtgttcccaaagcatcggggttcagcggtaatgtttttgaatcttctcgggtgtaagtaaatatatttcagacagcttttagaatgaagttagctagaagaattttgcagcaatagaagctggttttggttngnnnagacttcaggttctatctatttattggtgctgctcagttggatgggaaagagaggagaagctgagagacgcctggcacctgtacagagtgaaacaggcaatgctgtgtaacgagcagttgacagcaatgaataagggttgcagaaatggcaaaagagggcaccaaattaaccaaagcctagggaagatgacgaagccagagtattcattaagggaccagatgaactagcatttattgagcaccttctgtttgccagggcatataagaacatactgtgatgaggcaccatgaaatacgacctttgaacagaaactgggtaaaaaacaaaagtaggcttcctcctcctcctaacagcatctagtgcagccacattagatggggagagccagaactaggcaagttattccactccctgatctcagctgcctcggttgccatctctgcacctgcagggtgaacacaccccaatagcggtaacgtaagcatacccttagaatgatcctgtgtgggagatgcacctgaatgtgtggtccgggctggggaatccaggagtgaccaacccagagatttgtccctaatatataacagacatctgtgccccatgcctgtcccgtggaacacaggccaaacaggggattgaggtcctgagtttggagttaaatgaagattgccaggtagaggttgttagggggagggtgttaagtgaaggtgtgatataaaccacatgacatttgcaggtggttatggttttcctgcccagcccaccgccaccactggactgtagggaggtggatatcctgtccagcctactgccactggaccatttctgtatgtaaggtgggcagttgtactatccagcccgccatcactggactctctcccttatatgaancccctcnnnataaaacccccatgtctatctgttggctctgagtgtcttcttcagctcttgaacctggtgcctttcctattgaggttaataggggttcagcatgacagcacctccacctcccatggcacagcatatgtacccaataagcagtccttacaataccaatagtttctatctgttggcactgccaattagccaggcatgtcaaatggaagatctcacttaatcttgccaaaaaaaaaaaatgagcggccgc

SEQ ID NO: 666327 - DNA, 108 bp, Homo sapiens
tcagatcaccaaaatatagactaatgtatggacgcccatggcacagtctagtccacacatacatttaaccgttacatcattcctgagctcagagtgttgccataccaa

SEQ ID NO: 666328 - DNA, 641 bp, Homo sapiens
ctcaagcactaataccagcagagcagtctggtggggtagggccgatcccctcttataccttgatagtggttaacactaggttttactgttcgtctccccagtctgcctacaagcatgcaggcaggaagatcggacgcgagagtccgaggaggctcacgccggatagcagtgagccagtcacaaacgcgagagctcccgccgtgggacgcacgcttagctatgcggagagtggtgcacttggggctcgtggttccttgctacctggagggccagtaagtctcttagtgcgagactcgagacatctgtggcattgctggttactcgcaccatcatacagggattctgaggcccaaggagaacggacgaagcaagagctccttgcggggctagaaataaaagaggggtacgtacttacgcgagttcaccgcactttgcgtacctagcatgctcttccgattgtttatcccatgccctaaagtgtgcggggacatgcattgcaatgctcgaactagcttaaagcaacaaggagttcaaggcttgcaatgaaccctagggttgctcgtaatacgcaggtttactcgccggtgaaaaccacagatcgaacatggatgggtaggcagcacacgtcaggggtggcaaaa

SEQ ID NO: 666329 - DNA, 499 bp, Homo sapiens
agagagttgtagtcatctgcagaggttgaaatattggaataaaaagctatctcagatgaattattccagaagatatctgctatatactccctgtgctattccagccatcttaaaatatgaaagggcaagcccgcccttccagttcggacgcatagcattaattcccctgcagcggcaatctcttgcactcagttcttccattgatggtatccctgagttttcactataagaaactcgatttatcattggccctgtccttggccaacagtagacacgggaccaatgagctaagtctgacacaggatgaccaatggttgacagctcccaatccagcactgctatcactcgacactctttagggtggaaaactatgttatctagtctgaaatctccatgcatcaaatctcttcattgtcattatcgggcaagttcttcattagccactcccgataagctgttgcatggcagggatgttctggatgagctgcagcttgatatt

SEQ ID NO: 666330 - DNA, 107 bp, Homo sapiens
aaggcatctggatgccatcaaagtctcctgcaacctggagactggtgagacctgcgtagtagccgagtcagacccgtatgaccagaagaactggaacatcagcaaga

SEQ ID NO: 666331 - DNA, 356 bp, Homo sapiens
ccgacctaaccccacatgctcaaaatcaaatgatacatattcctgttagacccagcaataccataagaattactaaggaaaatttaaaaaaggggcctttggccccctgttttcatcctacccttttttcacttttaatggtattataaacttcatgaacttaattggggtttttttccagaatactttggggtttgttaaaatttgaggattttagggatgggtttggttcagttccagaatttttgactagttacagatttgttagcccttaaatgaaatggaatggcttatgcttaattgctggggcatatccagcttgttttgaactaataacttttaaacttgacttaacc

SEQ ID NO: 666332 - DNA, 182 bp, Homo sapiens
  misc_feature (129)..(129): n is a, c, g, or t
ggctggtccgatggtagtgggttatcagaaaaatcctgcgaagaaaaaaacttctgaggtaataataggatatcccgttcgaggcctttttggacaggtgggttggtggccattgccccatagtgcatngcgctactgcgaaccgtcacactcgaccagctgccgtccgtcactcacagtcc

SEQ ID NO: 666333 - DNA, 166 bp, Homo sapiens
catcgctgacccgttgctctctaggctggccctgtcacccctctccacaccccttccagcccagggttcccattgggcttctggcagtggccaactagccaagtctggtgtccctcatcatccccctactgaaccctcttgccactgcttctaccttgatctcgat

SEQ ID NO: 666334 - DNA, 393 bp, Homo sapiens
  misc_feature (24)..(24): n is a, c, g, or t
  misc_feature (49)..(49): n is a, c, g, or t
  misc_feature (65)..(65): n is a, c, g, or t
  misc_feature (124)..(124): n is a, c, g, or t
ggcttaggcaggaaaattcacttnaggccaggagttcaagcccagcctntgcaatatagtgaganacccccgcccccatctcatttaaagaaaaaaaagagtagaaactctctttgccgggcanagtggctcatgcctgtggtcccagcactttgggaggctgaggcgggcagattgcctgaggtgagtagttcaagaccagcctcgccaacatggtgaaaccctctctctactaaaaatgcaccacattagctgggtgtagcagcgccataatcccagctactagggaggctgcggtaggagaatcacttgaacccaggaggcagaggttgcggtgggcggagatcacgccactgcactccagcctgggagacagagcaagactccatctca

SEQ ID NO: 666335 - DNA, 157 bp, Homo sapiens
  misc_feature (154)..(154): n is a, c, g, or t
aggtattagagtctgcgagtgatggtgatggacacttcttggcatagtctctctgggagcgagcagctttacagtgcatggtggtgctgcatggacttggagcttctagtatctgctctcaaagtcaaggactcatctggctccttgggtttgngcc

SEQ ID NO: 666336 - DNA, 447 bp, Homo sapiens
  misc_feature (11)..(11): n is a, c, g, or t
  misc_feature (31)..(31): n is a, c, g, or t
  misc_feature (45)..(45): n is a, c, g, or t
  misc_feature (153)..(153): n is a, c, g, or t
  misc_feature (155)..(156): n is a, c, g, or t
  misc_feature (158)..(158): n is a, c, g, or t
  misc_feature (283)..(283): n is a, c, g, or t
  misc_feature (297)..(297): n is a, c, g, or t
  misc_feature (311)..(311): n is a, c, g, or t
  misc_feature (318)..(318): n is a, c, g, or t
  misc_feature (347)..(347): n is a, c, g, or t
  misc_feature (361)..(361): n is a, c, g, or t
ataccatttcnatttgtgatgatacgttttngcccttaaattttntttacccttccttggacccattttcttaaaagtaatggctcaaagtaatattagataacatttccccaaaaatggtgggagggtgggtgggttgctaatgggaggggntnncnctagtttaatgatgggaattggcctcataaaaggttagttcataaatgttgtttgcttttctaggaaggaatctgctatgaggcttaactgctgtcataaaatttgtttaaaaaattctgcagangttgctggccaaanaggaacctccttangacagcngcctttattctgggccactgtactccacnctactgccatgcantggggttttagctgtactgctaaaaaatcattcaattttgtgaatggcttactttggtttttttttttaaataaactttttaatta

SEQ ID NO: 666337 - DNA, 828 bp, Homo sapiens
  misc_feature (4)..(4): n is a, c, g, or t
  misc_feature (11)..(11): n is a, c, g, or t
  misc_feature (27)..(27): n is a, c, g, or t
  misc_feature (52)..(52): n is a, c, g, or t
  misc_feature (66)..(66): n is a, c, g, or t
  misc_feature (73)..(73): n is a, c, g, or t
  misc_feature (88)..(89): n is a, c, g, or t
  misc_feature (92)..(92): n is a, c, g, or t
  misc_feature (95)..(95): n is a, c, g, or t
  misc_feature (102)..(102): n is a, c, g, or t
  misc_feature (108)..(108): n is a, c, g, or t
  misc_feature (119)..(119): n is a, c, g, or t
  misc_feature (137)..(137): n is a, c, g, or t
  misc_feature (142)..(142): n is a, c, g, or t
  misc_feature (169)..(169): n is a, c, g, or t
  misc_feature (189)..(189): n is a, c, g, or t
  misc_feature (200)..(200): n is a, c, g, or t
  misc_feature (203)..(203): n is a, c, g, or t
  misc_feature (208)..(208): n is a, c, g, or t
  misc_feature (223)..(223): n is a, c, g, or t
  misc_feature (231)..(231): n is a, c, g, or t
  misc_feature (240)..(240): n is a, c, g, or t
  misc_feature (242)..(242): n is a, c, g, or t
  misc_feature (256)..(256): n is a, c, g, or t
  misc_feature (260)..(260): n is a, c, g, or t
  misc_feature (264)..(264): n is a, c, g, or t
  misc_feature (272)..(272): n is a, c, g, or t
  misc_feature (279)..(279): n is a, c, g, or t
  misc_feature (282)..(282): n is a, c, g, or t
  misc_feature (284)..(284): n is a, c, g, or t
  misc_feature (288)..(288): n is a, c, g, or t
  misc_feature (291)..(291): n is a, c, g, or t
  misc_feature (332)..(332): n is a, c, g, or t
  misc_feature (354)..(354): n is a, c, g, or t
  misc_feature (374)..(374): n is a, c, g, or t
  misc_feature (390)..(390): n is a, c, g, or t
  misc_feature (394)..(394): n is a, c, g, or t
  misc_feature (398)..(398): n is a, c, g, or t
  misc_feature (430)..(430): n is a, c, g, or t
  misc_feature (438)..(438): n is a, c, g, or t
  misc_feature (449)..(449): n is a, c, g, or t
  misc_feature (479)..(479): n is a, c, g, or t
  misc_feature (496)..(496): n is a, c, g, or t
  misc_feature (588)..(588): n is a, c, g, or t
  misc_feature (605)..(605): n is a, c, g, or t
  misc_feature (684)..(684): n is a, c, g, or t
  misc_feature (744)..(744): n is a, c, g, or t
  misc_feature (747)..(747): n is a, c, g, or t
  misc_feature (749)..(749): n is a, c, g, or t
  misc_feature (782)..(782): n is a, c, g, or t
tctnatttaanttttttaatgggtctnaaaattctgtaaaaaatttttggtnaagttgtttccatnaaaaaanactgattttaaaaannaanaanttaaaantgccanacgcaaaaaanaaaaccaaagtggtccanaaaanattctcctttccttctgaaggttttangatgcattgttataattaancagttttttantantaaanttaaatggccaattnaaaaaaanagttctganancgttcttccaccantgantaanagtggggnggcaggnatnangganaanattcatttagccttctgagctttctgggcagaattggtgancttgccagctccagcagccttnttgtccactgctttgatganacccaccgcaactgtntgtntcanatcacgaacagcaaagcgacccaaaggtgganagtctganaagctctaaanaaaaatgggcttgccaggaaccatataaanaatggcagcatcaccanaattcaagaatttagggccatcttccagctttttaccagaacggcgatcaatcttttccttcagctcagcaaacttgcatgcaatgtgagcngtgtggcaatccaatanaggggcatagccggcgcttatttggcctggatggttcaggataatcacctgagcagtgaagccagccgcttccattggngggtcatttttgctgttaccagcaacgttgccacgacgaacatccttgaaagaaacattnttnanattgaagcccacattgtccccaggaagagcttnactcaaagcttcatgggtgcatttcgacagattttacttccgttgt

SEQ ID NO: 666338 - DNA, 330 bp, Homo sapiens
gtcgacggaagggtggttcacacctgtaatccctgtacgttggaggccaaagtgcatgggtcacttaggcctgggggtttgagaccagcctgggcaacatggcaggatcctgtctctatcaaaaaaaaaaaaaaaaaaaattcagaaattagctgggcaggtggtgtgtgcctgttgtcccaggtactcaagaggctgaggtgggaggatggcttgagtccaggaggcgaaggtggcagtgagttgaaattgtgcactgtactccagcctgggtgacagagtgagaccctgtctccaaatctccaaaaaaaaaagtcgacgcggccggca

SEQ ID NO: 666339 - DNA, 344 bp, Homo sapiens
cactactcatgcaccataaataggcagcgccaccctagaaatatcaaacaataacctacccactacacttatcatcttcaaaatactaatatctacagactatcctagaaatcgctgtcgcctataatccaagacctacgtatacacacattctagataagacctctaccatgcacgacaaacaacataatgaccccaccaaatcacatgacctatcactatagttcaacccagtcccatgcaccccataacaggggaccctctcagaccctcctatagacctccggcctagccatgtgatttcacttccactccataacgctcctcatactaggcctactaac

SEQ ID NO: 666340 - DNA, 594 bp, Homo sapiens
  misc_feature (16)..(16): n is a, c, g, or t
  misc_feature (71)..(71): n is a, c, g, or t
  misc_feature (88)..(88): n is a, c, g, or t
  misc_feature (104)..(104): n is a, c, g, or t
  misc_feature (112)..(112): n is a, c, g, or t
  misc_feature (146)..(146): n is a, c, g, or t
  misc_feature (148)..(148): n is a, c, g, or t
  misc_feature (151)..(151): n is a, c, g, or t
  misc_feature (201)..(201): n is a, c, g, or t
  misc_feature (211)..(211): n is a, c, g, or t
  misc_feature (216)..(216): n is a, c, g, or t
  misc_feature (292)..(292): n is a, c, g, or t
  misc_feature (361)..(361): n is a, c, g, or t
  misc_feature (396)..(396): n is a, c, g, or t
  misc_feature (398)..(398): n is a, c, g, or t
ttttaaatattcaagnaatttcaaatttttcagtattaagaaaagttcagtttattcagagggaaaaaaanatttttaactgtcgggngatttgtaacataaanatattaangtattgggggacaaagttcaagccagtaaagaananttntggcagcatttggggagcccaaggcgggcggatcacgaggtcaggagatngagaccgtcntggcnaacaccgtgaaaccccatttttactaaaaatacacaaaattagctgggcgtggtggtgggcacctgtagtcccagntactcgggaggctgaggcaggagaatggtgtgaacctgggaggtggagcttgcagtgaaccgagatcgntccactgcactccagcctgggtgacagatccagantntgtctcaaaaaaaaaaaaaaaaaatacttctggcagagtcttttatcttcctattaaaatctcacttgttctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 666341 - DNA, 2026 bp, Homo sapiens
tgccactacttgctcttgtgaccttggacaggttacttgatctttctatgccctaatatcctcatctataaataaaggataataatagtgtctgactcaagagctcttgtgaaaattaaatgagatagaatgtgtaagggcttagaagagtgcgtggcatatagttatgtgtgatgatcacagctataaaaataagttaggaaagtaggcaaggggtgaggcagcttgtgagggagattgagctcctggtcacgtttctgtccatcccaggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaa

SEQ ID NO: 666342 - DNA, 160 bp, Homo sapiens
atcgtgagacgtcccatctcttaaatatataaaaattactaggacaagcgcagtgtctcatgcctgtaatccgtggcacttttggaaggccgaggcaggaagattacttgagctcaggagttcaagaccagccagtacaacatagtcaaaccccatctct

SEQ ID NO: 666343 - DNA, 1138 bp, Homo sapiens
  misc_feature (291)..(291): n is a, c, g, or t
  misc_feature (523)..(523): n is a, c, g, or t
  misc_feature (797)..(797): n is a, c, g, or t
  misc_feature (1062)..(1062): n is a, c, g, or t
agcgggttaagggtcttctgagctgcagttggcgaattagcaccagaagatcccgcgagtcctgtctctaaagaggggaaagggcataggatggtgcgcaggactctctcatgtagctacctggtaagtctgacactagaccagtcacggatactttgatgcagctacagtgaagtgctcgtaggccgtgggcgttagcacactaggctaggtggtgaacactgtgacctaggatccaagcgggtgaagttatcagtgcaagaaggggaagaccaatcaggtgaggtcatntctgaggacatcatcagggacatattcataggaaacagccgcgagaattatggttatcctaggcctgcgcgagtgaaagatgatctatgagtgatagaacccagcttgtcaggtaatcgaactaagaaaaacttgctacaggtctctggtaagctataagcgcatgcggagtgggagtacacaaaactgttggttctacaattacgcacgcacataagtggggcagtgggcnatagaagcaaaacggagaaactttttagttcaacgaggcacagatctataggagacttgcgcggaaacaaaatgggatctaggttgaacccaatttaacgtcttatggggtgcgactcgatcgggatgtggcctagttctaccgtggcaccattacttgaaggaaagaggcactttagacataaatggtgtccctggggtccggggggcctctgtgcaaacgaagccctctctacaagtttttccagtacttggtatttcccctgcaaacggtnctacgaggtcgggcattattctccttaagtttacccacagcagttgggccatcgaactacatgtgtaatacctttaggaaaccgtgtgtgagttccccttatagggatatgggttgtagaccgcgtatgggaaagatataacgtggggggtggaacttttcctaaagaatgagggtttggattgaagttttccgccaaatgggcaaaatgcgtgtgaggccgcaaaagattgttgtctagagtttctgtgggacagacgagttancatgttcggatgtgtttactgtaacttaaaatttgtgtggaaaattttcaaggagggtgttatgtggtaaccctgc

SEQ ID NO: 666344 - DNA, 2687 bp, Homo sapiens
cgcccgggcaggtcggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatccggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaa

SEQ ID NO: 666345 - DNA, 277 bp, Homo sapiens
gccaaggtatgttaaggggccccccctcaaaagtccaagggccgggggggggggttcccagggtcaggagtttaagcccatcccggttaaaagggtgaacccccgttttttttaaaaaaccaaaaaattacccgggggtagggggggggccctgtagtcccccctatttggggggttggggcaggaaaagggggtgcccccgggggggggggcttccagtgacccgagttgggcccccggcccccccgccggggggccaaagggaaaccccttttca

SEQ ID NO: 666346 - DNA, 2885 bp, Homo sapiens
  misc_feature (1228)..(1228): n is a, c, g, or t
  misc_feature (1236)..(1236): n is a, c, g, or t
  misc_feature (1240)..(1240): n is a, c, g, or t
cgcccgggcaggtcggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatccggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaangcatgctngatnggggctgcccgggcttggcacccttggcaaccttttggaaaacgggttccttcggccttggaattgaatgagacaattgagacccgggttggattgtgtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaa

SEQ ID NO: 666347 - DNA, 2969 bp, Homo sapiens
cgcccgggcaggtcggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatccggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccactaccaggcgggcgagtctctgcgcttcttctgctatgagggctttgagcttataagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaa

SEQ ID NO: 666348 - DNA, 127 bp, Homo sapiens
cggtaccaacgatggtctcagctcactgcacctctgcctccgggtcagcgattctcctgcctcaccctcctgatagctgggattacaggtgcgcagacaccatcacccggctaattttatttatata

SEQ ID NO: 666349 - DNA, 418 bp, Homo sapiens
tttattggttatttttagtattttaatgtatgtactttttataaattccaaaagttaatacctgtaaactccacccaaatattaataagatcttagaacacaaattctgaatactttccatccttattcatgctattgccgtgtagtacttttgttctaccttgcttttaaataccaaaaaaattgttgtttttaaaaaattgtattacaatatacaggacataacatttaccattttaaccatttttaagtgtatagttcagtggcattaagtacatttgcattgttgtgcacccattaccaccacccatctccaaaattttttcatcttcctgaactgagactccatacccatcaaataattactttactctccatctcccctccactcccctgcttaataaactctaaaaatcca

SEQ ID NO: 666350 - DNA, 558 bp, Homo sapiens
cccccccccgggggagggtttccttgtgggtgagttttatccacaaaaatatacacaaatttgtgtgttgcctttttaacccccacccccgcccccaagagggggggaattccctcctttttttttttcccccccccaaaattttggatttttaggaggaaggtcccccgagagagaaaaacttggggggttttgaaaggtaatgcaaataacaaacccccaacttttttttaaaaaagataattgtctgagttaaaattactgattctttatttcacacctaaaaaaatatgagaacagggtacttgctttttgtgtcacattacggggcaaactgttcaagtttttttttttaaaacccccctgtatagaaaaaaatcattagggatgtaaacgccatgcttgcctatttgctgtatacataatgaaattgtagataaagtgtggtgcattgaaacaaatgaacaaaaagtagatacttttactatacaggggtgctggtgcagaaaaaaatatatatatttttggaaatgtagcattttatactttcaagtgtta

SEQ ID NO: 666351 - DNA, 238 bp, Homo sapiens
tttaccccgggtcccaaacaaaattcccccccctttttttggggggggggtttcccccaaaattcccggttttaaaaacccggttttggttttgggccttttggggggtccccccccgggggaagggcccttttaactgggggacggggcaatgggggttttaagcccttgggtttttccccggttttgccccggggaattggggaaaaggccccaaaaagggtttttttttaaccca

SEQ ID NO: 666352 - DNA, 515 bp, Homo sapiens
  misc_feature (264)..(264): n is a, c, g, or t
  misc_feature (271)..(271): n is a, c, g, or t
cggggacttgctggcgtggtgcttctcgaattgacagccccgggctctgcagagttgtggggccccggcatcagtgggtggacgggtgttgtcctacggcgcggggcggcgggctggactggacttctctccccggaccgtagccgggtgtgccgcgccaccccagggctcctgggacgggggtatccgcctctcggatgaaggatttgggggcagagcacctctgtgcaggtcagctgaagggggtcctaacgttcgtcgggnggttgcnttgagacgtcgttaccctggagacgaaccgaagaagaagaattcctaaccctctgagacggaaaggggctgagctctgagtgtgaggctacccccggggaaatgatagcactttgtgtccaggattgagaaatgccaaagttgaagatttaaggagtttagccaacttttttggatcttgcactgaaacttttgtcctggctgtcaatattttggacaggttcttggctcttatgaaggtgaac

SEQ ID NO: 666353 - DNA, 701 bp, Homo sapiens
gtgggccgcatgcagatggttgactactatgcgtgtgggaccacgattgatggtgtctgatgatgaagacgagactgcaccccaacatcgactacggccagtctcttccgctggcggcatcagcgcccggcgtggaactgcgatgttacgccaagcttcctcagatacgtgtacgcaacgcgtaggtaccttggacagtggtgctgcctgcgattgctagctgctcggtgtcctgagtgccacgatggaacactgaaggagctggaggtggcctgatggcggccaggcaagagctggatgcgcctgcaggcctgatgcacatgcagtctgcgcaacggaggatgcgtgagctggtcagcagaagctggaggagatgcgcaacgaatgagaagaggtatgccctggaactgtggacacgctcagcaaagatggtttcagcaagagcatggtaaataccaaggcccgagaaagacggaggaggactcagaggaggtgagtggagcagaaacacaagaccttcgtgtgaaaaatacgagaagacagatcaagcacttaggcatgcttcgccgctgggattgacatccaaaaagtaacctgtcagacaagcgtccacctggttgtgcgaggagaccagccaattacctggtcatttggtgcattgacctaaggtggaggagaatgtgcactcattgagcaggttg

SEQ ID NO: 666354 - DNA, 967 bp, Homo sapiens
  misc_feature (908)..(909): n is a, c, g, or t
gagctgggactataggtgcccgcaccacgccaggctaattttttgtattttagtagagatggggtttcaccgtgttagccaggatggtctcgatcttctgacctcgtgatccgcccgcctcggctcccaaagtgctaggattacaggcgtgacccacctggccggcaggcaaatttaaagccaagaaattgaatgttgccagaaccccaggaacacacacacagactcttcccatattgaccaatttccccagaatctccacctttccttacttctatgatgcccctggttacagactagaaacggccttgaaaatctacgtggggtgggagaagaatatcaaaactttcctaagagaattttctaatctgtaagatcaatatacttgattggaaactggctttggataacgtgggaatatataatcatgtgatcaattaaatataccctttacaagagaaggtttataccaataacataaagcgtacaacaaatgtgaacacatgtggagtggaaacaagatctgtagggctcaatggataagatactgaaacttgtgatatttttcagtggggcaacagagttgaatattagtctgatagtttccggtaaaatttttgaatatttctggaaggcgttggaaaacttgatttgtttctttgaatattttccaattgggtcaatgctttacagaaggaagaaaccaaatttgcttgaggactgcagaaaatgagtttggaaagtggactgtcgatgacaaaatcacgacactcttgtgtggacacaagatcagtcattcgcaaatgatgtatccactgatgcggggagggaaacaaaaagaaattggagagggaatgtggttatgatttcaacacgtttcttttctctcgctctctagcgatcacccnnaagaaaagaagaaagaacagagaacaagatgggaaagacagagaatgagtgaacgagg

SEQ ID NO: 666355 - DNA, 120 bp, Homo sapiens
taccaaaaaaacgtattcaagaaatcattgagcagttaggggtcacaactagttgaatatgaaaaggaaaaactgaatgaacggcttgcaataactttcagaatggagtggctgtgctga

SEQ ID NO: 666356 - DNA, 149 bp, Homo sapiens
ccgtgcagatagaatcgagctggtaccccgacacttcatgaccggccgtaccacacgggtggcgagctatcgtaacaacaacttcttcggtctggttgacggtctgaacttcgctctgcaataccaggcaagaaccagaacgacgatcg

SEQ ID NO: 666357 - DNA, 353 bp, Homo sapiens
gctcgacatcgttatgaagtgcgtttgaagaatggaagcgttctggtactggtgcgcgataagccctgagcatccaggtgcaaatcgattaaacggcaacttgatgccttgtgcctgttagttgttttctcgttcagtctttatgcgtcgctaaagaacgactcctattgaaagtgcctatattcccgagcggctcgcggccatcgaataaaggtgcgtatccggctgtgcgtaaacttcaaggaagagagatgaacccgccgaaaatgatgtccgggacacctttgattcgtgtgctcggcgattataaaagtgtgttgttcagcgtcggttgttttaccgcgttggtcgac

SEQ ID NO: 666358 - DNA, 327 bp, Homo sapiens
ctaggaatatggcttacggggaacaatcactttaaagaggatggtgtcgaactggtgtggtaggtacatggctgtcaatcccctgtacttatggagaggtcaaagctgggaggatcactatgaggtcaggattacaagactagcctggccaataaggtgaaaacccgtgcataataaaacagtataaaaatatagctgggtatggtggtgcacgcctgtaatcttggctactcaggaggccgaaggaaggagaatagcttgaactcgggagtgcagaggtagcagtgagtcacggccatgctacttgcactccagcctgggtgacag

SEQ ID NO: 666359 - DNA, 737 bp, Homo sapiens
atctgctgctggtggtcgccccaccacgcggtgccagtgcccagtgtccccacagtgcctgtctgtccactccatgccacctttctcagcatcagtgacggggttgccctgatgttcacacacgacgtgttggcatgcatggactcaagtggcacgcctgtgggacgtgtggccatggccacgatggccatgtgccctgatggagacaactccctcaggactagggacatgggcatgtagccagagccatgtggcccacgggacccacaggcaacccagacagcatcaagggccgcccttgccacacagtctagtcatgccagagcggatgcagccgacgggggcagatcccatccgctgtcatcttacacctagaacaataatgcagaatgcacattttgccgacttcccaatatatcatctttggctaagtgacgaccacagcccatgagagttgggcagcttgcatccccaagaaaagcctgataggtgatccccaaggacccctatgacagatacccatcttactggtacccttgttcctggttagattcacaggcacccacggggaacccccaacactgctccagcgggtggccccggaagggcacaaccccaaagacccaagaccatgacggggggccagataccccagactgaccttgggattaccctggccttgacaggtcctgagcgcaacgggcaggggattccaggtggttgggggaccgtggccc

SEQ ID NO: 666360 - DNA, 243 bp, Homo sapiens
  misc_feature (16)..(16): n is a, c, g, or t
  misc_feature (215)..(215): n is a, c, g, or t
ctgcacatgtagctcngcaagtcttacaggttatctttgtgcttctggcgtgcctgggattgggatggtctgggagagctttggctatacaccccaggatatcgccagtcccggcaccactttttctatcaatttcttgaccatgtggatttttgaaaaatgtgaacaccagttcaggcccttgcttataggtacttggagttggtgtgacgacngagcagcttctttgttgatcacctggtg

SEQ ID NO: 666361 - DNA, 294 bp, Homo sapiens
gcttactctgttggagtaggttctcttcagagctgtgcaaggacgctagggagcattcacagggtgctcttctggatcattccatttgacagataaaggggactggaggtcagagagactgtacccttttcataggatcacacaggagtggctgcacatcttagctcaagggcatgtataactcccaggcagggccaaagctcctagggctgagtgactcccaaaaagagaagggcaggtggtcaaccacaaattccccaagttcggccctcttcagagccgtcctgcctgggt

SEQ ID NO: 666362 - DNA, 409 bp, Homo sapiens
tactgtatgcattaataaattaaagctccatagggtcttctcgtcttgctctgtcacccagactgggtacagtggcacgatctcggctcactacaaactccacctcctgggttcaagagattctcctacctcagcctccagagtagctggaactacaggtgcgtgccagcatgcccagctaattttttgtatttgtagtagagatggggtttcactgtgttagccaggatggtctcgacctcctgacctcatgatctgcccgcctctgcctcccaaagtgctgggattacaggagtgagccaccgcacccagccgaccctacttctaatagtatggagaacgctaatagtccttggcacgaactgtttagagaattaggcaaaataaatgcatttgacactcctgattc

SEQ ID NO: 666363 - DNA, 134 bp, Homo sapiens
  misc_feature (130)..(130): n is a, c, g, or t
gggatttaggttctaagagattctgttttgctgttgcattgatcaattgtttctaaggcctttttttttctttttaaaagaatgtaacaaccatataataaatcacctcttccgcttgttttagctgagngttt

SEQ ID NO: 666364 - DNA, 272 bp, Homo sapiens
gaaggacatcacacatctccccatccttccaatcaactggggtggcaaacctatatatactgctgtcagctaggagcgagatgactaccctgagaatctcatcaaagtacctgccagatggtagctggagaagcaggatagacagctacagaataactaatcaggacaaaaaacaaacaacacacgagctgtcacaggcatgccctttacatccttctctgaaggatccagcatgcccaacaggataggcaaagactcccgatacctatcat

SEQ ID NO: 666365 - DNA, 227 bp, Homo sapiens
agaccagccgagtctgcgtatttcaatgggtcagcatctctgtgccgagaaaaaggtgtgtagtgattgtgtgtatgtgtagtctttctgtgtgtagtctgtgtgatgtaatggtgtagtctctgtggcggggaggggatgtgtgtgattgtgtgtctgtgtgtgtagtctgtgtgtgtctgtgtgtgtagtgtgtgtgtcttagtgatatgtaagggcgtgactgt

SEQ ID NO: 666366 - DNA, 381 bp, Homo sapiens
ttacaacccagaatcacatggaacaaggccctctggctcttctgagcgaagtgttatgttctcgcctttttctgggtgggtaaactgaggctgatgtctgggacgtgacttccccacatatccccaacagatcattaaattcactgtaagtcactttttgtcgtttaccaattcccttccccccacttaccagtcaagttatgaaaacagtgagttattgtttgatcgtctgtgatcccaattttcctaggaatatagactgttaggaatatagatcctgtcacaagaggcttcagaagtaaaggaaccatgtggtttcttggctgttttgcttttcaaagtctgtatcattttaactagtgtagcaatgacagtctcttt

SEQ ID NO: 666367 - DNA, 241 bp, Homo sapiens
  misc_feature (239)..(239): n is a, c, g, or t
ttcggccaccacatgaaccagcagcggatggtcacttacggggtacgagcggcttggaggagactgccccaggccttccggccatagcagccatgagtgtcatgaccaccaccacggtggtcattggaactcagtgtgactccttagggttgaggtccagctgtggttgaaggactgtgacaggcagcagagacttgggacattgcctattttagcccgaatacaaacacctggacttnta

SEQ ID NO: 666368 - DNA, 389 bp, Homo sapiens
ctcgaggccaagcatcgcagcactcttcacgatagcatgtgaatcaacccacaaagccaaggaatcaacccggatgcccatcaacagcggactggacaaagataatgtggtacatatataccatggaatactacacagccattaaacaagaatgaaatcatgtctattgcagcaacatggatgtagctggaggccattatcctaagtgaatgaatgcacaaacagaaaaccaaatatccaatgttcttacttctaagtgggatgctaaacattgcgtacacgttcacacacacacacacacacaccccatgttcttacaagtgagagttaaacattgcattcacaccacattcacacatacacacacatacacacaccccatgttctta

SEQ ID NO: 666369 - DNA, 210 bp, Homo sapiens
caagggtcaggctcgctggaacttaataagtttgtttgacaaactgatttggaggaagcattcagcatctgcccttgtcttccatggtcacaaccaggaactgtgcactgtacgccgcggacatcaccttgcaagatacatgtttttgtaggcttcttcagaagcttcagatgaccacccacgatgaacaatgtacttgcttactcacac

SEQ ID NO: 666370 - DNA, 120 bp, Homo sapiens
tgctgatgtgatctagaggatcccgagctctctctgtggggtctcagcatttccctgccctctctgtcagtatcctcgtcccgaaactggagacagggtaccggagctctgaattctgta

SEQ ID NO: 666371 - DNA, 1006 bp, Homo sapiens
  misc_feature (372)..(372): n is a, c, g, or t
aaggtaggttgagctctaagtcaggccccgatccatgctttcacagcctacgtgagagagtacatatgccccgacccgccgtggcacggacagccgagctgaggtatgtgtgtggtccctcgagtgtttcggcgccgcccagcccgttctctgggtggctgcagaaagtgcatctgcggctccgggtttaccgggcctgcggggactgtcgcgagctcgcgagacggagtcgctaacaatgagtcgtgccgtcgagtgagggagggccctgagtccttaggcacgacaacgtgatatgatagacaacgttcgagtatactgcttgacatatctcctcctgagatgcgctggtgaggtgaaacgacaccaacncccttttgtgtatgaggccttgtaggcctgttgtagaaccagggctcgcgtggcgactggtgtgagttcatctcgcgtgcatctttgttgccgaagatacggtataaagtaactccgccgattcactagatttggtcgtcgccgtttcttcgtccaggaacccctgtcgaaccagggacgtcaaacttgaccttatattcgacgcattttaaatgtcgcggattgagtgacatgaaaggggttcgaaggtagcaagagagggggtgaacgaaaaggttggggctgtgagggacttttgagacatagggagaggcgttcaagtggtagcggtattagaccggaagatggcgtcccggacgtttcgttccgcttgagaaaagattgaacggatggaagacttggagacaccccgacgtaatggttatgtggggtgccgtttagacccacttcatttcgttgctgaaccaattttttcacaacaggtggtcgaaacgtgtaattcaagtatcgttgcccagtacggaacgttggtaaatcccgtcccctccactacgtgggatggtcataggggggtgtgcgtaaattcacgccctggaggggagcattgcttgagcggggcattgcctgggaaagt

SEQ ID NO: 666372 - DNA, 112 bp, Homo sapiens
ccgcaatgcaagtgggcacgcccgtaatccagcacttttagaagacgaggcggccgatggcttgagctcaggagttcaagacaagtctgtgcaacatagcaaaagcctatct

SEQ ID NO: 666373 - DNA, 288 bp, Homo sapiens
atgtatcactgctgacttttattccaatatttggtatggagtaagttttagggttgaattttgttcagtttggatttaatcttttgaaaagtaaattccttgtttactggtttgactataattctctgttatctttacgtggtaaaactgcaagctgactagcattttctttgatttctgccattcctaaaaattttttatacacttgtatacttttctctgttaatgtttgtctccaataaacatatattgtgaaaatgcatccacaatatatggaattcttttctg

SEQ ID NO: 666374 - DNA, 304 bp, Homo sapiens
ggagttctgagaccagcccggcaacatagtgagaccccgtctctaccaaaaacacaaaaaattagccaggcgtggcggcgcgcgcctgtagtcccagctactcgggatgctgaggcaggagaatcggttgaacccatgaggcggaggttgtggtgagctgagatcacgccactgcactccagcctgggcaacagagcaagactccctctcagaaaaacaacccccccctcaaacaaaacaaaacaaaacaaaaaaagtgtaaattgtgaaagaaatcatagaacgtaaggaagtgagtttccac

SEQ ID NO: 666375 - DNA, 681 bp, Homo sapiens
gaaggggtggctgaggcaagaggatcacctgagccttgggaggtcgaggctgcagtgagccattatggtgccactgcactccagcctgggccacagagtgagaccctgtctcaaaaaaacaaaacaacaaagacaaaataacaaaaacattaaaaacaacatctcatccaagcatggaggctcacacctgtaatcatagcactttgggaggctgaggtgggaggctcacttgacaggagttcaagaccagtctgggcaacatagtaagacccctgtctctactaaaacttaaaatatcgaactgggctgggtacgtatgtgccggtacttccagcttactatggaaggctctaggtgggaagaacgcctggggtccaggagtgcaagacggtagtagacgacgactgcatcactgcattcaagccgggttgacacagcaagaccatctctaaaccactacccattaaaggccgggccgcggtggctcagcgcctgtaatcccagcactttgggcaggctaaggcgggcagatcacctgaggtcaggagttcgagaccagctggccaacatggtgaaagcccatctctatacacatcgccagcttagccgctagcaggtcagggagttgggaccactagcctggccaacgtggtaaaaacccaatctctactacacctaccc

SEQ ID NO: 666376 - DNA, 931 bp, Homo sapiens
  misc_feature (23)..(23): n is a, c, g, or t
  misc_feature (63)..(63): n is a, c, g, or t
  misc_feature (87)..(88): n is a, c, g, or t
  misc_feature (95)..(95): n is a, c, g, or t
  misc_feature (131)..(131): n is a, c, g, or t
  misc_feature (142)..(142): n is a, c, g, or t
  misc_feature (186)..(186): n is a, c, g, or t
  misc_feature (198)..(198): n is a, c, g, or t
  misc_feature (226)..(226): n is a, c, g, or t
  misc_feature (230)..(231): n is a, c, g, or t
  misc_feature (237)..(237): n is a, c, g, or t
  misc_feature (265)..(265): n is a, c, g, or t
  misc_feature (268)..(268): n is a, c, g, or t
  misc_feature (275)..(275): n is a, c, g, or t
  misc_feature (296)..(296): n is a, c, g, or t
  misc_feature (298)..(299): n is a, c, g, or t
  misc_feature (317)..(317): n is a, c, g, or t
  misc_feature (372)..(373): n is a, c, g, or t
  misc_feature (375)..(375): n is a, c, g, or t
  misc_feature (377)..(377): n is a, c, g, or t
  misc_feature (405)..(405): n is a, c, g, or t
  misc_feature (422)..(422): n is a, c, g, or t
  misc_feature (431)..(431): n is a, c, g, or t
  misc_feature (491)..(492): n is a, c, g, or t
  misc_feature (544)..(544): n is a, c, g, or t
  misc_feature (693)..(693): n is a, c, g, or t
  misc_feature (821)..(821): n is a, c, g, or t
  misc_feature (893)..(893): n is a, c, g, or t
aaagttgtgtggtgttttgtganaatgtgggttgaggtagagggggggggagttaggatggtntattggatgtgaaagagagatggnngggaaantggaatagagaggaagagagcaaggagatttgaacntatgtgctttnaaggtggtgatgatgatgaaaattagaaaaaaaaataaaaaggnaggtgaaggttncaaggggcaaaagaagataagttggggntacnntcaggntgcaaaggaaaatgggaagaaaggaacntcnaaagtgncctctgcacctcattttgttnannccaatgatgatgggaatngagagggtgaattaaagaagaagtgggttgaggagatgagggagaagcagcaagnngngngggaggaagaaagagaaaaacgcaggancattgagagctagtgtnaggatgtgntaagaggccaggaggagtttgagcataaggaggaagttttgcaggaattaaatatgtttnntcagctggatgacgaggccacgaggaagggttattacaaggagttccgtaantggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaangaggttgtggagaaatggctggattaccttcggaatgagttgccaaccgtggctttcaaggccagtacccagcatcaggtcaaaaacctgaatcgttgcagtgtgccagtagatcaggcctctgagtnactgctgaaaagcaaagcctgcttttggagctgaaaacctcatgagggttctggggaactattgccgccttnggtgaagtgcgcaccacattcgtgtgggtgttgtgggt

SEQ ID NO: 666377 - DNA, 707 bp, Homo sapiens
agcggaggccgcgcgttgcaagctcgcagggagccagccggggcgtcggagtcgcggcgcagcgcggagctggcaggggtgcccgcctgggcacgcagtcgcctccccgggggcctcccgggcttctcaagcgcccgcctccgcccgcccagccacaccaggcgccaccgcgtggcctgggcatgagcggcagcgctactgcgcccttgcccggtcggacgcccgcccgcccgattcacgtgcgcccaagtcctcgcggcggggcagcgcggttcccatgcttccaaggctgttgatggagaagggggcgaggatgacaagcccgggaccgtggtccatcacccgggggcatcttggcgaacgtgtgaattttgctctgcaatcagtcgctgtatctgtgctacatgcgagctccagttactacttgctggcaagaaaggaacgagtccgaaggaggaccggaggaggaaccagaattcgccgtacactcgcaaactgccccagcttggagtccaaacgcgagtagctggtgctgaccaaacagggcacggagctcgtaacagaccaaacagcttccaaactcctgacagccagaaaatcccccggcaaggaccggaggcctcttggccggaggatgctcccccactgagaaaccccccccacccttactttccttgcaaggaagcgcgcggaagggaggaaagagg

SEQ ID NO: 666378 - DNA, 215 bp, Homo sapiens
catgcaccacagcggtctccgttgtgtttctgcttcccatggtcgcctacaggccatgtcaacaggctgatatatataagggtacatgtgcaggtataaccttggtcatctgaaggaatgacatctttccttagaaggctcggagggcgtgtgctggttcccaatacgctttccttagaaggatcagtgtgtgtggtctggttcccaactacact

SEQ ID NO: 666379 - DNA, 310 bp, Homo sapiens
ttacacaacctagggtcagttttgcaggtggtaagccattacagatagttgtaggtaaagaagggcagatttattagagaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 666380 - DNA, 174 bp, Homo sapiens
cctctctgtctagtagctagtaggcaccaactacttcgtgggaaggtgccttatggctgctatccgccctctccacagagaaaaccactgagacaaacgaattcacaaacattttgagaatatcttctaccaaggacacacaagtaaaacttacagacgtgctcccagacggct

SEQ ID NO: 666381 - DNA, 200 bp, Homo sapiens
cttgttgaatcaggaatagcatttcattagggatagatcttctgctccagcacacaggacagggagttcccccgtttccatcctccccctctggccctctccgataacttgcaggcctgggctatccagtactcactccctagatgagctgacactctgtggacttgtagcctgtgctctagggaaggtcctagccatct

SEQ ID NO: 666382 - DNA, 783 bp, Homo sapiens
  misc_feature (18)..(18): n is a, c, g, or t
  misc_feature (64)..(64): n is a, c, g, or t
  misc_feature (73)..(73): n is a, c, g, or t
  misc_feature (76)..(76): n is a, c, g, or t
  misc_feature (78)..(78): n is a, c, g, or t
  misc_feature (82)..(82): n is a, c, g, or t
  misc_feature (84)..(84): n is a, c, g, or t
  misc_feature (87)..(87): n is a, c, g, or t
  misc_feature (102)..(102): n is a, c, g, or t
  misc_feature (105)..(106): n is a, c, g, or t
  misc_feature (111)..(111): n is a, c, g, or t
  misc_feature (125)..(125): n is a, c, g, or t
  misc_feature (135)..(135): n is a, c, g, or t
  misc_feature (143)..(144): n is a, c, g, or t
  misc_feature (173)..(173): n is a, c, g, or t
  misc_feature (197)..(197): n is a, c, g, or t
  misc_feature (205)..(205): n is a, c, g, or t
  misc_feature (209)..(209): n is a, c, g, or t
  misc_feature (224)..(224): n is a, c, g, or t
  misc_feature (226)..(226): n is a, c, g, or t
  misc_feature (244)..(244): n is a, c, g, or t
  misc_feature (268)..(269): n is a, c, g, or t
  misc_feature (295)..(295): n is a, c, g, or t
  misc_feature (304)..(304): n is a, c, g, or t
  misc_feature (310)..(310): n is a, c, g, or t
  misc_feature (319)..(319): n is a, c, g, or t
  misc_feature (323)..(323): n is a, c, g, or t
  misc_feature (325)..(325): n is a, c, g, or t
  misc_feature (339)..(339): n is a, c, g, or t
  misc_feature (355)..(355): n is a, c, g, or t
  misc_feature (358)..(358): n is a, c, g, or t
  misc_feature (369)..(369): n is a, c, g, or t
  misc_feature (382)..(383): n is a, c, g, or t
  misc_feature (387)..(387): n is a, c, g, or t
  misc_feature (391)..(391): n is a, c, g, or t
  misc_feature (425)..(425): n is a, c, g, or t
  misc_feature (429)..(431): n is a, c, g, or t
  misc_feature (438)..(438): n is a, c, g, or t
  misc_feature (442)..(442): n is a, c, g, or t
  misc_feature (451)..(451): n is a, c, g, or t
  misc_feature (457)..(457): n is a, c, g, or t
  misc_feature (481)..(481): n is a, c, g, or t
  misc_feature (636)..(636): n is a, c, g, or t
  misc_feature (638)..(638): n is a, c, g, or t
  misc_feature (654)..(654): n is a, c, g, or t
  misc_feature (656)..(656): n is a, c, g, or t
  misc_feature (688)..(688): n is a, c, g, or t
  misc_feature (712)..(712): n is a, c, g, or t
  misc_feature (721)..(721): n is a, c, g, or t
  misc_feature (774)..(774): n is a, c, g, or t
aaccatggtggcggcganggtggcagcggcgtggctgctcctgtgggctgcggcctgcgcgcanaggaaaganaananttcnanganttcaaggcggtcaanatnnggggnaaactggtgtcgcnggagaagtancgagagannggtgtccctggtagtgaatgtggccagcnagtgcggcttcaaaaaccagcacnacaaagcnatgnagcagctgcagcgananctgggcccccaccacttnaacgtgctcgccttcccctgcaannagtttggccaaaaggagcctgaaagnaaaaagganattganagctttgcncgcngnacctaaagtgtctnattccccatgtttagnaanattgcagtaancggtactggtgcnnatantganttaaagtaaatggcccgtaagtactggtctattnatannntaaaaantaanttagctggntgaggnaatggataaatgggaagaagaagnaaatggctggttgggtgaaatggggccaattaaaattactgatcatctcgggtggactgatgctttgttccagcactaatctttgaggagagtggaggcaggtacaagctgaggggtattcctgcctaagaatatctccatacctgctgcctctnanttgtccctcagaagtnantcttttggacttttctgggatcctgttttcanattcaggggctcctagaaggaganatttaagtnagtgtgaactagatgagtttatggacatatgatggagaaaccaaggcataganaggggaggc

SEQ ID NO: 666383 - DNA, 881 bp, Homo sapiens
  misc_feature (651)..(651): n is a, c, g, or t
  misc_feature (689)..(689): n is a, c, g, or t
gggaatccgggtcagtactggggggaagggagtgctgatgtgtctcagcttcccctgaagaacagtttaggcagtgattggaaccggtagacctgctgattcagcattagggctgaagctgcagaggctgtgcccaataccaggttggggctagaaagtctcagggcctggcttgtgctgaacacagcttattccagctaaatgagagaatgaggaaagaagagagaatttaaggctaaccttggcaagtttgtgaaaccttgtcaaaagtaaaacaaggactgggggcgtggtcagaggatggagcccctgcctaaaatcccctaccaaggggctgggttagtggctctgcagtgtgcctacctggcaagcatgatggctcgggtgctgtcccagcaataggaaaaaaaatggccacaggaccctttgaagatgccctgaagttgcacgcgtgctcagtggcagccggcatcactgaggcctcaacccctctggaagaccagtggcccagtcccccctacccgaggggccccgtgcagccacagaggagcaattgaggcaggagccctggtaccacggacgaaatgagccggcgggctgcagagcaagctggttcgggccgattggggacttccctttgtgagaagacanggttcaccaaaccggggggcaggtatgtcctccacggngcatgcattgcgggggcagcccaaaggaactgctggtggtggacccccgagggtgttgggtaagcggcacttacagcatcacggggaggaggcaggggtaaataaggggcgctctagaatagaaatcccctgtgaaacatttccgtcagaaaggtttccaagggggcccaacaaggaggatacactaaaggg

SEQ ID NO: 666384 - DNA, 285 bp, Homo sapiens
ccgggggggggccttttggggcccggttttaaccgggtttttttttttaaaaccgggccccctgggggtttcccgggtaacccctgcttcccccccttttgggggggggggggggttttttttttttccccccccccgggaagggggggggggggggtttaaccccaaccttttttttttaagggttttttttttttcggttttttttggggggccccggggggggggttggtttttgggggttttttttttttttttgcttataaattttttctttttttttta

SEQ ID NO: 666385 - DNA, 350 bp, Homo sapiens
ccccaaaacgaaattaataatagcagagtaaggatagtataggacctgtgagtatgtcaggtactagttagcattaataaataacagctccatagggtcttctcgtcttgctgagtcatgcccgactcttcacgggcaggtcaatttcactggttaaacagtaagagacagctgaaccctcgtggagccatacatacaggtccctaattaaggaacaagtgataatgctacctttgcacggttagggtaccgcggacgttaaacatgtgtcactgggcaggcggtgcctctaatactggtgatgctagaggtgatgtaactggtaaacaggcgggataagacttgccgag

SEQ ID NO: 666386 - DNA, 1132 bp, Homo sapiens
  misc_feature (132)..(132): n is a, c, g, or t
  misc_feature (135)..(135): n is a, c, g, or t
  misc_feature (148)..(148): n is a, c, g, or t
  misc_feature (151)..(151): n is a, c, g, or t
  misc_feature (159)..(159): n is a, c, g, or t
  misc_feature (181)..(181): n is a, c, g, or t
  misc_feature (274)..(274): n is a, c, g, or t
  misc_feature (278)..(278): n is a, c, g, or t
  misc_feature (306)..(306): n is a, c, g, or t
  misc_feature (475)..(475): n is a, c, g, or t
  misc_feature (538)..(538): n is a, c, g, or t
  misc_feature (568)..(568): n is a, c, g, or t
  misc_feature (596)..(596): n is a, c, g, or t
  misc_feature (616)..(617): n is a, c, g, or t
agcggggggaggcggggcggaggcgccgcggcgggtgttattgttcggctgggctcggtcgggcgctgtctccctcggctctgcgggtgtcagttcgtccggcttcctcacagcccctcactcccgcgtgcntgnctgacagcagcangcnggctggcnggctgtgtgctgtgcgcctggncgtttcgaggctgagcggcaccggggttgtgggcgcggaggaggagcagcagcggggaggaggagcctgtgtgccctgtgcacttgagctggnccgnggccatggcgtacgcctatctcttcaangtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcaggncaagaatcctttcgatccatcacaaggtcgtattacagaggtgcagcaggagctttactagtntacgatattacacggagagatacattcaancacttgacaacctggttagaagatgccngcagcattccaattccaacnntggtcattatgcttattggcactacaatgtgattaagaatctagaagaggcagtacaaacagactgaaggtgaagcttttgagcgatgacattgactcatcttcatggaaacgtcatgtaagactgcttcaatgtagaagaggcttatatcatacatgaaaaagaagtatatgaagaactacaagaaggagctatgacattatagtgggcagttggttaaattgtcataagattggtgtacgaatgacgattgcagcataaggaagcaagatgagaagggggtgagaaggcttggatatggttatgatgacaggtggcataacaatattttgagaccatgttgtgaagagtagacgtaacaatagaatgttgatagaacgatatacaggaatgtataactaaggtgtgagcttaaagaaactgaattgtgggaaaaaaaggtcgtgaacgtaagggtatcataaaattgagatcagagagcgaagatgagctccctcctcacgtcaatagagcat

SEQ ID NO: 666387 - DNA, 699 bp, Homo sapiens
  misc_feature (545)..(545): n is a, c, g, or t
  misc_feature (675)..(675): n is a, c, g, or t
ggcgagagcccctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagccttttgtggcctggcttgtttgcaaaggccctggccaacgtcaacatgtgggagcctcatctgcaatgtaggggccggtggacctgctccagcagctggtgctgcaccagcaggaggtccttgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaagaaaaataatanattgataattcattgtggccgtcttgtcccacttggctctagacttgagccagcttatgcatgcggccggaattagagctcacttgctcaatacgccctatagtgggaggtattacaattcaatggccgncgtttaaaaacggctttacatgga

SEQ ID NO: 666388 - DNA, 346 bp, Homo sapiens
tacatgtgaaagatacaacaataaacacaactatagctccttacctgatgaagcttacggtcaagtggagagaattcagacactaggctgggtgcagtggctcacgcctgtaatcccagcactttggggggctgaggtgggtggatcacaaggtcaggagatcgagaccatcctggccaacatagtgaaaccccatttctactaaaaataaaaaaattagccgagtgcggtggtgtgtgcctgtggtcccagctgcttgggaggctgaggcgggagaatcgcttgaacgtgggaggcggaggttgtggtgagctgagattgtgccactgtactccagcctggtgac

SEQ ID NO: 666389 - DNA, 327 bp, Homo sapiens
agtgctcttagctatttcctgtttgaacatgccctgagcgtctgactggcactgggggccgatgccagggtttcgagcacagaccctcaacatagtccttctaattgacattttccaggaactttacatagaggcgctgataaccgattatatgcatccccaaaataaccccaaataattactggtagcacaaaactgactcttaccgccgttcctaggaacggcgggaacacgaaataccagctccatcagaggcttcctcagcaagcacagctcagatgagtagaggcagatgcttcaaaacaggatcacagtctttctgtccac

SEQ ID NO: 666390 - DNA, 237 bp, Homo sapiens
tggcgtgaccagagttcttatggatagtcccatcacctccaaagcagggggcccaccctccctcctaccagcccctccccagcacccaagccccttcgaggtgacagggccaactcttcgcgagtgggtgtggcaggtgtgggcacgcaagcggagcaggcctcgttagcgcacgggcggaaacctccgttggaaactcggtggggcaaccagcgccagggcgcggggcctttccca

SEQ ID NO: 666391 - DNA, 525 bp, Homo sapiens
ggcgagagcccctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagccttttgtggcctggcttgtttgcaaaggccctggccaacgtcaacatgtgggagcctcatctgcaatgtaggggccggtggacctgctccagcagctggtgctgcaccagcaggaggtccttgccccctccactgctgctgctccagctgaggagaagaaagtggaagcaaagaaagaagaatccgaggagtctgatgatgacatgggctttggtctttttgactaaacctcttttataacatgttcaataaaaagctgaacttt

SEQ ID NO: 666392 - DNA, 704 bp, Homo sapiens
  misc_feature (362)..(362): n is a, c, g, or t
ccccagttattaagatcatcagttaatacacagaattgtgtttccacggtgtctattagcctgccatggtttaaaatgcgtttacaccataacatgtcgatgaaggctaatgatgggcttactacagaccagaaactgttctgggcacataggttctgtctcattttagctcaccgtctcacaaatagccacaggcagatgcagtaggctaggggatgccggggactgcatgtaggctgcctaaatttacatccgggtccctcaacctgtgcagcctgtgccaagtcacttaatctcgtagtgtctcggtttactccactgggaaacagggacaatgatgtagtcttaaagtaagggttgtnaagaagcctggacatcatagacagtgtatacatatttgatagcctcatttttacaggtaaagacactgaaaacagagatcaaagtaactttaactcagggtttcccgggctgtaaatggtagccctgagatctgaccccaggcagcttaactggagaacctgagttctaaccactaaacgcaccacgggaggaacatttgaatatttatttattttttttaacatttgaatatttctatgaggccttatgatgcatactttgacccaagattgcgtgttaaaccatttccagtactgaaagatatttaaattgcagtcaaaaacgcccaatagaatattgcc

SEQ ID NO: 666393 - DNA, 241 bp, Homo sapiens
ctctgtctctaccaaaaaatataaaaattagccgggcatggttgtacgcacctgtactcccagctactcaggaggctgacatgggagaactgcctggaacccggaaggcagaggctgcagtgaaccgagactgcgccactgcactccagcctgggcaacagagcgagatcctgttcaaaaaagaaaaaagaatctctaccagcatatatgcctaacatattaagtgtgaacttggagagga

SEQ ID NO: 666394 - DNA, 213 bp, Homo sapiens
gtgccttttttgggccatggatcaccccctgtaaggtactaaattactgcccagcctggggagatcaaggaaaggtttgcatagttagtaagttggggttagcttttgtgtgtgcatcagtgacttaaagttctgtaataacttattgttaaagcatgaagccctgttttttaacccaagtaaaaactgccttaaacctgttgatgggaatga

SEQ ID NO: 666395 - DNA, 429 bp, Homo sapiens
  misc_feature (64)..(64): n is a, c, g, or t
tggaactgacagagctggggtgaggcggctgcagcctccgccatctctgtggcccgccccctgntggtctttgaagtgcagcagcccttccttttggtgctttgggcccaacagcccaagttccctgttttcatggggggggtatatgaccccagggcctgaaacctccaggatcaggttagggcgagggatacctttccagcctcagttttcagttgcagccctggtgctgcctgcctggatttgggcccctgcccacctcctgcccagggtgcccgttttcccccaaaagggctccctaagggtttgggcaagggacctgttttttttagcccttttccagggccctgccatgctttccaaacccctttttgcagctttttttggttcaagttcccccgcctctttaaataaaccctgcccgcccca

SEQ ID NO: 666396 - DNA, 516 bp, Homo sapiens
  misc_feature (362)..(362): n is a, c, g, or t
  misc_feature (492)..(492): n is a, c, g, or t
ggcgagagcccctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataatccagctgaggagaagaaagtggaagcaaagaaagaagaatccgaggagtctgatgatgacatgggctttggtctttttgactaaacctcttttataacatgttcaataaaaagctgaactttaaaaaaaagaaaaataatanattgataattcattgtggccgtcttgtcccacttggctctagacttgagccagcttatgcatgcggccggaattagagctcacttgctcaatacgccctatagtgggaggtattacaattcaatggccgncgtttaaaaacggctttacatgga

SEQ ID NO: 666397 - DNA, 313 bp, Homo sapiens
  misc_feature (61)..(61): n is a, c, g, or t
ggcaataaaatcttgctactgctcaaaaaaaacaaaaaacaaaaaacaaaaaaaaacacancaaatgttgctttactcttactgcaaatcagacaggagaacctttgtatctagctcagggattgtaaacgcaccaatcagcgccctgacaaaacaggccactcggctctaccaatcagcaggacgtgggtggggccagataagagaataaaagcaggctgccggagccagcattggcaacccactcgggtccccttccacactgtggaagctttgttctttcgctctttgcaataaatcttgctactgctca

SEQ ID NO: 666398 - DNA, 809 bp, Homo sapiens
agtcaggggccactagggaccaagaaagagtaggaagaaggggacgagccgggtagcaaaaccacctcagacagccgggccttctcagccttctccccgcggacagctgggtctccggggacccgtgggccctgggccgccatgcctggccctcccgctgcatctcagaccgtgacacgccaacggggggatgtgggtggcctgtgcccagacttctctccctccgtccacgacccacgctgcatcgatgaccgacgccctgtggagtatcggcagataaatcgactgggagaaacaaggaggataagacaatggatgaggagaggaaggcaccagtcacaacaaggaggagaacatgtaagaagaccatggtgcgacgacgaacaacgacaccaagaacagcggtcagaaatagcaagagcgacaaaccgaccacacgggggccaccagcacaagccagcaccataacagcggcaaacacagaggcagccaaacgaagagacagacattaacacacgggaggaaagaccacacagacaaaacgacgacacaagccatcgaaacacgaaacaagcaggaagcactccccacgggaaaagcgcacgcaatagacacagaggcagcaccagatgcccgcacacagcccacacgaacagcgaacacagaaaacccggcgaaacaaaccacacaacaagagaacaacaagcgggcaaggacagcacacaaaagcaaaaacacacacacaaagaacgacacccagaacaacagacaccagacaggaagaggaaaaaaacaacaaacagcagaga

SEQ ID NO: 666399 - DNA, 613 bp, Homo sapiens
agcgggcacatgcgcggcagcgtcttttccttcttcctccacttcccctaccctccaccgtccgggagccgccgccagcgacgccgggagtcaggaagttcaagatggccgccgcggagacccatcgctacgggagcagccagagatggaagatgctaattctgaacagagtatacatgaagacacatggacgaagtatcagaagaccagtctcaaaataagcacagtcgtcacacaaaacagaagcataaacacagaagtaaacatagagaaacataagacatgcctcagaagaagacaaggataaaaaagataaacataagcagtcaaataagaaacacaaaagaaaagaggttatcgatgcttctgagtaaagagggtatgtctccagacaaaaagaactaaacttgatgatttagctttgatagaagacattggacaacacagagagccttgattaacggacgaaattgataatgagttaactggaaggcaaggtccagtcatggtatggggcatcatttagcaaggatgtatgagtctggcatctgaaagaagaggggagaaattcatgaaaaggcaagaaatggaaatagggtctacgtcactagga

SEQ ID NO: 666400 - DNA, 339 bp, Homo sapiens
atgagtgcttcactaaggttatattttaaagtagaataacacactgctgagtgtaaactggctttggcattggtcagctgcacgtagtacaacaacagcatagaatttgagacaactaaaactgctatgacgatagctactgagaaacctaaaactgctatgagatagaaatgatgtaaaattatgtggccagttttccctcatatactcacatacagccttcgaagggctctggctctgaccggttgatggccttgagacgagatgaaatcatgacaattgagtcaaatcaatttgacatagaaatgacaagaggaaactcttaaatacctaaaaaca

SEQ ID NO: 666401 - DNA, 771 bp, Homo sapiens
ggaggcaccggctggccagtgatacatgtctaagcggtcgggtaccctaagcggtgtcaagaggtcgcataatcactggtaccttaatagtagggacctgttatgaatgcgttccagcgatgggttcagtctgtactcttactttataatccgagtgaaatggacctgcccgtgaggaggcgggcataaacgacagcaacgatgacgagagacccgtattggacgcttgtacattctatatataatgtcgacatgcagttaccgtaagctaaatcgccaacgaaggtcgctgagaatctgacctaaaccatgaccgattaagagagatggtcgggtaggggcgacctcggacgcagaagccaacgctccgagcgggtacatgctaggagttcgtcagtcaacagcgaaactactagtactcagattggactccagataacgttgaccaaaggaacaagttaccctagggatgacacgggcaatgcctagttcttagagctctcatatgcaactagagtacgggttctacagaggctcgtactgtatggatcgaggatcatcccgatggtcgctagcgctatgtaagaggttcgttggttcaacgattaagagtcctacgtgatctgagttcacgaccggagtaatccaggtcggtttctatctacttcgagattcctccctgtacgaaaggacaagagaaataaggcctacgttcacaaagcgccttcccccgtacatgatatcatctcaacttagtattatagccagagc

SEQ ID NO: 666402 - DNA, 121 bp, Homo sapiens
aattcgcggccgcgtcgacacggctgcgagaagacgacgaaggggagtctgatgatgacatgggctttggtctttttgactaaacctcttttataacatgttcaataaaaagctgaacttt

SEQ ID NO: 666403 - DNA, 387 bp, Homo sapiens
ggggcgttggatattgggtatggcacgggtatatattgataattgtcgtgatgaaattgattgccccttagatagagcagactacctgctaggtgtaaggatgaagatgtgttagtgtctacaggaggctccaggatgggagtagttcccttgctaatcggagggtagactgtacaacctgtttcctgtctccggcctccactattgcagatgtgagctcggagtcggagagagggaggtaagagtcagaagcttatgttgtttatgcggggaaacgccatatcgggggcaccgattattaggggaactagtcagttgccaaagcctccgattatgatgggtattactatgaagaagattattacaaatgaatgcgtccgtcgaagt

SEQ ID NO: 666404 - DNA, 571 bp, Homo sapiens
aattcgcggccgcgtcgacacggctgcgagaagacgacgaagggggagtcaggaagttcaagatggccgccgcggagacccatcgctacgggagcagccagagatggaagatgctaattctgaacagagtatacatgaagacacatggacgaagtatcagaagaccagtctcaaaataagcacagtcgtcacacaaaacagaagcataaacacagaagtaaacatagagaaacataagacatgcctcagaagaagacaaggataaaaaagataaacataagcagtcaaataagaaacacaaaagaaaagaggttatcgatgcttctgagtaaagagggtatgtctccagacaaaaagaactaaacttgatgatttagctttgatagaagacattggacaacacagagagccttgattaacggacgaaattgataatgagttaactggaaggcaaggtccagtcatggtatggggcatcatttagcaaggatgtatgagtctggcatctgaaagaagaggggagaaattcatgaaaaggcaagaaatggaaatagggtctacgtcactagga

SEQ ID NO: 666405 - DNA, 514 bp, Homo sapiens
aagcttacctgctatgtccttgggttcgttaaccatcgctgaaccggctatgatcgccgaatgtaagacgcgtaccgaagttttcgaaatctcgagacgtttgattgaccgcaccaacgccaacttcctggtttggccgccatgtgttgaagtccaacgctgcagtggttgctgtaacaacagaaacgttcagtgtcgacctactcaggttcaactgcgtcctgtccaagttcgtaagatcgaaattgtacgtaagaaaccaatcttcaagaaagccactgtaactctagaagaccacctggcatgcaagtgtgaaactgttgcagctgctcgccctgttactagatctccgggtggttcccaggaacaacgcgctaaaaccccacaaacccgggttaccatcagaactgttcgcgtccgtagacctcccaagggtaaacaccgcaaattcaagcacacccacgacaaaaccgctttaaaggaaaccttaggtgcttagtaaggatccgaattc

SEQ ID NO: 666406 - DNA, 817 bp, Homo sapiens
  misc_feature (308)..(309): n is a, c, g, or t
  misc_feature (663)..(663): n is a, c, g, or t
  misc_feature (793)..(793): n is a, c, g, or t
agggtgggtaggggaaaacaatttcccccgagaacaattttgctccttatttcccccagccgaaattacaccctccaaaagggacaaaaggtgggctcccccgcgggcgcgcccctttaaaaaaagggatccccggggtccagattggccaaaagccaagggtggggctcttcaagaaaaataaggtgggttgggtagggccttcttttatcggggaaaaagccggtgcggaagggcaagcctaaatttgcccggccaagggctttgtttcaaggttgcccggcattaaatgggccccctttttgccnnaaaataaggtacaagtcccggaggataagatcaatgccctcattaaagcagccggtgtaaatgttgagccttttgtggcctggcttgtttgcaaaggccctggccaacgtcaacatgtgggagcctcatctgcaatgtaggggccggtggacctgctccagcagctggtgctgcaccagcaggaggtccttgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaagaaaaataatanattgataattcattgtggccgtcttgtcccacttggctctagacttgagccagcttatgcatgcggccggaattagagctcacttgctcaatacgccctatagtgggaggtattacaattcaatggccgncgtttaaaaacggctttacatgga

SEQ ID NO: 666407 - DNA, 484 bp, Homo sapiens
ttcgtagtaattgagcgagcccagaagatgtaatgtggaagtgaggtagatacccatttcctacttgggtgctggataagataccaaagaattaatcaaaacgttttatttgctagcatgcaaatcaagaggttccaatcttcgtgttcactttaaggtatgcgattcatagttgtgatccaacagttcctcatgtaccactcaaaaaaggtagctgcagtgatgactttcttaggacacctttgggatttaccgtgaaaaatcagataaaattctgagcagccaccttatatttaggcattgatgatcagggttgtaaggatgtagcgtttgtgacattgagaagtagtaccagaaaaaccatttgaaaagcctaagtgtgcagatcacggatggggcattttaactggtaataccttgattgatggaatttaaacggtttaaacgtggataactgggggtttgggggtctcttcaaggttta

SEQ ID NO: 666408 - DNA, 648 bp, Homo sapiens
gaggatatgtacagcttcctagcaggacatgggcttgaaggcattcaccagagctcagagattcgttaacccgatatgtgtccactacgccttacaagcgaggtaatgaacactgcatgagacctgagggtctacgtgtaggttttatagagtcatgatgtaactgggaagtaggccattcacgacctggtgccatgttgaagagcctcgacacgggtagacctgtacgaaagtacttcccgtgagacatggatctgggattgggtggtggtaaactcagcatggtgtggctcgaggtacggagtcacagtccctgaccggccatcaccgacgtggaacggtcatggggcccttcgtgcctgtctgaacgatgctggagctatggttatctcttccaactgtctctctccgtagaccttccagcaccttctttgatggagcgtcacaatgtccttactcatgtgattcgtggagaggcctgtcatacatcaaggccacgggcctaaactaccttcccaaatgcatccgggtcagtgtgcagctggaagcctctcccgacttacctagctgtcccagtggagaaggaacaagcgcctcactgcatctgtgcaaacggggcggcaaactgtgtccctgggcagtaaaccc

SEQ ID NO: 666409 - DNA, 637 bp, Homo sapiens
  misc_feature (39)..(39): n is a, c, g, or t
  misc_feature (160)..(160): n is a, c, g, or t
  misc_feature (281)..(281): n is a, c, g, or t
ccccccccacttctgtgaaggagagggagggggggtttncccccctcccccccccttcttcctggggggggttttttttttctttcttctccccaaagagggggggggggccctttggggttttttttttttttggggggggggcgctcctttttttttnttttttgttttgttcgccccccccttgggggggcccccttttttatttataatctctcataagagaaggcccccccccgaaaaaaaaaaggggggcccgcgccaaaagaagagaagggggnaaattttttgttctcctccttccttttcccccccaaaaaaaaaaagtttggggggggggccccccccacccccccccgggggggggggccccccccctctgaaaaaagcccgccgggaagacctctctttcccaaaaaatttgttgtgggggtttttcggcgcgccccccaattttttgtggggggcccccccttggggcccccccaaaaagggccctttggaaatttccccccccccccccggaggggttttccccgcgcccccagggcccaaaaattttcccaaaggtcctgaagggcccaaaatggttttaaaaaatttttcccgttttcctccaacaggctgttttgttatt

SEQ ID NO: 666410 - DNA, 125 bp, Homo sapiens
cttctcgcatactggaggggcagccatgaaaactccaagcgccccttgagcataatgaaggagatgccccaggactctccacgtccaagaaactggtagggatcatggctcactctgaagtccta

SEQ ID NO: 666411 - DNA, 950 bp, Homo sapiens
agcggggtccagccggcggtttgagggaaatgcccaagggaacaagggtgtttaaaaaaaccaaaatgggggagtatagagagggaactggggcccgaatgggccgaaagccaaggtctgggcgtgaactggtgccaccagcgccccagcgacaagtctggtcaaaggcttccggggatcttccctggggccaaagcgcaccaaggggagccagctgcccccaaagcgtttgacccgtaaattagagaatgatcagcccgggggaggaagtgtaaaatctgggagccactttgaaaaatcctttccagtgaggcaccataaaaaagttgccccctcgctggggccccctcgcccaggtggaaactgtttggcccgtgagtggtgttaattgtgcttcgtgttgtgctgaaatactgtctgtcatagagttcccctccgcaccactcccccggatattttaatgtatgtctgccctccattagtgtgtgtattgaagctgctcttttttaatagggcgtctgcaaactcttggtgataccgggatatactcgtgatgttataaactcttgtgagccaccccagaggaggagtgtagcacccccttttaacacgtggccactgcaccactcacgaggagaagagaactcgcactgtttgttgttgagtgagtgagaatataaaatgctacgcggagcacagtcttttttactggtgcttaagctcttctgttgcacccaaagctttaataaaaggggaatttccaaaggggaagccccttaggaattagagagttttgagggacagcccttacaggcctttattaagtatgattgattgttaaatttcagggagacatgattggtttgctgtgtatttgaattcatgtaaccaagaactgttacgatgggattttgctcattttatttaaaaggtactgacttgactttcca

SEQ ID NO: 666412 - DNA, 326 bp, Homo sapiens
taataccaggttgccatcccaggaaagcgagtaggaaaagcccaggctcgagatcggcttgcgcaatcgtccaagtccgtccccggtccgtcgaccggtacagcgtgttccccatggaacggcccaccgtcgattgcggatcccgataaaagatgtttgcttgcaacaagagcagatccggcgtgcgcggattcgggatgatcgccgccgcggtaaccgattcaatccccagcgtattggccgacggcactgccccggcaaccgtccaagtcgcaccatcgtcgctcgataccgagaagccggccggcgccccgggattggctgca

SEQ ID NO: 666413 - DNA, 208 bp, Homo sapiens
tagagcaccccccgctcagagcagtcttaaaggggtcttgtcttctggaatcccttaactagaggatcctctccagagcgtctgcaatatagtctttatttcttcagaacatttagtcacttgttgtctctgcaacttcacttctttgcgaagcgccacaattcccttttccagttttcccttctttggcaatcctccgaggtgaggg

SEQ ID NO: 666414 - DNA, 760 bp, Homo sapiens
cgacaacatggcacgagaaggcggcatgtgatatcctgaatcattgtgtatataactgtattctcagagctgctgaggatcgtacggcctggtgtaaccacacaacagaacagagctgcatgaaattcgccaccggactgtatctcaaatcatgacccaatgacctagcggccatacggtgggatctccttgagtggaagccctaaatagcgttggaaaatactagtatggatcccgatcgctggccaccgtatgcgcaacactatcacagatacaacagtaacgataccttcgcacattcactatcaccacctaggtaagcctcctacacacatcttgacactgcaatactaaccccaccgcccttcatcacaaaattacatcacgaacctcaagactgacagttaccactctaccaccatgactcatcagttactactcaccaataacatatgaccaactacttctattaacccttctaaacacctaacatgacaccaaaacaaagacaaataacacccaacaacaaacactacaacaaaagaccactaccgtaccgtcatacacgaaccaccgtggtagcacctctgtaatcccatcccactttaccactcaacacctgcatagcggcgacaattaaccttacaatgtacagggggaaggcaagattccaaatacaattcacattgacacagaacattaacaggcaatagtggatcgagcaaatacagaaactccggacaacataaattcaccctca

SEQ ID NO: 666415 - DNA, 256 bp, Homo sapiens
tactctatggtcacaaactcaggggtttgggactaagtaaaggcggatcctttagtgtagatcatgtcactaagaatcacacctcatccgttgcttattatcatttttccaatctgcgtgccccctcacggtccaagattctgttagttcatagttacatctttagtgtgtagcatagtgctggggatacaagagttcatgggaatacgtctctcacagtctgcattcacccagtatgcaggacaaaaaaaaaaaa

SEQ ID NO: 666416 - DNA, 939 bp, Homo sapiens
ttcacgaatagatgctgcggtaggacttcgttgccggagctcgactgattagatgtttgaagtgattgatcatgtgagtctatgatggttggccattgggtaccttgcgctgtgggtggaacgagtggtaatctactggaatgtatggcatatactcggtgtgcctttttgtgctgcgcttgaattaagtctctgcgcagacactggaaatttactaagctgcacttgagattagctacactagcgtgagttcaacggacaagtggaagttgaacctttagatatctctgtcccctaacatgcacattgggatggatagtccgatcctgtccctccttctggagatttaaatactgaaggatgtaatttgtacctggaagataaggggtctaactactctgcacagggatcggacttctgtgatgtcttgcatgaatgtaggagtcatgggagtgctagtgagcggtaggagagtgctataggtgctgaaatgaattgtgagatttttcgtgtagattgtgcagtggactggttgggttcatgttagaacatcctgtccgtgaaagtgcgattgtgcatagtagactttgtttagcttaccataattgacgatatatatggcatgtgtgtgacaccaaaatccatgaaaagctcaaaagcaacctagagtgtggtacctgtcattgatgagcgaattagaattgtgggctgccgaatcagtttaggattcctagctctagtataggggactgggcagctgtgttgaggcggcgcccttggtataaccatttcaatgccattttgaatccaattgtttgggggcctccccgggtagagacacgtctcatgggttgggccggttcccccgttgaacccgcctcatacttggggccaattgccgttgacaccccacttggatagagcccggaccccacgctc

SEQ ID NO: 666417 - DNA, 340 bp, Homo sapiens
tagagactgagtctccctctgtcgcccaggctggagagcagtggggtggatttggctcactgcaatctccgcctcccaagttcaagcgatttttctgcctcagcctggcaagagctgggattatagataggcacatgccaccacccgtggctaatttttgtatttttagtagacacagagtttcaccatgttggccaggctggtctccaactcccagcctcaagtgatccagccacctcagcctcccaaagtgctgggattacaggaatggcctctgcgcctaccctattttatttttttcgtgggcttgtttgtttgtggcctatgcccccttcttcct

SEQ ID NO: 666418 - DNA, 1177 bp, Homo sapiens
tctgggttgagcacagggaactttatggagggtccatgaaaagggggggttccctaggcccctcccctcttcagaggggttctactgtggaaacgtggtgaggaggggagaattcaggtggtggggggggcacgtgaggtgtgtggcggggactccccagcaggtgagggtctctctcttcctctgggtgcctctgcgggggcgtgggggctccagggggggtcttaaacctccttgtgggggccattgtgtggcgccattagaggtccaccacctctgtgttggcttgttacccaaaatcggtggtacaataccagagaaattgagctttgaacaaagggggtcgtggaaggggacaagggcacagccccagggtgctcaaagggtggaagagaaggggggtgttcgcgtggtgaaaagcctcagagagggaaaccacgcgggggggccccaggtggtagcccaggaggcccttgggggggcccttcggaagcgccgtggttcaaccaccttttgtgggaggtactcaatatttggggaggggttcctaaaagggcgaggttcaggttccaccatggacccgtgggcaggggggcacacggaaaggggccatgcctatgtgaactttcccgaggtaacgctacagggattagccttttgccaaaaagctttggggactggctgccaattaaaacgggagggaacataaacgtcctggaaaaagcccccgggggcatataacgccacaagattcccccgcgagggggggccaaccccaaagttccttcagggcggggagcaagagattggcactggactcggagggcccaagaagtcttccaacgaaaacccaagttgtgactgggatagacttaggacaggggcggtgcaacaccattggtgggggcaaaaaggaactgtggaaaaacaaagaagggggggaaacctcgcagggagacaaccctaggagacaactggggccacacaggggcataatagcctctggggcccccgggaaatgagccacgattcacgggggaagaaccgggaccaagaaatacgacacagcccagatattgggagcaccggaaaaaaggaacagaaaaggcagcaacaaaaacggaaaggaaacctcaaaggggccaaagaaagggacaaaccactcgaggggcaactc

SEQ ID NO: 666419 - DNA, 479 bp, Homo sapiens
tgggggaatagcctgagtccaggaatgcgaagaccagcctggcgaagatggcaaaacccacctctgaaaaaatacgaaagttggcagtcatggtggttgcgcctgtggtcccagctacttaggagcttagggcgggaggatcacttgagccctggagtgcagtggcatgatctcgagtctcggctgcaggtccgcactccgtgggttcacgccattctcctgcctcgtgcgtcccgagtagctgggactacgggtgccccaacaccatgccgggctacatttttgtcttaaaagtaggagagtggggtttcacgatgttggccaggatggtctcgacctcctgacctcgtgatccgccgtgcctcggcttcaaaagtgctggattacaggtgtgaggcaccacacccagcaatgtgttcttaataagtatagtcgctagggaaagtaactcatttttgtctagtacatatatgtacata

SEQ ID NO: 666420 - DNA, 108 bp, Homo sapiens
  misc_feature (108)..(108): n is a, c, g, or t
gtccccggaccgccggtatgagcgccctcgccacccgtgtcccaggcccggcctttttgaaagagctagctcgggttcctggggcacttcagttttgtaatgtttgan

SEQ ID NO: 666421 - DNA, 1026 bp, Homo sapiens
  misc_feature (489)..(489): n is a, c, g, or t
tatcgccgctcaagaccaccgcggaagaaccacgggccgcgccgtgcgggtggtgctgcgcaccgtggatctcccgtggcccgccagcagacgtttagtcttcaccgacggggacgaccctgagctcgagctcctaggtcggggaccggctggtcatcaagctaccaacatgcttctggcggatgctgctactcggtcagggcccgtcgtgcttgctaaggatgtccggatggaagtattgacgacagttcacttcgagtccggggcagcaatgtggtttttgcgctacgtggactgatggacgagagttgaatgatgaatgcgcccagtgtagtccatccgtgtccgaccgtgcgtcgtctcgagacttcttcaagcgcccagtcgctaagggaggtcttaccatgtgtggctggcctcgagccttgtggaaaccagtcaccatttgattggccaggcgaagagtggtccagtggttgggcagatggntgtgatccacggagtcgaaagcttctaggtttgtgcttgacttggtgggaggcccgcggttctagccatccacgccagcaaggccgttgccgcgtcagcgcgagtgagctcccatggtgcctaggccttggcgtcgatggcttcaatgaggcacgaggctgcagcgagagttgccggacttgccgggaagtgactgcatgcaggttgggcgtacatcggtggcacagggcgtcctgggtcgcgccgacctggcgtgccacagggcccctgcttgccaatctacagccgtggagaagactgtcagagggcgtgccgaacgcgaaaaccacctgcttccaagcaggtttagcctttgtaggccactggcagggtcctgtagaagacctgacatcccgtggttgaacggtgggctggagggcttccaggccgtgcgatcaacgaacgccaagaaccggtttaaaggtcggtatccaatggtcttcgtggtaccccagacaccggagctggggtcccagggcagacaacagggggccccga

SEQ ID NO: 666422 - DNA, 153 bp, Homo sapiens
ccggttatgtcttacggagtgaccccatatcactcatagtttaatcccattaactccatagtcttcaacatgcctttgttctgtcccttttggtcctttaagggccgcacctgcggtatatggaggttccccggctaggggtctaataggagc

SEQ ID NO: 666423 - DNA, 684 bp, Homo sapiens
gagcgggtgtatccgctggtcgatagcagccgggctggtcctgctgcgagccggcgtgccggagtggggcggcgggtaagtgggcacgaacgcggtggacgctgtacagttgccttcgtcggtagggaactgctggcggcctacggggtcgtcctgagagggaaaagcgggctccggctgcaatctgcggcgccctgcgtggacgtaagagccaagtggcctcagaggctcgccccctacgcaaatcctcgtttgacttgccagggtcctgacagtgatcgtgctggaccgcgagaacggacatggggcgggcttggcgggaggcgcttgaggtggtagcaggaggcggcttttgctgagttttctctggaccagaagcgctcgaggctgtccgtgtctacgcagtggtgggacatcccctgagtgggcctggctgtcggagtctgccgtctatcggaggcaccggtcgactggcagagccaacatgccctcttcatcggactgtaaggtcattgtttgccagtctgtggtgcagcgctggcaagctgggggaagaggttttctgtgttggaataggatgagtactgagcaggtttgccttccagactgagatgtaatttcaggcctccatctgtgagaagtgtggaaaactatcttgagtggttggaatgttctaggtatgac

SEQ ID NO: 666424 - DNA, 468 bp, Homo sapiens
  misc_feature (76)..(76): n is a, c, g, or t
  misc_feature (96)..(96): n is a, c, g, or t
  misc_feature (98)..(98): n is a, c, g, or t
  misc_feature (101)..(101): n is a, c, g, or t
  misc_feature (106)..(106): n is a, c, g, or t
  misc_feature (115)..(115): n is a, c, g, or t
  misc_feature (246)..(246): n is a, c, g, or t
  misc_feature (260)..(260): n is a, c, g, or t
ctacttctactggaatggttgggtcccctgaccaggatctccaggaagctgcagctggttgtatatccaatatccncaggctggggggtgctacananaanacaanatacacttnaaatttaaatggacattacaagctatcaaattctacatgacacaggacatgtcactcccatggccagaaagcctaaattgggaaacagttgttagcaaaccctttcaaccatctaaatgagagcaggcaanttgaaaatgcacanaatgttaatcatctgaaaattgcatggagacttttgtttctatttaatgttttcgagatatgacatgtgataagatggaagggcaataaacctgtgataagtttctaagaatatgagaatatacgtgtatgatggatttttagttcagggatgcttttgtatttggggcggatttaataaagggcctggcctcgttggcctcagaggg

SEQ ID NO: 666425 - DNA, 887 bp, Homo sapiens
agctggctaccaggtccaaggcacttgctcccagctgacatccaggctcagtttgccgatcagccgggagctagatccggaacatctacaatagcttctgcagcaagcttcgcgaccagggccagagcggatcgcgtcgcgggccatcgacaatgcggcagatcttctcatattcgtggaatggagctaatgtgcaatagtggtctgacacgaccccgctgccctcctgcgcgtctgctctgaatagcagcaccgtgggggatccctgtaagcatggctctgaaatggcctgtctgtggaatccgcgctgctcgccgacaaggctgcacaactagggtaagcaggaagagaacgacgtggtggagaagcttgaagcctcttcttggatctgctggcgagtcctataagtgacctagtgacgagccggcatagcgaacggcgcgtgtatgccatcacacggcgagccacgacggtgcccttgctacaaggtaccaggcctcgatgaagcagcgcacgatgcatgacgcgaccaccgcgacaggaaccgcgaagcgccggaggtccgtgagaggccgctggaggtcccgcaatcgctgggagcaggcagaaacgcgacttcagacgataggagctagccggagactacgttctccgctgtcactggctgcagcagcgagacggcagctcatccagcgtcgtagcgtgcccgctcagcgtcccgacatcctccggcgccgttcggtcagacgtctcagaatccaaaggtgcacaatggacgatggagccaaggtcgtggcaactgatcctagagggccacaaggctcgaggcttttcctccttctgcggtggacccacactcagcacccctgaccccaccgtgcttcccg

SEQ ID NO: 666426 - DNA, 358 bp, Homo sapiens
gcgatgtggcaggccctgactgggaggtgggagtgtccagtgcctctgtgcttctcacgaactgtcgcggtacccatggcgtctgccaatcataagaggagcccaggcttgtgtgcaccccaatacccatcatgaatacccaagttctggggtgggtccaaagtcgcgcatccctccaatccctcatagaccgtgcaggtcacaccatgccccagcccagtcctcactgtgacctcattcatcgcccatagcccaggcctgaggccatgcacttgcggtcatcggctcattcacagtgaaagcgccttgcctggtgacatgggcagctggtccatcctggggtggcccggtacatggc

SEQ ID NO: 666427 - DNA, 292 bp, Homo sapiens
ctgagaaagggactgagcatagtactttgcctcggcttccttttctccatgatccaatcgagaagagaaagtcatcgaaacaacttctgatcagcatattgggtcatgtaacgctggagtctgatcatgttgtcagtctgctccacactgttgtgtaccagtatatcagaggtcacagtattatctctgcctagagaagctgcccacagggtccgggccttttgaaaaaaagaggagattagagatctgatccatgggcctcgcggacgggtgggtaaccgtagctcgaatt

SEQ ID NO: 666428 - DNA, 179 bp, Homo sapiens
cagtttgatcagtatcagctttggtcgatggaccttgccttcagttaggagacaggccatgccttgcaagtgctgcagctcactgatttcatcctctagtttccgcacagtgcccaccactaagtatgtccgacaagcctagcagaaggcagacctccatactcctgtaccgcccgggt

SEQ ID NO: 666429 - DNA, 433 bp, Homo sapiens
  misc_feature (19)..(19): n is a, c, g, or t
  misc_feature (29)..(29): n is a, c, g, or t
  misc_feature (33)..(33): n is a, c, g, or t
  misc_feature (35)..(35): n is a, c, g, or t
  misc_feature (417)..(417): n is a, c, g, or t
gttgctgcctgcggtaatngaagggggtncttncncttccccttggtgggggacaaatcctctaaggcccaggtcatcctaaggactggaatttaagcctacgggaagccactggggaattatgtgttcatttgagttggctgctgcgtggaccgactacgctggggcaccagtggaagcagggaggggagaggctactgaagaagctactgcagctcttcaggtgagaaagggctggaggtacagatgactatgccaggctgtacagtgaaggaagagctagcgggaccaagaataacaagactcaggactcccaggaagctgagagggaaacaggaaagttagggatcatgcctaggtttctagccagaattctgagagctgccaccaacccccaagggggagaacctagttttnccccttgggggggggg

SEQ ID NO: 666430 - DNA, 200 bp, Homo sapiens
agagcttcttggcttggaagagatataccaagagtttccgggaaaggcaagctttgttccaggtgaatcagtgctaacctggttagaactgctgaagagaggatcagaggaggagctgactaagaccagcaaagccttaatgtgcaaacatactgtgctatgatgtactgcattgacctaccactgcgaaaattcattcc

SEQ ID NO: 666431 - DNA, 716 bp, Homo sapiens
gtgacgcgtgggtcgactacgagaaggaaagctcctgtaaacctgttattctggaaagtaaagcagaggtagagggaatcaaatgttccaggtataggacctggctggagttccagcactctgatagcaggaaagtgatttaatcattgacaggaatctttcctagagatggcggagaaggccatgcccttccaggattttatctgctactagatatttagagccctgagggctgtccattaacagatagatactctggtgttcccatactccaaataggagcaagcataggctaatgactctggctcccgcaaacctgtgtgcttacatgctgacttacagttactaacagggcacaaatcaaaatcttgcgagagtcacaggagccactgaaccaagaaagaccatgacctgcaacaactgggtgggacagcagattacgcacaatgagacataccaaagagtgtacagggtccgttacataattaggagacgatgaggcctgtactaccatattcatagaccaaacaagctgtagcatgctgatattcaaacgtgggaatacacacatcaagcatctagacaacatgtaaacaatgaagcttgccaatattgacaaacactacgtttagcgcaatggacactgagcaatagatgacaacacaatcaaacacacacaagtatatacctgtcaccttcccctactaagaattacg

SEQ ID NO: 666432 - DNA, 188 bp, Homo sapiens
caatctggcagtgtacatacatggtcatagctagagatgaacattaactgctgcagcggctggcagacggggccatctgacctctatgccatggtggtggttctctctgaagtgaggaggcaggcaggaaatgcctgagccggcacgcggactgtgtactagaatcccagcgcggcccaaatttgatt

SEQ ID NO: 666433 - DNA, 116 bp, Homo sapiens
agtggtgcgacgccctaggattcatctttcttttcaccgtagtcggctgctggcattgtataagcaacttcatcactagacatcgtactacagcgacatgtactacgtgtgtcgcc

SEQ ID NO: 666434 - DNA, 150 bp, Homo sapiens
gtttttttaaaaaacccccccttccaaaaatgtaacccaacggaattgttaggatatttaatgtaaacttgttttaacaactcttttcaacattttggccggggtattccccggaaccaaataaatttcatgggtttttagttgttttta

SEQ ID NO: 666435 - DNA, 221 bp, Homo sapiens
ccccccccctttttttttccccctttgaaaaacccgggcgccctccccccccggttttttttttgggccccggggggggttatttttttcccccgggaaccctttttcccttttcctcttttcaaaaacttttttttgtgcccctttaggggggccccccccgggtccccccccggattttccgggtccccccccccctcccttttaattttttaggcgga

SEQ ID NO: 666436 - DNA, 107 bp, Homo sapiens
  misc_feature (104)..(104): n is a, c, g, or t
caacgtgaatccagagtaggagggatcgggtagagggctgggctatgatttgctttccttggcccagttggtgcttgactgatagaataaatgacttttttgcncca

SEQ ID NO: 666437 - DNA, 255 bp, Homo sapiens
ggatataaggacttgaacaatcattagaacgagctacttttgcacatactctaaaacattatataaacagggccaggcatggtggctcacatctgtaatcccatgcaccttgggaggctgacagtgggcggatcatgaggtcaggagtttgagaccaacctggccaacatggtgaaaccgtcttctcttactaaaaatacaaaaaattatccagcgcatgcgtggcgtggcagcctgtagtccctagctactcgc

SEQ ID NO: 666438 - DNA, 334 bp, Homo sapiens
tggaactggaggctattatcttaagtgaaacaactcagaaaaaaataagaaaataaagatttttaaagaaccctcagaaacaaaaaaaaataccacatgtttccacttataagtgggagttaaacagggtgtatacagggtcatggagtgtggaataatagacactggaggcttggaaaggtgggagggggtgagggatgagcaattaccttttgggtacaatgtacagtatttgggtgatggttacactaaaagcccagatttccccactacacaatatatccatgtaacaaaactgcacctgtgaccaggtgtggtggctcacacctgcaac

SEQ ID NO: 666439 - DNA, 311 bp, Homo sapiens
gtttgtggttgtagcgacttgcaagtagccagtgtgagccgcatcccacacactgtccggcccacccctcgggctccatggcagctctttccaggcgcctgccctttccagtctcccagagaaagaaaggcctgggggaagcgggcggagagtgtcttatgctagggatcaggggtccaggaaggaaggggggcaaggggaagctttgggcccccggttcccaaagggggtttggggggccccaaggggggaaaaagggccccctttttcaaggggttttcccccccccaaatttgtggcccacccccccg

SEQ ID NO: 666440 - DNA, 1170 bp, Homo sapiens
  misc_feature (1)..(1): n is a, c, g, or t
nttcgcttgcgtcttgttgttgctatggtagtgaaccatagggggggcgtctcctctggtagccgatctttggagggtggctttgttgcaatatatgttttgtgggtggccacacacagtgtgccactagtgcttttgtgggctcgttgggtgcacaccccctgcaccggggggaagtgtgcactatgtgcgccgcgtcaagtggtcgccccgacagtgctaggtggtctcacaggtgtggctacgtccacagagtgtgtgttttggcgctccctaggtagcgtctccctcatgaggcccccccctagtctgtgtacgacatatgcgtactgtgggccgctccgagtggcgccacaggggcctctacagactgggcctcatgtgtgtccgcctggccctggttgtgtgggcgccccctggtgacagttgccccaagggtgttttgtgagagccgcagactcacacccgcggggttttatgagtgttgggggcgaccctctctgggtgtttcggggttgtggccgctcgtgagagaccccctgtgtgggtgtcgtgtgggcgtgccacgtgtggtttgagacagtgttgtgggggcaccacacactgggggtgttctttttgggcgggtggttgaaggggcgccccccgtgagagggcctcttgtgtgagagaatatccgcgctgtctgtggggctgtctgtgggccctcatggccctctgtggtgcgctgcacctcggctgtgtgttgtgtgttgatgcgccacagggtgctctttccctcagcctgtctcccacaaggccgccagggtggctgtctaagaaggggccgctcggagaggcccactctcgggggcttgcctgtctgttgtcacggggtttcttataagggtgcacatgggtgcccccgtgccctgggaggcccccattgtcctgcccccactgccggacccgatagagaaccgcttggtggcttggaagatagttgccaacaccctatgttgtggatagggccgacttgggtgccatcgccagaccatgcccagcttagagagccatacgtgtgtagctggaacagataaccccttttgtaaattgttaagacccccaaatatttattggttttttaaatttagctcgccatgtattttttttaaaaaagaattatacccc

SEQ ID NO: 666441 - DNA, 720 bp, Homo sapiens
  misc_feature (36)..(36): n is a, c, g, or t
  misc_feature (151)..(151): n is a, c, g, or t
  misc_feature (156)..(156): n is a, c, g, or t
  misc_feature (158)..(158): n is a, c, g, or t
  misc_feature (215)..(215): n is a, c, g, or t
  misc_feature (221)..(221): n is a, c, g, or t
  misc_feature (224)..(224): n is a, c, g, or t
  misc_feature (240)..(240): n is a, c, g, or t
  misc_feature (280)..(280): n is a, c, g, or t
  misc_feature (291)..(291): n is a, c, g, or t
  misc_feature (309)..(309): n is a, c, g, or t
  misc_feature (415)..(415): n is a, c, g, or t
  misc_feature (418)..(419): n is a, c, g, or t
  misc_feature (432)..(432): n is a, c, g, or t
  misc_feature (445)..(445): n is a, c, g, or t
  misc_feature (483)..(483): n is a, c, g, or t
  misc_feature (489)..(489): n is a, c, g, or t
  misc_feature (501)..(501): n is a, c, g, or t
  misc_feature (547)..(547): n is a, c, g, or t
  misc_feature (616)..(616): n is a, c, g, or t
  misc_feature (622)..(622): n is a, c, g, or t
  misc_feature (630)..(630): n is a, c, g, or t
  misc_feature (665)..(665): n is a, c, g, or t
ttgggctgtctgtcccggggctgccgggggttcctngtgcttcctcgtgggcgtcctggtgcttaccccctggccactggtgtggtggtgggggttctcctggtggtccctagtggttgccttcctgttttttcttgttgctgggcgctcnggtgngnggggggggtctggtggccggttgttgatggtcattgccgcccggtaggttgccgccncggggngcntgctgtgtgggcgtcntggggttctccggttctcaccacccttgggccacgccgtnttgtccactcntgaggggttggtcaggtngaaggggcggatgatcgtgcggtagccgttgaagtcccctgccgggccggggacggcggaggtgctcttcgagctgttggtgtccagggcactgggaatcgcagcnttnnagccctcgaaatnggtgacgtctgcnacgaagcccccttcgcagagcattagggctttgttttngtaggnaatggtgcgatntgagccgccagacttggtgaggcccaggacagggagctcgtccgangagcaggagaagccgtagttccagcagctctggatggccgggaggtagaccagggaccaggacaccctnttgttntggaagangaagctggggtgttgtggagtctggaaggactggnaggggtagtatctgtagtcccccggggcttggaagtaattagaagaatatttgac

SEQ ID NO: 666442 - DNA, 1096 bp, Homo sapiens
agcgggtgtgctggccgttgtgcttgcaaatggggggaaatggatccggtcagccgaatacccccagcctcccggtgttgcgcgctgggctgaggtataaggagtcagcaatcgcgagaacaggcatgagggcgcgcaagagatccagtctcgagatgagagaagcggatacagctcagagcaggcaccaaaggattcccacctggacactcggcagagacggagagcagcgacactggcacgaaactgacagggaagcgagagcaggaggacggggaagacatacggacacggaaaaacacatgcagctaaggccggacgggacaaacgaaagaggtacactggatgaacgaggtaaatgcgggagacatcagcctcagggagacatatacgagccctggagtgacaccaacgaggggatatggaacaccacaccaaaaagcatatgggagagctaccaggagacgggaaagaggaacataatcagagacgacacacaaagtcaccacgatataagaaacgaacaataagacaatggaatacaccataggtgcgaagggacccagatagagggaaagacgagtagagcaaaatgtcacacacagagggaactataacaagacatggaaacggtggagacagtaggaacgataaacgacactaaagacaatacatgactagcgcctggagacgaagaggaatgcacaggcgaccaatacaagtctcaccccaagagacaaagaaaaaacaaaggagaacaaccaaaccccacaccatgttagggaggaacaaaggacaccacaagagtgaacatcgcaaacaatacagaataacacttagacacaagatggacaccatcaacgaggaaccccaagcaaaatcagacaacaacaatcaaaacaattggcccaagtaactaacaaagaaagacacaaactatgataacacggacctcaaagtgggaacagcgataagagaccaatgggaagacagtgagaacagacaaactaggacatgagaaccaaagcacaccaaaacagcagaaagtaaggattagcacaacagtgtaacaattacgtacggaaaacacacgagg

SEQ ID NO: 666443 - DNA, 121 bp, Homo sapiens
ctattctcacaggagtacgtagcctttctctctccaatccacagatctgggggcctcataaaacagatgttccggaaaactgggaggcttatctcactgagtgagcagaatctggtagact

SEQ ID NO: 666444 - DNA, 110 bp, Homo sapiens
ctgcggtgcctagaggactctgatagctgtctcatatgaagaccatgtatgctcatacgagacataacgactgagaggacgtaggatacgcagttaaacagtactggagg

SEQ ID NO: 666445 - DNA, 166 bp, Homo sapiens
acctctaataaatttctgtccttcagatggaactctttaacttctcgtacaagtcatatacctatataataaagctactgatattcctttggaggcttttctttaagataatagtttacctgtagtagtacttggaatctagggttattaactaataatgggcttg

SEQ ID NO: 666446 - DNA, 941 bp, Homo sapiens
  misc_feature (589)..(589): n is a, c, g, or t
ggcggtggctcccgcctgtaatcccagcactttgggaggccgaggtgggtggatcacaaggtcaggagatcgagaccatcctggctaacacggtgaaaccccgtctctactaaaaaatacaaaaaaattagccaggcatggtggcgggcgcctgtagtcccggatactcgggaggctgaggcaggagagtgacgtgagcccaggaggtggagcttgcagtgagccaggatcgcaccactgcactccagcctgggtgacagggtgagactctgtctcaaaaaaaaaaaaaaaattagaagtttgtggttaaatccccaggtattggggatttccagctatcttccggatttcaattcctagttaaattccatgaggcctgaaagcagaccctatttgactccttaatatcggcgacggtgtgtttatgggcccagattgtgatccggctggggaatgccccaggtgatttggacgacagacttcgtacctccggctgcctgctgcctggttgacatattcctggagatttgccactttctttcccgttgatctgccacgtgtgcgtggactccacctggtgtcactaacnggtttctgccttgctgacctgtgtggccccattcctggtacgagggaagttggttaaaggtctcccacctattatggttaggattccccccagggtccttctcttgacggttaatccaggctgtttgtcctcctttaccattatttttgggagtgccgcccgggctggttacagggtggcaattccccttttcgcgcaattcatgttgcgggctacgcccgggttgtaccgcgggctcgaattgtcccgtgtttaatcccccccaaggtggtttcgcccattacacggggcatgtgcccctttgtgccctgggggcatacacagcggtgtgtctcttgtgtccacccggttt

SEQ ID NO: 666447 - DNA, 497 bp, Homo sapiens
acaactacattcacaaatggcctgtcttgtgttttgtcaccgttttgagggatgatgttttgtggcacgtgtgtgatcacagcctgatggttctggtcgtgggttggttcttctgggccagctttcacagacttgcgcagctgacctacagtgctgccccataatactgtttcactttggtgaagatcagcccaccttacaccccgagtgcaggtgtgaaccacggtaagtgtgcacagtccttagggaaaacagggacgcagaggcctgcctcctctcttttccatgccaaaatgaaatgaccaagaaacaaaacatttaaaaagttgtttctaaatgctgagacctaaccattgcttatatactgttgtctgttgaaacagtttgttacaatttcattctgttgaactaggtgagactttaagaaatgttgaaattatgttaatttcctattattatttaatataaagatatttaaaatgtctaaaaaaaaaaaa

SEQ ID NO: 666448 - DNA, 714 bp, Homo sapiens
gactagttctagatcgcgagcggccgcccttttttttccaaaaaaaaaaaaaaaaaaaaaaaaaaaaaaaaaaaaaaaaaaaaaaaaggggggggaaaaaaaaaattataatccacgaagggggccaaatttaaaacccacatttttttttgtaaaagggggcccattaggggttttttttaagggggggggttaacaactgttgagtgaggggggaaaaagtgcttcgatgtggagatttcttgtgtgcgaaagaaccacttatcttgcgctggggggtgggacatttaagtgttggggaccatattctcctctatggagcatttttaatagtccttctctgagggttgaacattattaaaacatctgcagcagggtgatatatcgtgggttgcgaacatcattggtgcgcgaaattatgtgccctgccgcgatcgatgaaaaaagatcttgtgtgagcaacattggagtggatattgatgacttcttctatggacaacatttatctattcaccgccgcgcgggccctcgttgtcaaaaatacgcccactacgtctaatgaacgacgacccgacttcagttccgtgatgctcgtaccaacacagctcacaatgcgtccgaccgctcccaccgacctgctacaccacgacctctaccatcacttaactcacatagtcatcattcgaacgacaccagcgcctactacacaccctc

SEQ ID NO: 666449 - DNA, 106 bp, Homo sapiens
catgttaacatgagtatgacatgagaatagcttgaactggaaggcagaggttccagtgagccgagattgtgtcactgcattccaggttcaagctattctcatgtca

SEQ ID NO: 666450 - DNA, 312 bp, Homo sapiens
  misc_feature (15)..(15): n is a, c, g, or t
  misc_feature (61)..(61): n is a, c, g, or t
acaagaaataccttnaatttaggtaaataaagctcaaggaggtgggctgtcatttatcgtntcagtccttctgccccctgctcagtgtcgctccagggccttgacaagcagcctcattcaagcggcccaccatgccctagggtcgtcaacaagtccagcagcaatcatgggccttctcttatatctgatccaccagcagcctgagccaggtcaggctcgcttggccgcagctgattcagcttcttgatgagcgcgctgcctgggttgatctccagcgtggctgcaggagctgtgccgctcctcctggtcttg

SEQ ID NO: 666451 - DNA, 187 bp, Homo sapiens
ctccggaacacctgccttcaccacataaatgcgcgagtccgcgtccagctgtgtttcgactatggcgagcatcttgccgaccttgcgggtgaagaacacagctgacagcacaacgccagtcaacacgccctttgcaaggtcatgggtgcggagcagttccacttaggccggagcagttccacttagg

SEQ ID NO: 666452 - DNA, 606 bp, Homo sapiens
ggagcgcctagggcaacatgatcagcgagaacgcctggatgacctctgcacccgcctgcagatgaccagtaccaaagagcaggtggatgaagtgactgacctcctggtcagcttcacctccctcagtctgcagatgcagagcatggagaagaggtagcaagatgaggctcccatgacttcctgccacttgcacccacaccaagccccactgcatgtctcagtaccaagaaaaagcccaacatctgggactaggagactgcactatgtctggtgaggaccttgccctcacccgcagaatgcagtggggcagaggatgctcatctctcacacggaactcagagaccacagtcccagaccacagtatccagcgatctctgtgtgacaagggaccacagagtcccagcttcttcacagttctcgcagaaacagaccagacctctgcagctgcacttcagatccgcagaactgcgctatctcagcagacctcacattgccaccatggacttcattggcagcgctccaggcctcagacccttctctgtgttccgtccatggccatgggcttgttgcagtacagcagagtgtgggcattaggcgggcacacca

SEQ ID NO: 666453 - DNA, 355 bp, Homo sapiens
gtgtcatagacatcaggtatatcttttaacttacagtattgtgtgaaatttacctgtttttcttgtctaacctgagcactcctccttgtttgaagtttctttatccaaaaccaaagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggacacgaatgttca

SEQ ID NO: 666454 - DNA, 119 bp, Homo sapiens
gccgcgcgccacggaatgcaatgctgaggcgtccttcaggtaatgaacttcagctgcagtgtgcacggggcaggaagactggcagctgtcacaactggcacagtccagtgagtatgtgc

SEQ ID NO: 666455 - DNA, 495 bp, Homo sapiens
catatcagtgtagattagattgctaagggttgcgagggaaggtgctttgactctagagggtcagaaaatgtaccttgagaatagaaagtaggtgagattctagctcagtcccaaccactgctgcattgcactttgcatctctacattgtgcatgtttgctcctttggtgcttctatgctttattcagacagtccaaaaaatatttcttgagcgtagactgtgtgccaggcagtgttgtagtgcacgtggaggatgtcggtactgaggtgggatcgattgaacgttctgtcccaagggaattgacattgcaaatgggagggcgtaagggggggaaggcagaagctggaaggtgggatgcacagggtacgcgaaaatggaggggtgaagatggtggaaaaggtgccatgagggggaatatgatgtgatatgtgacggtgtgtcatcccgataaggtcggagtgaggaggagcaggccggtagtgtgatcaggtaaga

SEQ ID NO: 666456 - DNA, 2275 bp, Homo sapiens
gcccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacggggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaaggtaggtttcctttgtaagcatctgcagtaaccaatggcttattatggctgtgtggccaccttagttgggccagaggggaagtagcttgagtagcctgctcacatcagacccaggttgcgtcctgtgatggtgggacactgtagcacttgaccacagtaagaccttccatttgaagagagccttttagcttgtgaaccactttcagtagattgacttcttgcatcttcttttgtcattttataaatgagaaaggtaaggctcaatcaaggttacagaacctgggttttctgtctccaagttcaagttcagtgctgtttccacattccatgtgctgctgtcctggcatgtgtctgttgtgggatgctgtccattgtaaacaatgtgggttacaagagctctcacctggagctttcattatttccactgtgcatggagaggtggctgatcccagggctcacaagtcccccacgcttcagtcaagtcattctgaaagtctcacttcccatatgttttctgagcatgaccaaaggggtgtggggaggaagtggccaggctgagctggggccagcagtcaaatgagctcaggctcatgggtcctgccctctaggtgctccccaggcctccgtaggcttttggcactaga

SEQ ID NO: 666457 - DNA, 206 bp, Homo sapiens
  misc_feature (206)..(206): n is a, c, g, or t
ccacctgacagagaggtaagctgttatcatagaaacaacttcataaagctccaaaatcagacaggtgtgggactgaattcaggtccagccagccactgggcaggtgcccatgaccaagcttgcctcttccgagcctcagcttgctcagcctacctcttggggctgttgtgagggtacagtgaggtaatgggcgcacctggcacagn

SEQ ID NO: 666458 - DNA, 1247 bp, Homo sapiens
  misc_feature (1234)..(1234): n is a, c, g, or t
aacagcaccttacagccaagccattcaaaaatgcagaaacaggctggaggcctgggctcacttgcccaaggccagtctcttagattgtgcagaatttctctttgatatcatcaaggtgtaatgctccatgattcacttcttttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccangcactgtgctcag

SEQ ID NO: 666459 - DNA, 528 bp, Homo sapiens
gtgtgcgggtggctcatgagttaaggagttcaagatcagcctagcgaacatggtgaaacctcgtctctactcaaaatacaaaaattagctgggtgtggtggcggtcacctgtaatcccagctacttgggaggctgaggcaggagaatggcttgaacccgggaggcggaggttgtggtgagctaagatcgcgccactgtactccatcctgcatctcaaaaaaaaaacaaaaacaaaaacaaaaacaaaaagcaaaacaaaacaaaacaaaaaaacaaagaaagaaagaaaagaggaaaatttcaaataacagttgggagcccctacatcaagaaactagaagacgaggagcaaaataaacccaaggcaaacagaagaaaggaaataaaggtaacagaaatcaatgaaattaaaaacagaaaacaatagagaaaatcagtgaaacaaaaagctagttcttggaaaagttcaataaaatagacggttatctggcaggactaacaaatagaaaaaaagcttatccaccatga

SEQ ID NO: 666460 - DNA, 1795 bp, Homo sapiens
  misc_feature (1794)..(1794): n is a, c, g, or t
cctgcgtcgtatgtggtatacctggagtgccgcgaggccggacacgaggtctggaacagtgtacacctcccttagcagcggaactactcccaccctggaggctccgaagaactaacgcagtgctgtctgtccttgacgagcctgagcgaggggtgtatccatctagtgcttcacggggcccactccacagtcgtcgaattcaccagaaccagacttactcgagtgagtatagaatgcgccgcgtgggcgatcatagcccgaagtgacgcagagacgactgcgcttcctatccgttcctggagtcacctgtcgctcaaaatcaacgagacatgctccgtaactgtgcatcccctagtactgcatcctcatgttcactagacgtgcttaggcagtccatctgagtaactgacgtataccaagaagcgggaaggcttctaaccaaggagccattcatttcgaaccacccggcaccgaggcaaagagagtggaggaccccccaaaatttcagtatcacactcagacacacctgtgaatgggaggaatcggaaccgagtgcaaaactcgggaagagaatattcactaatcccgtgtagtcatcctaccggagtgcttccggggtcaagttggctgcatcaccaacttaattatgaaaatacattcacggtaatcatccccgggtgagcaataccataaggacaatcacaattattggcgacctaacaagtataggttagtagccatctctagaggcgataagttagactattgcgagactggggcgtttaccaatacgcggggtggaaattctgcttgttgaaagcacacaaggcctactactttggtttacggcaggcatcaggtgaaccgttattgacccgattcggaaatcaccatgcgcgaagggccaagtaaatttcttcagacccgttcgcgcgccgtttagcccattttaaatagttccgacttcacggtctcaaggtaacaccgcgcaccagggaaatcgcctccacacggaagttaacttattacagccatgtgactggttccgaaccaaggaaggctcaccacacggagacaaggaagacacatagtggcagcacactgggtgtcacatggcatgggcgagggagagccatcatggggaaggccaccacgaaaagggacactacaaggaacgtcataacacgtaataaaaccagcccggaaacgacacagtgagcgccggagaaacacggagtgacagatatggtgggcaataacagcccccaacaataactaccgagacacaggcggcaagaacacacatcacacggggcacatacacacaggaacacaagacgtggtataccctaacaggtaatggtactaacaccacgaagcattacacaaatatagatgggtcgccaagagtaggacatcaagaaacacgacaatgattggcacaggccacacaaggagggggggagctaccacacgactaacgatggttgattacccgcaccataataacccaagagagggacggatgaacacgcgatgcatgagacaaacagccacaagcaacacagaagctaccacactacgacgtcaagaagcgacaacaccaaagggagaaaaacaataaagaagagagaccagccgcaacaaaccagtacaagaagaacaaaagagaagcaacagccccaaggcatccaagcgaaaaagatcacacgcgaatcatacgacgactaagagacagaccacaagcgaaggacgccaccacaacgactaagctaagcagatagcaagcagaana

SEQ ID NO: 666461 - DNA, 684 bp, Homo sapiens
cattgtagacagctgagagcctatcagaagtccgagctttatctggaatacacggggtaatacatatggcacaaggcaaaaatcatatgcaagagatatgctaacatctcttcattatttggataaccgcttcgtgcagcctcgtctagagagcttggtatctaaaagtcgtccggcataacgcagcaatataagagagcgcatgctagaaaagttgattctaatgtagagctcattcatcttgaagaatcgctgaaagactgttgcctgccagtgcttgtggacggcatcgctactgtaaatattgcagctgcatctatcaggagagtcgtataacaccaggaccaaatggccaaaagttaggaatcatactcttgcatgtcacatgataaacaggtgtacactgtgtggtcagaatgtgtgtgccaggccgctaccaagaatttgatcatacaactgacaagcatgtttacattctccactataccaggaatgtagcaccattgctatgcacagagagaccgttgatgatgaacaagttcttagacaacagtggaaagaatcttcaggcggtccaatagaccatggctggcattaagggagaaactatggtcaacttgaagaatatctcaattttgcggattactttcaaagaagagaagtcgagttgtagacacatttcca

SEQ ID NO: 666462 - DNA, 83 bp, Homo sapiens
gtgaaaacttcacagttactttaatctgcacgggttccggggaactcctctgcccctccccgctccccttctgtcgtcttctc

SEQ ID NO: 666463 - DNA, 861 bp, Homo sapiens
gggcgtgagttgtggcgagctaggcccgcgtgcggctggagacctacccgacgctgagcccccgtgagcctcctgccctggcccggtgctgcggcctctgcggcggtgggagtagtgggtgggccccggggcgcggggatggggggcaggcgggcacctgctgcgtcggcagcgggatgcctgctactgtattaaacttatggctgaaccgggcgtcggcggggggtcgaccggagctcgggataccgctcttctgaagtccgcagaagacttaggctgatggtcacatatggatgatgtctaaatgctgaacaacttcagtaaactcgtttagctgctggagtcaacggaggatcctgttgaatcatggataagagttgagctactttgggtatcaatgcagccttgtgagttaaccaagcgatatccgtgaatgggtggtattccaaggggtgcgggggggtctcaagcggttccatcccagagtatgaacgagagacgcttttgggtgcactagataagctgagttgtgattgtcgaaaatcgtgttccacgataaagggggggagttgggaagactcgttttggactttgtctgaaaatccagcatgacgagaagggtgctccggtgcccaaagtgggattcatccatttcgtttccctttatgacaggcaccgtagcccaaaggggatcttcttcgagtaacttaaggccatgcggatttaggaaggctcaaaaagaaggcattgtgtggaggctatttcccgagagtccggttccggtacgggagaaggccgacaaaaaggctgtggccccgagggggggggaagggcgcacccccggggttccccaacggcagg

SEQ ID NO: 666464 - DNA, 266 bp, Homo sapiens
ttactggaaatgaatacttaaatctagccgcataccgattaaaatccaatttggtggccgggtgccgtggctcacacttgtaatcccagcacgttgggagcccgaggcaggaagatcacctgaggtcaggagttcaagaccagcctggctaacatggcgaaaccctgtttctactaaaaatacaaaaattagccggatgcagtggcacgtgcctatagtcccagctactcgggaggctgaggcgggagagtcacttgaacccagga

SEQ ID NO: 666465 - DNA, 553 bp, Homo sapiens
gccaggcaggttgagcagtggtcttaacctagttgatggcatgatctagttaatatagtgctaaaactactgtattgcgataatatgacaagaagcctgatgacggagaccacgagataactggaaattcccaaatagcgcttaagaaaaaatactacgagacttgagaattaggcaacgtaacttactaagtgtaagatgacaaaatttagactttcgggatatactggcgtaaattttcccgtccgcctaaatgaggacaaaaattcacagctacgttatattaagcaaatattaacggtgcctattatttgctgagtgctgaaataagataaaaaacttaaaagttaaaaaaagttgtttagaattttactgtcacattgacttatctgggacatcgccaaaattaatcctcacatgagatttggctaagtttattaatcacaatctgttaatctcacaaaaactaaagctgttaagcccagtctaaacccattctgcagggtaagaaattcatctgtaaagcaaactaattgataggaagtaagataag

SEQ ID NO: 666466 - DNA, 155 bp, Homo sapiens
gaggatcccccgtgtagccttaaccctacagctgaaagccaggctgactcggtggcttgtgctgtatcctagattttgggagtctgaggtgatcgcttgagccaggagttcaagaccagcctaggtgacattgtgacaccccaactttacaaaaa

SEQ ID NO: 666467 - DNA, 399 bp, Homo sapiens
cttatgaggatctcgtgaactgcttcggattgtgcaggagcagtgctgcacagccagctggaggagctgcactgtgcacgggcatcagctggcaacgagcaggaccgtgtgccacgccccagggtgacaacggcagcctggaggccacatttgtgaagaggtgctgccattgctgtctgctggggagggcggcccaggcccagggccagagcttgcgagtacaggctcatggttgggtaccagtgtggacaggtcttccggggcatgctgtgtcaaagagccaggagaccggagatttggattgtcgggggcctccaagaaacggataagatcattgaggttgaggcggaacaagaggacccatatcttgaatgatcgctggcgaggaggggggccctg

SEQ ID NO: 666468 - DNA, 1614 bp, Homo sapiens
agccaaatgtctttaacaggttcctctactactcaacaattcccaagtcttcgtcatttgcaacatggcatttcaccagtcctggctcaaacaatctcagcatgttcaatgcacatgaggcattccatcctggctcatcttcctcatgtccagctgtcaatctgtcacatgctctcttgttcctgcaagttctcttcgcctcacgccatggccagagtggcacacaccaacacaattcaccagaccatcatgctgcgacttcccagcttagcaaccatcgttgacttgtccacagctcatgttcatctggatcctaacagaaaccaagtctttgccaagccagatccatcaattattaggttcatttcatagctaactcccagctccaggctcatcctacctctgaggcaacactcgcacagcaacttctatatacaggtctaccccacagcagcgcccatccttctcacacagaccacagattctctcccggtcggcttcttacccttaaccgtccacctcgggcaaccgcacgctcacatggaacagcaagagccattacacacgcccttctagacaacaccctcacttcgggcccgcttaatccacaccccactcaaaaccaaacctttccaccacccctcgccaccttacgaccctccccccacatcactacctcactccctaccgcatccagcgcgccacccactcacacctcccacctcacaccaccggacggcgaggcgatggcgaaccaggagaagaagccccacacaattaacgcaaccagagccgcacacacattcgaaccccacacaccactcggccaccgcgcagcagcaaccaaaacgggactaggcaaccacacagacaacgcgacaccgactccacgtgccaaagcaacgccacagaacgcacacctcacccagaccccctcacactggccgacacgccccaacgcacaacccacaacataccatcccacacaccgcgacaacccacacccacatcgacccaaacacccacgcataccccgacgccgacgagccaggtacaacaggcaccacacaacaagagcaacaacgacacacagctcgaacccgccacaccaacacgggccacgacccacccaccccacgcagcgcgacgcagcacaccacacacaggaacacaacaacgacagacaccaccacacacgtgcccacagtgaaacaggcgcacagacccacggaccactccgcagcgcccacgccgtgtgccacaacgccccagactacttctccaccgagagaccaggccatgcagcacatccctcttgacacgccacttgtgccgcacctcacacaccgcaggaacgccgctgcgccacacacccttatcgtatgcacacaccataccgttagacacggcacgcggctcccggccccccagcgcgtcgacccacgccgctgacggagctcacgcagacacccgcggacgactaccgacccgcgtagcgcaccagtcaccagacgctcccacgagaaccagcactgagcgcccgccgagatcgtcgccctcgcccgccacacacccagaccgcacacccaccacgacaccccgcgacacaactag

SEQ ID NO: 666469 - DNA, 513 bp, Homo sapiens
tcagaattttaagactgattaaaggttttaggtgtttatctcatactttgcatactgagaataatatgtatagtatttttccagtatgatttacaattttataaatgtcagtatacatatgtatatataaattattctcaactccatttttttttaaataaaataagtacatgtttgtgtgctaaattgctcatttggcagtgatagattgaaaaacatttataaatttaaaaataaagcactataagatatgaggaatgaatagcttctatgtgaatttctatgtaattaatatcaatatttagaataaaagtgtatttgaggataagatatttgtttactaaaatgttttatttactaagagtagaggtgaattatgcatctttctaaggaaaagttcttttaatttctgtgtctatgaaaaagaattcataattcataattcttaattgccctcttttgatccatataattctttaaataaacgaaacatttacttttcaaaaaaaaaaa

SEQ ID NO: 666470 - DNA, 124 bp, Homo sapiens
gcgggcgatgagtgactaggatatggcgggcaggatagttcagcacggtttctactttcctgtagtcgtctgtagatgttagatattagtacagtttctgttgtgagtgttagtgaaaagggcc

SEQ ID NO: 666471 - DNA, 119 bp, Homo sapiens
aacggctttgggtcttactggatttgctgtgagtggcaatatgctgtgggagtgtgatatcccacactgtagacattaatgtacttgttggacattttcataaatttttgaacagttca

SEQ ID NO: 666472 - DNA, 233 bp, Homo sapiens
ttgcagtgtttatgcccgccttctttcacgggcaggttcaatttcactggtttaaaagtaagagacaggctgaacccttcgtggagccatttcattacaggtcccttaatttaaggaacaagttgatttatgctacctttttgcacggtttagggtaccgcggccgttaaacatgtgttcactgggccaggcggtgcctcttaatatccggggatgtccagaaggggagtttt

SEQ ID NO: 666473 - DNA, 295 bp, Homo sapiens
taccgagtgatgatgtaggcaagatggcaccactgcactccagcctgggtgacagagtgctatgagtcaccacacctggtatgagccaccgtgcctggcccacaatgacttttacacatgttgttaaatcatcttacagattttataatttgggggaagaaaagttttactaaacttgtcttttaactggaaactctacaagaaccagaatctttgctttgttcacttatgtatccattcctaggcctagaaaaatgtctgacacatagtggcaattattcattgaataaatgga

SEQ ID NO: 666474 - DNA, 180 bp, Homo sapiens
tggggtggaaaaaatgggggggggccccagtgaaatttaaagtaaaacccagctggccccaggggtcccgccggctgtaaacccgtttaatcaaagggccctttttttttttgttcaaatgattttaattattggaatgccctatttttttaatatgcaaataaaaagtttaaaaagtta

SEQ ID NO: 666475 - DNA, 200 bp, Homo sapiens
ttacaaaagtttattcttaaatgtacaacagcttcaagacaacacttaattccagctatacgaggcaaaagatgttatggcagggaatagagaggcttaaatacagatgaaataaagggccaccatctcctcaggcacaaggaacagcttactttttgccagaattcttaattccacctggggccaagggccccttcccc

SEQ ID NO: 666476 - DNA, 409 bp, Homo sapiens
  misc_feature (14)..(14): n is a, c, g, or t
ggcctggcaggtgngaagcccaacggtgcaaagttcagcaaaggtgcagcctttgtgtccaagcaggagggcagcgaggtagttaaaaaacccaggggctacctgtatcaatgggtgggagccccagtcccctacccggatcccctggagcccaggagggaggtgtgtgagctcaatccggactgtgacgagttgggtgaccacatcgggttttaggaggcctattgggggttttacggcccggtttagggggttgttttgctgggctggccggcaaccccagttttggtcctttccaggcaccctttttttcttttccccttgcccttgccctgacctcccagccctatggatgtggggtccccattatcccaggtggtcccaaataaactccaaaaaaggaatttta

SEQ ID NO: 666477 - DNA, 572 bp, Homo sapiens
  misc_feature (31)..(31): n is a, c, g, or t
  misc_feature (33)..(33): n is a, c, g, or t
  misc_feature (35)..(35): n is a, c, g, or t
  misc_feature (135)..(135): n is a, c, g, or t
  misc_feature (155)..(155): n is a, c, g, or t
  misc_feature (191)..(191): n is a, c, g, or t
  misc_feature (218)..(218): n is a, c, g, or t
  misc_feature (257)..(257): n is a, c, g, or t
  misc_feature (266)..(266): n is a, c, g, or t
  misc_feature (310)..(310): n is a, c, g, or t
  misc_feature (351)..(351): n is a, c, g, or t
  misc_feature (354)..(354): n is a, c, g, or t
  misc_feature (501)..(501): n is a, c, g, or t
  misc_feature (538)..(538): n is a, c, g, or t
  misc_feature (552)..(552): n is a, c, g, or t
  misc_feature (563)..(563): n is a, c, g, or t
ggagcgaaggtaggaggcagggttgctcaantngnccaccctcccaaccccaagagcccagccccatggtccccgccgccggcgcatgctgtgggtcctgctgctgaatctgggtccccgggcggcggggccaanggcctgacccagactccgancgaaatgcagcgggtcagtttactcagtcaggtccncatgacccgcagctaccggagcaccgncctgacttggtcttccccggaagacaaggataatcctanaggacgatnaatgatgccatggcccgacgccgaccgcctggctggaccaagcngctgccgagctcttggccgccacggtgtccaccggctttangcnggtcccgccattaaacgaggaaggatggggtcttcagaagagggggttgtgattaatgccggaaaggatagcaccagcagagagcttcccagtgcgactcccaatacagcggggagttccagcacgaggtttatagccaatagtcangagcctgaaatcaggcttgacttcaagcctgccgggntcccccggaggtcntaatgaggacntgccaggct

SEQ ID NO: 666478 - DNA, 802 bp, Homo sapiens
  misc_feature (340)..(340): n is a, c, g, or t
  misc_feature (400)..(400): n is a, c, g, or t
  misc_feature (481)..(481): n is a, c, g, or t
  misc_feature (512)..(512): n is a, c, g, or t
  misc_feature (591)..(591): n is a, c, g, or t
  misc_feature (678)..(678): n is a, c, g, or t
  misc_feature (701)..(701): n is a, c, g, or t
  misc_feature (703)..(703): n is a, c, g, or t
agcggcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattaattccctgtataaagggtatgatgtgattgctcaatgctcagtcaggtactggcaaggacagccacatttgctatttccatcctgcaacagttggagattgagttcanaggagacccaagcactagtattgtgcccccaccagagaactggctcgaacagatccaaanggtaattctggcacttggagactatatgggagccacttgtcatgcctgcattggtggaacaaatgttcgaaatgaaatgcnaaaactgcaggctgaagcaccacatattgtngttggtacacccgggaggagtgtttgatatgttaaaacagacgatacctttctccaaaatgggtccaaatgttgtgttngatgaagcagatgaactgtttgacccggggtttaaggtcacatctatgagatttccaaaaagtaaacacaagtattcaggtgtgtgnttctgccaaatgcactgtgtgtngnagtgcaccaaacttctgtagatcatcgatttggtgagagaaatgcctgaggacaacagtattagtgagcaggccggggggacactggagtaaactgctc

SEQ ID NO: 666479 - DNA, 108 bp, Homo sapiens
agctctacaagcgtcccttatatgtacaggtaaacacttgcatggaaaggatctttctccattactacagaagtgagcttgtagcacattttaaaatcacagttataa

SEQ ID NO: 666480 - DNA, 198 bp, Homo sapiens
gaggatccccagagaaattctgaactttcactcagctttcagttttgccttaccaaagagatcacatcttagaaatgcgcaaatggagatggatgatcaaacccaaccacgtctcacactccaccgtcacttgcaggaccaagctcaccgtaaggcaatcagcgctgcatcgttgctcagcagaaggcacaccaggca

SEQ ID NO: 666481 - DNA, 202 bp, Homo sapiens
tcggcgacatggctactgtaggaccagaccgacatgtgccggtagatcttgtgtgtggactgttccaccaacaacccatcgcatgctaagctgcgcagggagcttgacgaatcccttcaagtagctgagaggctgaccaggaaatacaacgagctgctaacgtcctaccagagactgatgctcaacacctcctgcttgctgg

SEQ ID NO: 666482 - DNA, 1198 bp, Homo sapiens
tacaacagatcttttaatgtgaacttaatttttacacatataaagaatgtggtgtggtttgtgggaaaacatcttattctctttgtgaaacaatttccactaaattttcaagtggttttaaataacgtggacgagaaaataagtccgtggtggtcgtggtccacaattataaggggtcccagtgaattaccattatacccccttctccaggccccaccaaagctcaatttgtggagtgggtttcagacagaaaattgagacgagcccaaaattttaaaccagaattctcaatagcacttcttcacaaaggttgtttccagagaaacccccttattgtgtttctcattcacttgtggggtttcttaaacacaccaaagagatttccaatgtgagcacgaaccgtgagagtgactcagacaatgggtgttcacaacaatattttgcggtgccacaaagcgtggcctttacagtggggtctcctatagcccactctctaaagaggggggggtaaaaacactttaaaggaaaaaccagcggcacctgtggcccacatcttatgaggtgtgaacaaacacaacaacctgtcaccgcttctttcagaccagcggtacacttctccactaaacaattttggggaaactatttccctacaacccaccacacctgtgggggatgttttataatccccactatatctcgcccttaaaagcgcttttcgggtgcacacaaacagacgacacaacccggtgtttgtggtgcaaccaccacctgttgtgaagacgaagcacctgtcgcactagtggcaagacctcgcaccccacagaaggtcgttatcatcatgtgcgggcaaaaaattcccccccagggcgtttataatcagagaaaaacaatgcgccttgtagccccgccggggggaccatttattgtgccccccaaagagggtgtaaagagattctccccacacagttagtatgggggaacttccccacatgtgtgtaaaaccaaacactcgggggtcaaacacccaccccgtgtggtcagcgggggtttctcccacacgctctttacgcttcaccacgggcgcgcctctcatgcaatgcctgtgagaaaaattgtgcgcaggcgtccctcaaaacaattggcgacgattattcttctcgacacacaacagactctttgtcagaccccgcgcttcact

SEQ ID NO: 666483 - DNA, 397 bp, Homo sapiens
gcgtcgacaaatgtttagctttgaggattttttttttattgagatttacacatattctcacttataagtgggagctaaataatgagaatatatggacgcatagagggaaacaacaacacactgaggcctcttggaggatggagggtgggaggagggagagaagcaggaaatgtgactaatggacactgggcttaatacctggctgatgaaataatctacacaaccaacccccatgacacatgtttacctgtgtaacaaacctgcacatcctgcacatgtacccccaaacgtaaaagttaaaaaataaaataaattgaggtataattcacacgccataaaattcaccctttggaaacggtatacaactcagtgacttttagtatattcacagaattgt

SEQ ID NO: 666484 - DNA, 208 bp, Homo sapiens
ttgctgtagttgatctaaggatccccgcgctagcggcattaatgaacggagggtcttggcggctccttctccctgtgcactggtgctttgcttgtggtggctggagctggaaagcaactccaaacatgctctacttcagggagaaggggtatggggcctgaaaaggcctggtgtgcactgccccaccgttcacttaatgccgctagcg

SEQ ID NO: 666485 - DNA, 743 bp, Homo sapiens
ggcggagcgacgagtctccagatggccgatgtctggtatctaagaagggcgcagtgaagcggcatgcatggcggtctttcgaggaagcatgaagcatgcggtggaagatgaagtctagcacgggagacctcgaccagacggactagccttagtcgtgcgacagtacgcaggtggcccagttagcagccaagggactggacgacgcctcagggaaccctcaagccccaaccacaagaaacccggccgacctgagcgagaaggccgccgcagagacagcgcgcggcgggccgagcaacacgcccacgcacacccctggaccgtgggcgcgcacgacttcccacacacccaaggctctcagggaccgtgcaccacaccatgaaagcgcgccacgcagagatgattcaagcctagtctagtcgccctagcaccgacagcgggctggtcccgacaattcgaaagcggataccttgttgaatagcaacccagatcggcttggccaacggccaacacaaggaccttacggtggcccgatttgtcatgggcggacggcaaattccttatggggcaaggagcggaactatatgaccaaagctcgcacgggtaaccactagggcacctattggaacgcatatgtagactcgccttgcgcgtcagtacgcaggtgacaccaaatgtaccaaagagcaaccttacccgacgggccagcgcacaacacaaaacgcagagcacgttgccacggagtc

SEQ ID NO: 666486 - DNA, 1785 bp, Homo sapiens
  misc_feature (1508)..(1508): n is a, c, g, or t
  misc_feature (1753)..(1754): n is a, c, g, or t
cctcctcgtcgggtggtgggtatgttggtgggggtcggcaccaacggatggctgttggggtggctgcccgctgcgaccaaggagtggtttgtcctgcagaagcgggacccacgatccggtgggtgggggcaaactatgatcatccctgccgggcgtgatgaccgacatgttctgcagcctctggggggcgagacacaaaagaggggggggccccgccgccgtggtgatgagtgttcggtctctgtggaggtggtggagtggggcggcttgctctcccccgaggggtggagcacgacggtggttgtttgtttgtgtgtacatcacgtgggtgggtgtttcccccgcaacaggatggttggtggtgggcggtgttgatgggtggccacaccgcccgcacaacacacacacaacaaggtgagtggttggagcaatagtgggtggggggccgcctcccctctccccccccccggcggggggagaagagtatatacaccgcagggcgagtggtttgtgtatgcgaccaccgctgttgtgttgttagtctccccccgccgggtggtagagacaacgctggttgggggttctccccctcccagcacagttagaggtcgtgctctgtcaactgttgtgtgcctccccgcttttggtcagcacgacacactctcctcgtcttctcctcccagctcggggctgccggcgcacactccacaacaccgctctgttttgtggtggtgggtgatgttgtggggcgtcccacccactgctgcggtgcggttgtctataagagcagtggtgtcgcgacaacactcgacacacacgggctaccactacccacgctcctcacaacacccggcggtgttgggacgacccatacgctgctgtgaggagagacgacacacactgccagcacaccagcaggggctaacacacagcagagagagcacgctgtgtggtcgacacacactgctgctgagacgacgcgacacaacacacaccacaccaccacccccgctgctgtgctgtgtagagaacgctgctgctgctgctgtgtgtctctctcctgctctgctgggacacaccacacacagcatggtgtggtcacgctgcggcgcagtgtgtagtagtgcacaccaacgcagcgcggtgtggtcttctctgctctgtgtgttctctcgctgcgtgagagcgctgctgcgcggtgaggagagagggaggtgagcgagagagagagagcgcgcgctgtgtgtctcgcgacgagagagccaccgcacgacagaatatatagtataggtccacacacctctcagatgagagagagatatatatagtagagagagagagagaggtggtggttgtggagatatctctctttatgaagagagagagagagggtgagagagagagaatagagagagagagagagataatatcaaaaaaagaccacctctccctctctctagagtgccacacgccgcccacgcctgtctcatcgcgtctccccaccatanttatctccacgtccccacgctgtgacgtcgcacacaccgctcttatatatactatctttgtgggtgagagaaggggtgtgtccaccacgggggaacaaattttttcccccgtggccacccgaataatttttccccccacaatgtccccagagaaagagctctcgcttcgcacacaccccaacaaaaaataataaaataaataaaaaaaagggaaaaaaatacacgaaggcatataagctcggcgnncgagatagagtatatcaccatgtggacggct

SEQ ID NO: 666487 - DNA, 668 bp, Homo sapiens
tggtgctcgcatgctggtttggaatcacttgctagtgagtcttgtctctctgccacccagtgacatcatggcagctcacctgtgtaaatgctgatgcactgtgcctcctgagagaatgctgctctgtcagtgcccctgccatggctccagtttggcctgactgagacttgcctgggtagcccataagactctgacttcctcagccacctcacccatttcccacctcccatgtgttccttgatggatgccgtgtggatgaagtgaactgagcatctactccctacatatgagaagcagtgtgtgaccacctcatcaatgaagtgccacaatgtgccatgatgtgatgctcctgtgagctacttgtgttgtgcatgtcactgactttgtgacatgcaatcaagcatgcaatgtgtacttatcctgtgctctctcacttgcttgtcttgagaagccatgaagataaatgtgctttgctcatacatgtgatgcccactttcatcaacttctctgtctgctcaacatgtcagagttgcctcggtcttggcattggtaacccttctctgaagcttgttgggaagcctgtatgctctgtgtcatccccaatgggctccatggagctgcagtctggtgtagccgtagtgccgctggcgcatccgtgagctcagtag

SEQ ID NO: 666488 - DNA, 498 bp, Homo sapiens
atggccacctctaggtcttcaagaccaaggaacacctacactccaggtgtctccttgccagatgtttcacctgcattggtaaaaggcagaatcctcggcaggggtcggtggctcacgcttgcaatgccagcactttgagacgctgaggcgggtggatcacgaggtcaggaattcaagaccagcctggccaagatggtggaaccccgtctctactaacagcacaaaaattagccgggcctggtggcgccatgcctgcaatcccagccaatgggaaggctgaggcagagaatggcctgaacccaggaggcagaggttgcagtgagccaaggtcatgccattgcactctagcctgggcaacaagagcgaaactccatctcaaaaaaaaaaagaggctgggtgcattggctcacgcttgcaatcccagcaccccgggaggccgaggcgggaggatcacaaattcaggagatcgagaccatcctggttaacacggtgaaaccc

SEQ ID NO: 666489 - DNA, 539 bp, Homo sapiens
aattaaaaatgaaacctttcacactttgttaatacgctgatctgaacattgaagtactattaaatgatatccacattatgttggctattaaaatactgcttactgagaggcctagtataagctaggatattatcttccctacacagcaccgagtatcatcatgcctgtgccagtagaaaaggaaatgtacctatcaagcctcttcttattcttcatgaataactcaaaatcagtgcctcattttattttgctctataattggacctgaattttttgacatattgttgatttgtctttcttttttcttgactaaataatcttctcaagcatcccagctcttcaatgatactatctatggcactgaatgcacattcttcccagaaagcccgagacagtatgctctcatctgaaattagtctgctggatagctgtcactctagggtgagatacccttttggctgtcactctagaatgagacatcctaagtaaggtccactgttttatggatcccatttcttcttctttcctggttttcatcc

SEQ ID NO: 666490 - DNA, 1423 bp, Homo sapiens
taaaatgatgagaaacaaaatttatggggtggccttggagtgtcttagggaatgaggcttgggacaggggtgggcggggtcccctccgggttggcgtggtattgggggcgtgcgtgggtggcacgccttaaagggctgctcttactctcggcgttcatctcacgctttaggaagtcctccgggagaaaacccagaattgcaaaagacgcctctcttgggctcacaaactcggggggaggggcctctctcgggtaatatcacaagagaagggggagaagtggggtgccctcaaaatctcgccagagcgccccagagatatatattttcttcaaaaagaacctctcacatacagtgcggtgtgtacccgggggagtgtgtttgtggaaccctatcccttttcccttcggggggctcacaagtggctctcatatatagcgacacgaaaatagcgcgtgtatgtggtggggccctggtggctccctttctcgaaagtgtgtgtctctctcacagagtgtgtgtcttctctcatataagccggggcgggaactcttggagaccgagaaacagagggcaaaaataaattcgccgagcgcgctctccagagggggacatccggggggtgccccccctcagtgtgggcgtgtcgtgcgacacaaaactctgttcttctcaactgaaacagcgtgtgtccgtgtggggtgagaaaattttgaaaagcaattcctccctgtcgtgggtgtggggcccaaatctccccaaagagaacaagagaagtctgttcttccacagagaactttgctagtaaaacacttcttcctacaaattccccgggcgggaccattctcgtggggagacgtcctttgagaaccccggctgtaaaaaagaggggggggggggccacacacattcccaggcctaaaaagtggggcgggggtgcccccgagaagcgaaaataatcccggagccggggccttgggaagaggggaggacacctccgggggtggggcggggccccacgtggttgcgaacggcgaaactttggcggctccacacaccgcccgtgaacccccgcgtaacaaaggacatgcggaaacagcgcggggcgcaaacaaaccacgaggggcccaagggaacacccagttgggtgcgctaaaccccggggggcggcacgagggggaaaaaaaatccacgagggggccgccataggtcccccgctttttcaaagaggccccaacagaggggtatcaaaagaacgagggggggctacacaccggcgcggaaaacactgtgatttgtagaccccccgtggggtatgagaccaccaaaccacggaaaaaaggtgtataaccgcgtagcacgagacgcaacaaaacaagggatcactgtgcacacaacagaaaacactaacactacacacaagcat

SEQ ID NO: 666491 - DNA, 219 bp, Homo sapiens
gcttctgaaaccctgtcggataatacaaaagctaccatcagaagaaatcccttcaggatcatataagccacttcctttgctctggcgtttctatagtagttttacattattcttaaatcacctgaaaaaaattcccaaaggagaaccacacactaacatattccaaccaattttggatttaccataattgtagaaatgtcagccgtcgtcagccgagag

SEQ ID NO: 666492 - DNA, 100 bp, Homo sapiens
tgccgcttctcttttgcctgcgcgccctcccactggcggcccgcggaccttctcttgtgactctttcgtgtgtcggtggttgatgctgctgtctacctgg

SEQ ID NO: 666493 - DNA, 992 bp, Homo sapiens
tgactaatcagtgagagtgaggcaaatagactgaagatacccctacttactcggtgtcactagattatggtataaatcctgcttaatcatcatatgcatctgaatctaacttcttcttattcccaatcttatttgatggcgtaattatactaatattggatcgcatcctccgatgcaggcttctacgaagcacgcgcggtgggaaggaggaccccaatattcttataactactaccatcttaacaaggactaacatatccccatacatcatcagaccacataatataacactcaggaaagcgagccctagagctcacataacacattctaggtacctcactctcactgcccaaggaactatccaaacatcctggagccaacaacttaagtatgactagcttacacaatagctttgatagtaaagatacctctttacggactccacttatgactccctaaagcccatgtcgaagcccccatcgcggggtcaatagtacttgccgcagtactcttgaaactaggcggtatggtataatacgcctcaccactcattctcaaagccggctgacaaaacagatagcctaccccttccttgtactatccctatgaggcataattataacaagctccatctgcctacgaaaaggaaaaactaaaaatcggtccatgtgcatactctttcaatccagcacaatagccctcgtaagtaaccaagcatttctcattccaaaacccccctggaaagcttcacgggggcagtcattctcataatcggccaggggagtaaaatccttattatattctgctagaaaatcaaaattaagaaaggactcaaaggcgattataaaccctcttcagggttaaattattccctaaaatgtttgggggttttaaaaggcggaaactggttaccccatatattggggagccctgggtaaccggtcggaaaatccctaaggggaaaaagatcttttttaaggggggcctaaaat

SEQ ID NO: 666494 - DNA, 993 bp, Homo sapiens
  misc_feature (189)..(189): n is a, c, g, or t
gacaccccatcacatagaaggtacaggggtcagagcggataccgaggagcaattgggagtgtagtaatggtgttctagcaacaatgagaggtgtccactacgtcgtgaatgcagaggtaccagtgtcgctatgaataggttgagccgagtagtgacctagagcccacgcgactatgtggttgcttcccncaaatgatagctagagagcgacggtgatcaagtgcgcttgtagcatctcaagttcagtggtctggcatgtctctttgtgcgggtagagcagcagtggagcatccgatcagggactcctggcgattgcatatccacaacgagcacggtgtcatacgacagctgcggctacataacggtcgtgccgcgtggtcacccgaggaagggtcacgaccgaggcgcggagcctcaaaagagtgaatacaccccggtatgatccagctgtcgtatcaagaaacatttgatgacgccgtcgacacagcacccccggtcgacaggggaacaggggagaggactgtccctgagcagaatttagactgggtgggccgaagtgccagagacgcaggatttggactacgagaggcagagcgtccgactataaatcggctcacaagggattcaagggagtcgatgcccagggcacgcgtttccaacaatgtagaagctgggaggacgagatagtcgcgtctggatcacccatggctagacgctgaaaacccaccatggtaccggaatcctgtcctcagcttcttaaatataactgccttaaaactttaatcccacttgcccctgttacctaattagagcagatgacccctccccctaaatgcctgcggagttgtgcacgtagtacgggtacaggcccacggcaggcctacccggcaattaccgggcaacaggtaacatgagaacatgaaaacagaaaacggttacaaactgtaccattctgtgtgacagatacggttccttaccacggaaatgtgccca

SEQ ID NO: 666495 - DNA, 259 bp, Homo sapiens
agatcccttttcatcctgttaggagacgccaaagaaggtgttagtctattagatccaaaatagaatcaaagctctccaaatcctgatgctgctggcaccttgatcttggacttcccagccaccagcactgtgagaaagtgtatttctgttgtttactgagtttacggctatttatgcttacgcagctccacaatggaactacatgacatctggccacataaagccaacatagatacagtgccagtctacaagaggcaca

SEQ ID NO: 666496 - DNA, 252 bp, Homo sapiens
cccccatcccccttaaaccccttttttttaaattataaaaatttggaaagccgggtttccactttttaaaaccctttggactttttttttgaattattaaagttttttatgccctcctttttaaaccctaaattttgtccccccccgtccttttttttttttttccttccaaaggatttttttttggggctattataaaaaaaaattttttggggtttttctccaaaaaaaccccgttaatgttttaaggga

SEQ ID NO: 666497 - DNA, 670 bp, Homo sapiens
  misc_feature (663)..(663): n is a, c, g, or t
aaaagagggagcgccccctcccaaaataattcagtgtttccgcctggtgtccacttaaccaatacagtgtttccccccggaaaacaatgggggttgggggccccagctcccccttttattgggctgggcgaccataaaacatccccccttcctgaaggcccctttttccccggcgtccctgtgggaccagggtggccattgtctcaccaattctggagtccttcaaacatttttaagagtatttgtgggcctcccccccagggaggggttccaagcagggaggggggcccctttatcccccccccccccgggagacccccccccttggggaggtagggaatttttcccccccacccccccaaaggcggtttctcccccaagaaaagacacccccccctttttttttttgaatttgagaacaccctaacggcggcgtggtatcttttctttggggacaccccgaaaagtcgttatttgggtgtggggacccccccatagtcttcaaacagctaatagaaaaccgcccttttggataaaatttccccgggttcaagtggcacacacaagccttcttataaaaaggtaaagaaaaacttttttgctccttccagagcagcgcgcccatacggtggaatataaaaagtcaaaaaattttcctcaaanttccaga

SEQ ID NO: 666498 - DNA, 143 bp, Homo sapiens
acgttctatgacatcggtgtgcggcgtgtggcgcgttatatgacattccatgttatgtgacattccggtgtgctggcgtgtggctgcgttatatgacattccatgttatgtgatattccggtgtgccggcgcgtggccagaag

SEQ ID NO: 666499 - DNA, 173 bp, Homo sapiens
agcctggtgaccctggacggctcgagacctgggagaaccctagcggccactaggcacagctatcacaggtcaatcacgaaaaagccggaccatgcatcagagatcacattagagagaaaggaagaatagatcagataaatactgaggaacctcctgaggagcatacaaaaaag

SEQ ID NO: 666500 - DNA, 625 bp, Homo sapiens
ggtaacgaattatctattctcgccccatgtcagcgacccagtatcatatcatggaatggaaatggagagaagtagatatccccttaaactgcaagtcagcaggatgttacttatacagtataactatagcaaaattcatacaaaatagtaattaacaatgatcttctatacttgtataactcacaaggaaacaccttcgaaactgcattaagttacagttggtgtactaaaatgtcagaacaactgaactacacacaatattgaaaagttaacaaattccattaattttttattcctggtaccactcaccacaatttacagggcaatcatacctgatgtaatgaaaagaaaaagaaaaagacaacgctccaacagcataaaagcactcaggaatgtacatctaattgacactacattgcattaatcaatagctgcactttatgcaaactgtggctatgacagtcctgaacacgacagggtttcctgtttaagctgcagtaacttttctgactatggatcatcgatccttctgtggcagattatttacacgttcctctaatgcatttgggacgactgtctctaagtaacctgcagataatctgacaactcctcgatctctctcctg

SEQ ID NO: 666501 - DNA, 343 bp, Homo sapiens
tgtccttatgtttctaacagcgctctacctccctccttcttatatttcacccctaatatattgtattttttattctatctattcttatttttattactactttctcaccatcctttactttcaaccccagaacatacactgaaagacatacttcacgatgactaggcgaatagtcatcaatgtatagaatgaggttacaatatttactcaggatttcacgctcgagctgagatatgatacatagcgctttcacagagatttattttgagtcaacgtgtgaactatcttatctatatttttagatagcatcacttctatgtttatgaaagaagaaaagctatcg

SEQ ID NO: 666502 - DNA, 517 bp, Homo sapiens
  misc_feature (36)..(36): n is a, c, g, or t
ccaagaaatgtgcatgggagcacccagcccacaaangccgggttgtgtcaaagcatggcccatgacaaaaaccccaagtttttcaatgtcttcaaagcccggatgaagtcggcccacaagcgggagacaaagcgtgttgtcccaaaagctttggaaaagctgcgtttttaaatggaaaaaaaaaaaagccaacctgtaaataaagctgtagcccacatgcagggtgaaatggccaaaaaatgtaagcaagtaaaggaaaagtgtaaggaggaatttgtaaaaaaaatcaaaaagctggcaacccagcccaagcaattgatttttcagaccaaaaaaaaacagtgggtaaaaaccagttttttttaaccccttatttttgaaaatgtaccccaggtataatgcccgttaattcaaaagggagctgtggcccatccaaaaaatgttttttaaaaaaaatcaaatgtgaaatggtcagctttagttttaaaaattttattaaaagtcctatgttttttca

SEQ ID NO: 666503 - DNA, 123 bp, Homo sapiens
ggaggccgcgtttgggaggatcgcttgagcccgggattacaggggcggccactgcgaccagctgcttctccttggtggactgataaacaccaacaaggcggcgcacgtcccgtcaggctcctg

SEQ ID NO: 666504 - DNA, 344 bp, Homo sapiens
  misc_feature (33)..(33): n is a, c, g, or t
  misc_feature (37)..(37): n is a, c, g, or t
gatccaagcagtcgttacagtcattcctggcanctcnggaggactggttccaggacctctgccaggtgccaaactccacggatgcccaagtcccttatataaaatagcacagtatttgtatataagctaagcacatcctcctgtatactttaagccatctctagattatgtatgatacctaatatgatgtagctaatgctatgcaaagttgttatactttctcatttagagaataatgacaagaagaaaaaagtctgtatatattcagaacagatggaatttttccaagttttttttttttttttttgagacagtctcgctgtcgactgcttggattacaagga

SEQ ID NO: 666505 - DNA, 197 bp, Homo sapiens
tctaacaaccgagaagtggaagcaagccaagtgctcactgacagaggaacagatttctttcaaagcagcatatacatacaacgaaacattattcagcctgaaaaagcaggaaatgtcgtcacacgcagtatgactgaacctggaaaacgtactgctaggtcaagcagattaagcaaaaaaaaatgaaccggatgaga

SEQ ID NO: 666506 - DNA, 117 bp, Homo sapiens
taagaggaaaaaataaatataaatataaataagatggtagagagccgtgcacggtggctcacacctgtaatcccagcactttggcaggccgggtagggatcttcctttcatcgatcg

SEQ ID NO: 666507 - DNA, 903 bp, Homo sapiens
  misc_feature (1)..(1): n is a, c, g, or t
  misc_feature (8)..(8): n is a, c, g, or t
  misc_feature (15)..(15): n is a, c, g, or t
  misc_feature (735)..(735): n is a, c, g, or t
  misc_feature (790)..(790): n is a, c, g, or t
ngagaacnaaggagnacagcgacggacaaaaaaaaggcaaaacacttttaaagcgcccgaataaacccgaaaaaaaagaagaggagtggcatagagcctctgctagactccaattgattctaattttttatatgaaatagaaaaaggcaataagagttaacctaaaagaagaacttatgccggcgatagtaggcatcaaccaaaaatatatttgaataaaaatgcttaatacatatatgaaatattggatgcgagaccaaatgtataaggagtgtcaataatagattacataaaatgacatgaagaaaatcgcaaggaagaatttgacagtaaactctaaagtttaatttatatctaatctgtttatggaattaacaacaagcgcccaaaaatgacgtgacgcagttgttatttttttcttacggatttagcttgatgatgaatatctgggagtgtggaaggcagaagtcagtcaatagtccggtttacaatctatatgtatgtagatgtagaccgttgtatgacatgaaagtgagatttgtcgcgtttttttaatatttagtttatattaatagttagactttatctcattttatttggatcggatatatatcaattctacagagtttagattatatataggtattacaggtgatatgatatgatagatttttgtattgatgtattacgacagtagttatctcgttgaggattttatcacatctccgctcatcngatgagtaggtcccaatatcggtgtttattgatatagatgcgtacattagttttnacatcgatcacggtcgcatctcgtgcactagtgtatttactattatgcgattgaattgcagtatttaggatagttactcattcgtttcttagtgtatgactagagacgtagcg

SEQ ID NO: 666508 - DNA, 175 bp, Homo sapiens
cggtgagccttggaggcttaggtaggtctgaggttggcacctcaatctacaccagagcccaggagtcccagaggcaagtttcacagaatgtcaaatgatcccatttccttgagtctgcttttttttttttttttttttttttttttttttttttttttttggggggcccccgggg

SEQ ID NO: 666509 - DNA, 276 bp, Homo sapiens
gagatcactgtgtatatctaacactttgttccacgtagcattatgtcagatagccagtagacatgtatgtatatagaactcctttaaagtttcttacgatatcttaattatatcgatacatgaattcacttactttcaaatggtagggcaaaaacctaattcaacttttttcgtccattttcctgtttgttaaaataaacattagctctccctacgtataatattcttgaccccaaattgaaattatttaaccttaagggtcaagctgggagaaga

SEQ ID NO: 666510 - DNA, 687 bp, Homo sapiens
  misc_feature (461)..(461): n is a, c, g, or t
  misc_feature (598)..(598): n is a, c, g, or t
tggccgggccctccgccttgcagttcagagtcgtgggcttgcccttagagacgatgacatcggaaggatgctccacaatccgcgggggaaagtcctcctggcgaagacgcgatcctacaaaacatgacggaataaagacaagctttaacatttccttatctaaaccttcggtttcacttgggttcctgatggggaaattaaactcttcgattatccaactgaacattattttatgtttctttttgtgtatgcatctcataagtcatctcaattcctttgcaggatagggcgataccaataaattaatatgttaactcaaaggagttaggtttaatgtgttccatgaatcatgacaagcaaaagtaaaagagaacaagagactttcttgttcttctgggatcagcatgggtactaagatgagtaagactaatttcctgtcctcagattgcttattatacacntgggaagaaagccacgtcagcaagtagctagaagacacacatagatagcatttaatgtgctgccaatatgttatcagactaacacagagacctgtaaattatgtacaaatattatctgcatttaacagatgaggcanaagcttaggaaatgatgtcagttgcccagtgtagatgaggcaagcagcagaggcaggattttgaactcagggtgtgttgactgaaggct

SEQ ID NO: 666511 - DNA, 424 bp, Homo sapiens
ctagaagcatttggagagggcatactcattccgttgctctgtgagaatcatttttcatttcaacattttcctttcagtctttgtctgcttacatatagctatcagaatggcagttttatcatcctttttcataaaacattataagcattttgctctgttattatattttacaatgaaaacttttaatgagtgtggacttttctgttttgtgaatgtcccataatttgtttgacacttgccttcaccccattaattcttgtgaattgtctatgtctgttattttttttggtctttggtatgaaaaaaattttttgtaggcaaatttgtgtgagacgttgaaactctttgtaagtttcaaaacaaaaacataaatattatttttctttacaaagcctgccatgttgatctgaaactacttcctctt

SEQ ID NO: 666512 - DNA, 711 bp, Homo sapiens
  misc_feature (72)..(72): n is a, c, g, or t
  misc_feature (74)..(74): n is a, c, g, or t
  misc_feature (79)..(79): n is a, c, g, or t
  misc_feature (81)..(83): n is a, c, g, or t
  misc_feature (86)..(86): n is a, c, g, or t
  misc_feature (112)..(112): n is a, c, g, or t
  misc_feature (114)..(116): n is a, c, g, or t
  misc_feature (120)..(120): n is a, c, g, or t
  misc_feature (125)..(125): n is a, c, g, or t
  misc_feature (127)..(127): n is a, c, g, or t
  misc_feature (163)..(163): n is a, c, g, or t
  misc_feature (170)..(170): n is a, c, g, or t
  misc_feature (185)..(185): n is a, c, g, or t
  misc_feature (189)..(189): n is a, c, g, or t
  misc_feature (194)..(195): n is a, c, g, or t
  misc_feature (212)..(212): n is a, c, g, or t
  misc_feature (218)..(218): n is a, c, g, or t
  misc_feature (292)..(292): n is a, c, g, or t
  misc_feature (294)..(295): n is a, c, g, or t
  misc_feature (297)..(297): n is a, c, g, or t
  misc_feature (299)..(300): n is a, c, g, or t
  misc_feature (302)..(302): n is a, c, g, or t
  misc_feature (304)..(304): n is a, c, g, or t
  misc_feature (309)..(309): n is a, c, g, or t
  misc_feature (311)..(311): n is a, c, g, or t
  misc_feature (321)..(321): n is a, c, g, or t
  misc_feature (333)..(333): n is a, c, g, or t
  misc_feature (342)..(342): n is a, c, g, or t
  misc_feature (360)..(360): n is a, c, g, or t
  misc_feature (386)..(386): n is a, c, g, or t
  misc_feature (397)..(397): n is a, c, g, or t
  misc_feature (400)..(400): n is a, c, g, or t
  misc_feature (403)..(403): n is a, c, g, or t
  misc_feature (425)..(426): n is a, c, g, or t
  misc_feature (439)..(439): n is a, c, g, or t
  misc_feature (445)..(446): n is a, c, g, or t
  misc_feature (448)..(448): n is a, c, g, or t
  misc_feature (450)..(450): n is a, c, g, or t
  misc_feature (452)..(452): n is a, c, g, or t
  misc_feature (454)..(455): n is a, c, g, or t
  misc_feature (484)..(484): n is a, c, g, or t
  misc_feature (493)..(493): n is a, c, g, or t
  misc_feature (501)..(501): n is a, c, g, or t
  misc_feature (551)..(552): n is a, c, g, or t
  misc_feature (555)..(557): n is a, c, g, or t
  misc_feature (570)..(570): n is a, c, g, or t
  misc_feature (575)..(575): n is a, c, g, or t
  misc_feature (582)..(582): n is a, c, g, or t
  misc_feature (707)..(707): n is a, c, g, or t
ccgccgcctcccacccacccagccctgccccccccccccctccacccctgctcgcctggcttccgccccctncngcccncnnncgnccatggccatactatgacgccataancnnnggcngagtncntgtcctttgtagggacatggacgaaattggaaatcntcattcncagtaaactattgcnaggncaaannaccaaacaccgcatgtnctcacncataggtgggaattgaacaatgagaacacatggacacaggaaggggaacatcacactctggggactgttgtcgngnncnanncngngggcngnacagccttcngcgacacacctnatgctaaangacgagttaatgggtgcngcacaccagcatggcacatgtatacntatgtcactcnccngcncattgtgcacatgtaccctaanncttaaagtataancccccnncncncncnnccgccccccaggccgagggaaaggtagcnaagtgttcnggggtccngacagaggggttccagagggctgaagcccttggtgtgaatagtatgaatnnccnnncctgccccccccntatcngaggtcngaactgggaggaaaaatcacctaatatttaataattaccaagtcctgcttttaactatataactagttatataatactataaacatttgctttattgtgtttaaaatatgtaaaccacttaggtnattt

SEQ ID NO: 666513 - DNA, 146 bp, Homo sapiens
gagctcagttgattatcacagttgaggaccacagcatgatctagatcgagtaagaaactgatggttatctgataggtgtttgcactcatcttggctgttaccatgcaatcagagatttggtgtattactgcctgcatggtaactat

SEQ ID NO: 666514 - DNA, 1069 bp, Homo sapiens
gatctcagctcactgcaagctccaactcccgggttcacgccattctcctgcctcagccttccaagtagctgggactacaggtgcccgccaccgtgcccggctaatttttctgtatttttagtagagacagggtttcaccatgttagccgggatggtcttgatctcctgacctcatgatccacccacctcagcctcccaaagtgttgggattacaggcgtgagccactgcgcccgggcaagaccttttttttaaaaaaaaaaaaaaaaaatttccattctttcttcctccagtcggttctcacattaccagagatacgcttcgggcttttcaaacttcctctcggggctggatcggccggcttatcggggtcttcaacagggtgagcttcccacatagtggttccctcagaacgggggctccagaaacctccgtggcctcaaagcccaatatttccccgggccatacaggcccgtcctacaaattagccgtgggccttacacgggtcattgaagcccacccaacacgtgtggcgccagagaacttagggatgggattacgacactttacaatccgtgggatcaacgccccctgtgtcttgtaagaaagccctttcgtgggcgactatgtcataaatgatcacccccgccgttcgagtttgaacgcagcgtggggtgtcagaacctcttcttctgcaccccgtgggggggtttaaaagtggagacgaacccagtgtggggtactctaatggtgacccgttttaccccccctgtttgaaagccccgttatgttgacactggggcgggaattcttcctcgtggcatagagggacctcccaacgaccaccgaaggtagggttgccccccactccactaagacagctcgcaaaagtagagggggagcacaccgaacccgtggggccattttcatcacggtgggggcccctttttctagcaagcggttgacagcgaagcgcgccaaagacacagacgttccttggacaccccaacgggaggggtaggcaccacctacacattcgcccaccaagaaggcctctgggagacagcaaac

SEQ ID NO: 666515 - DNA, 179 bp, Homo sapiens
cctgggaggccctagggagcaccgtgatggagagacagagcaggggctccagcaccttctttctggactggcgttctcctccctgctcagtggccttgctccacgggcaggggtcagagcactcccatatttatatagcacataaattagggagtgctctgaccctgcccgtggagccc

SEQ ID NO: 666516 - DNA, 306 bp, Homo sapiens
ctgggggaggcaaaaccaacaggtggacaggtgtttgcaggggcccaacttcccctggagctcaaaggtgtcccccctgtaccagcctttgataaactgcctccagttgtcctttatgaacattgcagggacaacctgtgtttgccagctgggtgttccgtgtaaaaaaccagcctgtttctttttcggtgataaaaccccccctttttggtgagcccagggtcccccccttggcttccaggagccctgggaagcatttttaactgggtaaaatttgactgtggcttgaaataaaaagctctcaga

SEQ ID NO: 666517 - DNA, 1607 bp, Homo sapiens
  misc_feature (94)..(94): n is a, c, g, or t
  misc_feature (497)..(497): n is a, c, g, or t
ctaactactctactgctggcctcgtgagcaccttctttcgaccccgacgctgggaggcgagagtcgccatgcgtagtatcgaaccacgccgtanttccttgagtttgttacgctcgatcgccttggataggtagtatcattgctttgattccataggcaaggcgttcggaatagtggactcttctctgattcattgtaagctatagtacttccctgagtccataggaagccactgtgtgggattgagcactgaggggtcattggcgtccttgacgctctcatcgaagtgatctagttggggcgtgtacactcagggggtctctcacttcggtgggtgaagctcagcaaaccagtgacctatttgaaccatgtccagcgtcacttagaccgtgacgcatcagactctagatgctagttagttctctagcgcattctctcgcatgagcgcaataaagatacgagtgcagcgttatgcaccccccaccaagcgcggtctnagaaggtgattttaacgctttgagcctcggcacgaacacttcccagcagcgcacatgcgagataatatgcaatatggatcctttggtagcttagcctgccgtcaatggcagcgctcgtcaggcgtagtttcaatcccccttcgttgtttgcccacgcaggggaacggatccggggtcgtggagacttcgggacccatatggatccattggagcccagaaaaggctcccattcgcacatacaggacgacttgattgacgtatacggacaggtacacacgcttaactgtaaacccctctgggtaagtctgaccaaccgttttcccacagctaagttgggtgccctaaatcctagagtaagcggcagggcctggtaactcttccgcacgaggtgcgattgagcgtgggaagggctttgcgaataatccaccctcgaattttgttcacacacgctaagttgtccctgcaagtgacttatccaattcccattagcaactcgaaacaaccccttaaaattgcccccaaggaaagtccacatttgttttccgagctttaatgtgccactcaatttgccgatcctggcgccgtttgtataattcgtcacaggctggggtaactttttccgcaaacccaacacggacatttttacggtggcggggagccctttattatcccgagtaaggagatagggtcccgcgggagcggtttagccattccaggtgaaactctaccacgcacagttagtgtagccattataccttcgaacgcattggaataaacaccaggttggggcaactttgaaacgggggcgggatggggggcctccacaatatcaatctttccattcctatataaaccagaccacgtgttacatcaatcttaaactataacatatcttgcactggacaaatgcttacggaagcacacgcacctgttggagcttccgaaaaagcgagaaaaacaggttccctacagtatggtatgcagcacagaacaccccatcacaatagaaaccctgggaggttgacataaatatagggggaggtggccccccgaacgaacggtatagcccagaaactttttgagacggcgcgcgatgactgtacaacataa

SEQ ID NO: 666518 - DNA, 292 bp, Homo sapiens
tgctccgggaggcaaggcaagacgatcccctgagcccaggagttagagagcagcctggacaacatagcaagactgtgtctctacaaaatatacaaaaattgggctggggatggtggctcacgcctgtaggcccagcagtctgggagaccaaggcaggaagatcgattgaactcaggagctcgggcacagcctggtcagcatggtgaaaccctgtctctactaataatactaaaatcagaggttgcttgcagtgagccaagatcataccattgccctgtggcctgggcaacca

SEQ ID NO: 666519 - DNA, 250 bp, Homo sapiens
ggctcaagtgactatcgtcagaggccagggagccatcgtgatcgtggagagacaggtgggccatgtggccgcagaggtcaccgaagatgtagtagcacggctcggagaaggtgatctggttgacggtatggcggatgaagccagctttcagcaggtggcgggcatactggcgggcctccctccggtccgtgaagccttccacatggtggtacagccagtccaccacatctgagccgatgaaagcattagg

SEQ ID NO: 666520 - DNA, 184 bp, Homo sapiens
ttagaaaaaacggggttcttcaacgtggccaacctggcttcaacctcctgacctaaggggatccgcaagaaggggcccttttaatggatccagcaccaaattccaaacttcccaggaagggtggtttcctgtcatttatataaaactttgggtctaaggcctttattgcttttttaattgaaat

SEQ ID NO: 666521 - DNA, 235 bp, Homo sapiens
  misc_feature (188)..(188): n is a, c, g, or t
  misc_feature (224)..(224): n is a, c, g, or t
caagcagttatacagaccaaattaggcatcctggagcaggtactctgaaaataacattaggcaacatcagagcttcactggcaaaggaaatgttaaaatcattttagggaaatcagtgaagtctctttagaaaacgagacatctggtggtataggggtaacccaagtctatagggccctacacggagnaagacgggggaagtcttattcatctgattgggtcancaaacaatatc

SEQ ID NO: 666522 - DNA, 598 bp, Homo sapiens
  misc_feature (274)..(274): n is a, c, g, or t
  misc_feature (335)..(335): n is a, c, g, or t
gaccgccagcgtaggtgctaccaccgttgccgtcgcctgcgccattttggatggcatggaagagtccggttctgggacagctggacgacacgtggtggtgactggtgaataacttgtaccaaaggggaaaacgctattttggcggaagctacttcgttctccaagcgggacgatttgggcccaaatgttgctttgtgtaaccaagaagctcagactgggttttccatatctcgccaggatttgggctctatatagttaacaaggcgttggtcanatcccaaaggccattttcgactgtgcaggattcaatcagggttcgggcattgactggtccnttccaccttcgtttgggcggccgttttgcgctttgtgcgcgaaacccccttttcccccaaaagggggacaatgttttaaccttttaacatatttagcgccccatgtttcacacattatgtcccggggggaacaactacaccactctataacactgtggctatgatgggagttatacgacagacacaccccctttttgatggagcatctttgttcgcaacccacacgacaccgtttaaaattgttgcggctgagggaatccccc

SEQ ID NO: 666523 - DNA, 364 bp, Homo sapiens
ttacgcctatagtcccaatactttgggagaccgaggtgggcagatcacttgagcccagcagttcgagaccagcctggacaacattgtgaaaccttgtctctacaaacaaaaaacaaaaacaaaaaaaatgaagaaattcccaggcacaatagtgtgcacctgtagtcccagctattcagaaggctgagatgggagaatcgcttgagcccaggaggtagaaattgcagtgagctgagattgcgccactgcactccagcctgggtgacagagggagaccctctctcaaaaaaataaaaaaagaaacccaggcaggcatggtggcacacacctgtagtccccagctgctccagaggcagagcagaat

SEQ ID NO: 666524 - DNA, 336 bp, Homo sapiens
gcgtcgacgttagtactaactcaaaccagcttttgtctcttcaggcatttgaaatgtcttttgccccagtcgtggtggctcactccagcaatcccagcactttgggagactgaggtgggtggatccattgagcccaggagtttgagaccagcctgggcaacatggcaaaaaacacaaaaatcacaaaaattggccgggcgtggtggcgcacgctgtagtcccagctactctgaaggctgaggtgggagcattgtttgagcctgggagacagaggttgtagtgaaccaagattgtgtcactgcactccagcctaggcaacaagaacaaaactgtctc

SEQ ID NO: 666525 - DNA, 133 bp, Homo sapiens
gcatttggaggccaggcggacggatcacttaaggccagcatggtgaaagccatccctactaaaaatataaaaattagcagggcgtggaggtgcatgcctgtagtcccagttacttgggtactacgctttggca

SEQ ID NO: 666526 - DNA, 305 bp, Homo sapiens
ctgttaatcctgccagccacctccacatattgtacaataactcaaccatgatactaaatcaccatattccgtgcaaactacttaacaacattgcgacttctctcccttaatccactctcgtagatctcttccctcatatttcttcagggacacaacccccctttaactgataacaactttacaccctccccgtcggaaaaccacccacagcttgtgcaatattccacacacacttcgccagcttttaaatgctttaacaactatgaacaccatctcggctcttgcccatacccgcattatcacaa

SEQ ID NO: 666527 - DNA, 111 bp, Homo sapiens
gtatattctagagattagccctgtcagttgcatcattgaaactattttctcccattctgtaagctgtctttttgttttcttttgggtttcctttgctgtgacaagcctttt

SEQ ID NO: 666528 - DNA, 308 bp, Homo sapiens
gacggatgctatggaccaggcaggacacgtgggcacctcatggagcggctgcttcgtcttctgagggccgggcacggtcacgcggcacccgccctgagcaccccatgccctgttcacgctcacccggtcacctccccacatcgcacactggggccccgggttcagcctggcctgcccgtgccctggtgaatcacctggctgagcagttcccctggagccccttcgggagcagggctgtgtcccaggatgggccacggttgagcctttcaagaggtacgtcctgccttggtcccatgggtaccgagctc

SEQ ID NO: 666529 - DNA, 238 bp, Homo sapiens
ttatgctcactaaagggcacagcaggagggtgcatctggaccaatgccctaccctgtcctacttaaagtgattcggtttgggaaactcgaaggtctatttgagagacccctcatcaatgtcactgagaaattgaaggaaaggagtttcttcccagtgtagctttccactgttctacctccccacaaccagatatctttcctaggatttctaacacagtcgatttggactgaaagagta

SEQ ID NO: 666530 - DNA, 712 bp, Homo sapiens
  misc_feature (266)..(267): n is a, c, g, or t
  misc_feature (451)..(451): n is a, c, g, or t
  misc_feature (515)..(515): n is a, c, g, or t
cccatttttttgttccccggaatttcgcccattatgcccgggagatccatcttaatctaaagggtcagggcgatgctctctaatcccagcaatcctgccacattctactcatcatatcttgaccaactcagtgtagagttccaccttactctataaaccataattttcctaatttaaaatgaactaataatgcccagatttcctatagttataacaattagatgatataggggcacatagatacatgcaattcctgcacagtgttnnaacccactgttcttcactctactctacagacagtattaccttaaaaaggatctgacacaggcctcaatcaacttataaccttattttccctatcttaaggccctccccaccttcctaagattaaagtatatttcttaacaattttttaaaatactccagtaaactctgttaatctctcattggntgcagcctactctgatccatctacaccataacttgcaacaccaacaaatgactctacttctctnttatttgcacttatgggccaacacacctataaaaacacttcatccttccaccccaaataagttctccctcttcgagttccccccttaccttttatgattaaacattttatttcttcttaaactgccaatactcatcatctcaacttttccttcttaaaccctttcattaaatccctcatctgtccattcttctctaa

SEQ ID NO: 666531 - DNA, 120 bp, Homo sapiens
aacacttacagatgaagatctgaaattttaaaatcctgtttgtatttttttcccaggccttcgaacgactacattgcattgttccctttgatgagtagattctcatagattggtgcaaaa

SEQ ID NO: 666532 - DNA, 540 bp, Homo sapiens
  misc_feature (299)..(299): n is a, c, g, or t
  misc_feature (362)..(362): n is a, c, g, or t
cctccctccacgggagggtttctcttgttttaaaaaatcccgtgtggcgattttttacccattttacacacagagggtattggtcccactttggccgggccccctgggaaaagattttccccggtgtggaagggcaggacccggaatggacatggtcactcagccccgccggcagtgtccccatgaatgatcatggcttttgcattttggggaaaaaggaaacttcgggatcctgtcagggtgtccccaatgcctggaaaagaagttgggggttcccacccttggggcccggaaaaggntggggctttccccttcccaaaagccagggctcctcctcctgtgggggggataatggggacacnggcctttttaaaagccgggcctggggcctgttaaaggaaaacccccaccccttgactccgggggggggagggggccaaggatgcgggagttaaatcaaacgctgccagtttttcgggcatttttttttcccaatggaattgaacccatgggccaaaaaaagttgaaattttcccccca

SEQ ID NO: 666533 - DNA, 695 bp, Homo sapiens
ttttttaaggcaaattattgaaatggcccttttcccttttattatatatgaagcgcgtgggccaggcaattccaatggagtgggggtttctgatttctttaaaaaagagtcctacatcaaatgtctgcaattggttcatttttttcatgtgagggtttataagtcaatatattgtaatatagcctttttccaccctttttaaagaatgagaattgcatgttctacagtagtcttttatatagtcctccagtccagagggtcagtatgccagacgcagaccctgacagcggttgctgcttgccagtcgatcgaaatcgtggattcttccgtcccacctgcatccctccgccaggcttcccgcgctccctgcctcttaaatgtgcatctgctccaggtatttgtaggtggggttctcatagccatggttctgcatcttgttcaggtgccgctcttgtggggtgagcattggatcatcctccgcgatcccgtggctgatggtgccatattgcttcttcgtcagcctcaccagctttatacgttggccgtgccattgcccactgcgattaccagctggccaatgagagcattgctactcagactgaagtcctcccgcggtgggccccagaattcccgctcttctcaaaatcccccacttctcggggctttgaatatcattcccttaccatccagagctc

SEQ ID NO: 666534 - DNA, 347 bp, Homo sapiens
actctagaggacttccgacgagttgtccgagttaccacctcttggactgaatcgattgtctagactacatgtattacagagtctatttggcaagattgctccatgatcatgtgcatatcatcccattgtaatgcgactttaaaaatatgtgaaacagctagttatttttacacagtgcttattggttctgtgtgtgggtgctgccgcttgactacaacagctattggtttgcctgaatgaggagcggtgctcatttgtgagcctgctatatacgcggacaactcgacaggttccgagcgtgaatgcgcgaacttggacatatcggtttacctgggtgactgtgtgat

SEQ ID NO: 666535 - DNA, 326 bp, Homo sapiens
ggtaccctatagtaccaggtgctattattagggagaagctatacaggagagctgccttatgaagcttcttaacttcattcatgattattctgttcctcattattctttgccttacataactttaaaacgatcaaaatctgtcatcttggatttcctaactctggcttcaatcttcttggcccatcgtgtggctgcccattttgtattgatgtctgccttctgccaggcttgtcggacatacttctggtgggcactgtgcggaaacttgaggatgaaatcagtgagctgcatgcacttgaaaggcatggcctgtctcctcacttgag

SEQ ID NO: 666536 - DNA, 1159 bp, Homo sapiens
ggcccggtatgcaagatgctacaatgtgactcgccttcaacatcagctactcccacaatccactcgtcagcgtagctccttgacatcgcagctgcgtatgactgagtccgactgctacgtgcatctgaccctcggctgcctctgctctcgattgcacccgcctgatcgtcagggctctcatcgttacccggtgtcccctagccagtctggacttcgtcgctcgtaagctccacattagtcttatcatcaatcactacgtacatcgcaggaaacgatggatatgcttctcgatacgtcgctagcatcattgggacatgacccaccgttttaccgcgaacactagccggtcttccttcttgtctgtccccggattgatcagctaggctcgatgcaagcgtgtccagagcccatgtggacagccatgagatcttagctcggagctgagccagcacgccgtctgaggcggccggtgtgcacaaaccagggcagcgcctacgtttgcagctggacaattcgcttaccaactccaaggtcgcagaatttgcctagcattttatgtaagtcccttgctttcgtgcattgcaaccccatggcgtaagtggcaccgtaaactagagcaaggatcctatctcgtggacaaacgcacttaagtgaagagatgtccgtaactaaaggccccacctgtaggttaaagaaagaggcggtggggggaattgcgaattaatgatcggcggctcgattgtagacttcacttgaacagagttctgtcgacggcctctttgtaacagcgactaaggccccaattacttcccatctacaacctcctaataccagtaatgacggcggttggaggccccattctgttcaacgtccacgttctaatccataagagagcttggttcgcggggaggacaatagagttctccgcccatgtggtggctttccaccgacaagtatcacagggcaaagcagcgcatggacaatttggttggtgtacccccaaggtgttgagcagcaacggtacttcagcaccctgggttcaaaagggtcctctggatactgtaatgagttggttcccacagtgacagcccagttacgccatggcgcgttctataagggacgaactagttcagggagcactacgaaggctgcccgagca

SEQ ID NO: 666537 - DNA, 684 bp, Homo sapiens
  misc_feature (601)..(601): n is a, c, g, or t
gaagggctttactcagagatcacatattcaggcccatgaaagaattcacactggagagaaaccatataaatgtggggattgtggtaaacgctttagatgtagctcaaatctttatacccatcagagagtgcacactgtagaaaaaccatacaaatgtgatgagtgtggaaagagctttagattgagctttaatctttataggcatcaacgagttcacacaggagaaaaaccatataaatgtgaagagtgtggtaagggttttaggtcagactcaagtttccagagccatcacagggtccatacaggagagaaaccatttcgatgcaacgtgtgtgtgaaaggctttagtcacagttcatactttcaagcacatcagagagtgcacacttgggaaaaaccctacaaatgtgaagtgtgtgggaaagcgcttaaattgagcctggaattttacaaacattaaagaaggctcaacggagagaaaaccttcacatgtggagaatgtggtgaaggtttttattaagctttcaaatttcagaccatttgagaggtccacttgggaaaaaacattctaaagtggtgcattgacaaaacgaataatttnggcttacaccctttaggccattatagagtgccaacccggaggcatatatatgtgacaatttttgggaaggcttttagcacggt

SEQ ID NO: 666538 - DNA, 211 bp, Homo sapiens
ggtgaaccgggatctggctgcactcttcgacgacatttgcggatgccgtcgatgtcggaaagtacaactgagggtcgaggcctgggtgtacatgttcaacgccacggtcaccaggtcgacgttaccggtacgctcgccgttgccgaacaggcagccttcgacacggtcgcgccgcatcagacccaattcggtagcgccacgccgtccatat

SEQ ID NO: 666539 - DNA, 424 bp, Homo sapiens
gagatgcctatcccttattctataaaaaataagtgagtgtgtcaagaaaccaactctatgaggggggggttaaaaatcacccttacctatgtgttctatctaattatgttggtagtaagtatggtgataatggacagtcaagttaaattttatatataaagaatactgattgatagagattgaagtcatgccagcacgtgtatgtaaaaatgaaggtggcaccggggtgagaccgaaagagaaatagtctactcaggttgtaaaaatatttgattctattctcttcctactgacctccttgccgtcttggtctgaaccatagcagaaggagtcctgcatctctcatgactggcgggctgaggtgatggaatgatcatacaacatacatctcagtctctgttgcatgaaatagcggctgtagtgg

SEQ ID NO: 666540 - DNA, 379 bp, Homo sapiens
gcgcagattgtatgagcccgggagttcaataccatcctggagcaacaaagtgaaaccctatactccataaaaaacaccgtttacccaggcgtggtgatagtagcgcctgtaggtaccagctactacgggaggctgaggtaggaggatcgcttagagcccagtggagcggggtgttgcggtagagccgggatctgcgccactagcactaccaagcctaggtgtgacacagggggagacccttatctcaacaaaaaaatataaaaaagcacaaaggaggaggggaaaagagagagggcaaacagggcaggtaggcaggaaggaactctaaaatttggctgagtagcttatactggtgtaagggcttaaacactaaagtact

SEQ ID NO: 666541 - DNA, 927 bp, Homo sapiens
  misc_feature (528)..(528): n is a, c, g, or t
  misc_feature (726)..(726): n is a, c, g, or t
gaaagaactccagattggacttcctggtgtaaatctcttcttgcttcacacaggtcatttccttggtagggtcgcagaaaaccttaagagctgcagggcttcaaagagaggaacttgcagtccaaagtagcaaaaggtgtctgcattctgagcctcttttgtaactgagcactcaaggtggggatcattgagataagggcttggtccccaaaccaccacagcatgaatttattgactttctcttctcctcgatcctcatggtcctgggaagcaagcacttttccatttccaaatccagtggctcaaacacctggaaatagcctaaagaaaatgcaagtcaggcctggcagctagagcaggagtcctggctcatggcccttccccggcccagcgctcggccatggcaccctagagtgtgtgtctccactgtgctatttttcagaagaatatgaggaacagtactcggaggccagacttgtggggcagaccttccgctcttctgatgaggccactaagcccaaccccaanccaaggccccagtctgccaggcgtctggagtttatattgatggtgagttgcctcatcccccaactgggagagccagcatgcacccactgacaagagacctccagctgcttactttaccactggaagctgctcagccctgtcaccagcagagctaccctgaggcccactgggataggccctgcacaagcaggtgcctgngctggtggcctggtcacgctttcctgcctccagaacgaaagctccaataaccagctaaacagcagcctatgggcactggctccattgccaggcaggaatacccctttcatcagcttctctccaagagctacaaacggaggagaccgaagatgagataccaccaggtgtgagggccccgaaggctccctgaaactgtgtacg

SEQ ID NO: 666542 - DNA, 656 bp, Homo sapiens
  misc_feature (233)..(233): n is a, c, g, or t
  misc_feature (286)..(286): n is a, c, g, or t
  misc_feature (354)..(354): n is a, c, g, or t
  misc_feature (404)..(404): n is a, c, g, or t
  misc_feature (421)..(421): n is a, c, g, or t
  misc_feature (425)..(426): n is a, c, g, or t
  misc_feature (433)..(433): n is a, c, g, or t
  misc_feature (444)..(444): n is a, c, g, or t
  misc_feature (462)..(462): n is a, c, g, or t
  misc_feature (469)..(469): n is a, c, g, or t
  misc_feature (481)..(481): n is a, c, g, or t
  misc_feature (490)..(490): n is a, c, g, or t
  misc_feature (504)..(504): n is a, c, g, or t
  misc_feature (546)..(546): n is a, c, g, or t
  misc_feature (549)..(549): n is a, c, g, or t
  misc_feature (551)..(551): n is a, c, g, or t
  misc_feature (557)..(557): n is a, c, g, or t
  misc_feature (563)..(563): n is a, c, g, or t
  misc_feature (570)..(570): n is a, c, g, or t
  misc_feature (623)..(623): n is a, c, g, or t
ggcatgagggagtccttatggacggtaaatggcgcctgtcagagtgggaaacccagctgcagaggctgcagccccggtccccagcggctaaaggacccccgagctcggggagggggaggccgctccggcccagcgctctgcgccctccggctccccctccccctcctccctgctccttcgctctgcaggtctcggaggaccccatcctagccctacctgtctcggcccgcaanctccccgaagccgtcggtgccactcccagcccatgtgggcccccgcgggctgnccacgcctgtcccccagctccccgttccgctgggctttaccctcgccaggggtggctttctgagccgnccgctccgtgcccctctctgcagcctctcctgccactcggggcccccgtnccccctcccgggggggngggnntgccccngggggggtggnggagtgggccgcgggggnccggggncggcggtgccgnggtcatcgngatgatgcggacgnagtgtctgctgggggtgcgcacgttcgtggccttcgccgcanagntntggagnttcttnatttacnttttgcggagggagatccgcacggtaattcagtaccaaactgttcgatatganatcctccccttatctcctgtgtcccggaatcgg

SEQ ID NO: 666543 - DNA, 1306 bp, Homo sapiens
ggcatgagggagtccttatggacggtaaatggcgcctgtcagagtgggaaacccagctgcagaggctgcagccccggtccccagcggctaaaggacccctacctacctgctccttcgctactgcaaggcccgtatactaccgctgtcacgagaaccacatataagaagacaccgatgaacaaagaataaaaacagaaaaaatacaaagaaaaacaagaagaaaaaaaaaaaaagaagaacacaaacagacgaagacagaagcacaccagggagacaaagagataaaaaggaaaaacaacaatcaacgcgaacaagagcgccagagaccagatcgcactacaaaaaaaccacgacatggagaagaacaagacatatgaagcagaaccataggccaacagactaaacaaaccacgaccaacacccacacataaccacacaaaaaaacaactaaaaagaaaaaaaaatacaaataactaccacattaacacaccacaacaaaaataccattcacacaaacaacaaccaacaaccgcaatacccaatcccacaccaatatataatccaacgttaacaacaacaacactcaacaataaaaactccaaaataaacaatataaccaaacaacacaacacacaactaagcccacacaaaaaaaccaccaacagtcccgaaatataccacaacaacagaatcacgacctaagccattcaatataccaaaagctaaataactaatatcaccataatattatacacacacactcaactaatccataaataataaaagaactaaccatcacactaaaaaaccacacctaccacttatccaacctcaccatacacaacaataccaccccactcaatcaataaactcaccaccacacaccaaacaaccaccatcacacacaaacaccatcacacactaacgactactcaccacacacccacgtcactacaaaacatacaccacacacacaaaaacacataaccccccacaaccaccacaagacagtcaatacaaccacacacacactcacaaacacatccaaccctaactcacactctataataacaacacaacaaaccaccatcaacacatcaaacataaacaaaacacaccgctcactaaccaccaccacaccaccaccccccacaacccccacaccccacatcacaaaactcaaaaatacccaccaacccacagtataacactaacgcacacctcacctaaaccaaaaaccaaactaaccaaaatcaaaaacaaaacatgctaactcataactcccaaccaaaccaccaccaacacc

SEQ ID NO: 666544 - DNA, 896 bp, Homo sapiens
  misc_feature (38)..(38): n is a, c, g, or t
  misc_feature (44)..(44): n is a, c, g, or t
  misc_feature (136)..(136): n is a, c, g, or t
  misc_feature (217)..(217): n is a, c, g, or t
  misc_feature (277)..(277): n is a, c, g, or t
  misc_feature (385)..(385): n is a, c, g, or t
  misc_feature (397)..(397): n is a, c, g, or t
  misc_feature (502)..(502): n is a, c, g, or t
  misc_feature (563)..(563): n is a, c, g, or t
  misc_feature (573)..(573): n is a, c, g, or t
  misc_feature (779)..(779): n is a, c, g, or t
  misc_feature (853)..(853): n is a, c, g, or t
  misc_feature (868)..(871): n is a, c, g, or t
  misc_feature (873)..(873): n is a, c, g, or t
  misc_feature (876)..(877): n is a, c, g, or t
  misc_feature (890)..(893): n is a, c, g, or t
  misc_feature (895)..(896): n is a, c, g, or t
ggccctcacggcccgggtattcttacgaccctggtgcnccttgntgccgccctgctcctcgctctgggcgtggaaaggggtctgcgctacccgagatatgcacccaatgtccagggagcgtgcaaaatttgtcaanagtggccttttattgtaaaacgacacgagagctaatgctgcatgcccgttgctgcctgaatcagaagggcaccatcttggngctggatctccagaactgttctctggagaccctggtccaaacaatcatcaggcacatacnactgtcatcatagacctgcaagcaaaccccctcaaaggtgacttggccaacacctcccgtggcttcactcagccccagactctgacactgccacaacatgtcaactgncctggaggaatnaatgcctggaaaactatcacctctaatatagacaaccaaatctgtcaagggcaaaagaacctttgcaataacactggggacccagaaatgtgtcctgagaatggntcttgtgtacctgatggtccaggtcttttgcagtgtgtttgtgctgatggtttccatgganacaagtgtangcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcattcctagaaaggcatctttcgccagnggattcgcctcaaggttgaggccgccatatggaagatgaaaaatagcactcccttggtgtagacaaatacacanttcccattggtgttnnnncntannataaacacttttnnnntnn

SEQ ID NO: 666545 - DNA, 861 bp, Homo sapiens
gccggtcccgcgggcatgctttgaagaggccttcgtgtcaggaagaggactgggccttggcctcccccgccgctctagggccgcagaaatagcagcgctgttttccagatcctggtgtaccgagcagcagcaaaggcggtccggtggcaggcatgtcctcctccccggaccaggccgcacgccctggttagcacccgcctcaggtctccgccattcgccggtagctcttgaccaattcggtggctcgttcccagccttagtcccgcccaagccgtgccgcatcgaagatggggtttcaccatgtgtggcagaggtttggtctcaaacttcctgacctcagaatgatccggctgttttggcctcccagaagtggccaggattataggcatgagccactggtgtctggcctgtcttcacattctgggaccagaaagaacgatttaccataagaggagactcatggaggaatgtacctgcctgcgagagacatgggtctgggctctgtcacccaggctaacagtgcctgtggcattcatcacacaggcttcacggacagtgcttcgactttcctgggtccaggggacttctcaattttcagcctctgtaataagcggggactacagggacttggcatgcatggaggacaggcggggaacctagggaggcctgattaaagatagtcccattctagtggtcttgtcacggtgcctggggcctcgcattgtgtggtgcaccttgtttctatgtaagagaccctcaacgttggtttctcgggtcctggggggggctgcagaaaaaggaacgggatggtctcacaaccctggtgtgcacacacctcagagcttgtcagatcccccaata

SEQ ID NO: 666546 - DNA, 132 bp, Homo sapiens
gagaagaccgacgaggatgactagacagcaaaaaaggaaaagttaaactaaaaaaaaaaaggccgccgtgaccttttaaccctccatttcccgtcttagaatctaaacgagggcaaccttcgagtagggagg

SEQ ID NO: 666547 - DNA, 1050 bp, Homo sapiens
  misc_feature (1050)..(1050): n is a, c, g, or t
ggaagaaccgagtccccgactcctgctgcattaatgttactggtgggcggtgggattaatctcaacgagataggcgatccataaggagggctgtgtggtagaagatgggggctggctgaggaaaaatgtgctggtggtagctgcatgcagcccttggaatgctttgtcgaggtttttgggaatagtctttgcctgaccttggctcggtagaatgagtatcacgaacgtggctacgacggtgattgtaaggggtctggtctccatcagcctcctcatctgggggagtggaatagtatcctccaggtttttcacaattaacatcggattattctgtttcagaccgactctgaaatacaaaggatagaagacttcgagagtctacaaaattatcgggcgctgcagtgcgaaacaaggggaaaggaagtggcccagggactttccttgtgtacgtgacccctagttctattctgggtctcactgagtggagtcaagatactctgaacggagatgtgcctcctagtaagctcgtattaacacttatgaataagcacgggtaacacctcctgttatatgaccttggggaaacatgaaaccttggcataatatgatttatctccacactagcagagagcaaacgagccccttcgacttgccgaaggggagtgcgaactagtctcaggcttcaacatcgaatacgccgcagggcccctgcgcctattcttggctagccgaaatacgcaaacattattataataaagagcctcagcatacatcttcctaaggacaacatatgaggcactctccctgagtctaagaccatatttgtgacagacctattcgaactccgtgctatgatcgaacagaacccgatgcggtgacaatcgtagctcaggaagattcacctcaccagatatgttggagttctacgtaatgcgtccccgctaagaaacaaggaaacacagaaagagccctggggagagaggcgtagtggcctgagagccgcccgttgacgcgcacacagaggcggaacagtgtctctgtggtacaaan

SEQ ID NO: 666548 - DNA, 152 bp, Homo sapiens
caggcggccgcccaggggacggacgctggcaaggccatgcaggacggcttcaaccgtggcgtcaagcaagcaagcgtcgactggtcgaagacgtcgaaggcggacccgagggccgacttctgggctggggtgggcggcttcttcggcaatgc

SEQ ID NO: 666549 - DNA, 300 bp, Homo sapiens
cctgaataatataaccgagatgtgcaactggtctagcaagtcactaagtaaaaaaaaaggaaggggcaggggataagaatacatcggaaccgaacttaggttgagtaccctaattttccttgacaacccatgcctgtccaatcagatgactctgggaaacgccaaacaggctgaatcaatgtcttggtgtggtttttttcttccagatagttgtttctcacctataaaaggatctatctttaaaaataaactgtattaaatctgtaacatcaaaggcagaaggtttgtgtgtgtgtgtgt

SEQ ID NO: 666550 - DNA, 318 bp, Homo sapiens
tctctcccattcatagtgtaattgttgtcatatattttgcttccacttgttataaaccacacaataattggtaattgttttgggaatggtttgcttggaagtatgcttaaaacctcccactgtgtcaaagttgcctttcccttccccaatttgcggctttaaaaaaaggcctttttggagccaaggaccacccttaagttaataatcttcttaaatccctggtgtgcaggatgaatggtctgtagttcacacaatatgaaagtcaatacatgtctaagaatgagaaaaaaaattaaaacaaatttctggagtctcaga

SEQ ID NO: 666551 - DNA, 549 bp, Homo sapiens
tttatactactgaacagtatacttaaaaatgattaacatggtgaaaccccgtctctactaaaaatacaaaaaaattagctgggtgtggtggcgggcacctgtaatcccagctacttgggaggctgaggcagcagaattgcttgaaaccagaaggcggaggttgcagtgagctgagattgcgccaccgcactctagcctgggcaataagagcaaaactccgtctcaaaaaataaaaaataaaaaaaatttaaaaatgattaagcaggaggccaggcacggtggctcacacctataatgccagcactttgggaggccgaggcaggcgatcacttgagaccaggagtttgagaccagcctggccaacatggcaaaaccctgtctctgctaaaaatacaaaaattagccaggcatggtggcatatacttataatcccagctactggtgagactgagacacgagaattgcttgaacccaggaggcagagattgcagtgagtcgagatcgcgccactgaattccagcctgggcgacagagcaagattctgtctcg

SEQ ID NO: 666552 - DNA, 81 bp, Homo sapiens
acatctgtgtacttctgtgccgtcagtgaccggcacgaggctgaagctttctttggacaaggcaccagactcacagttgta

SEQ ID NO: 666553 - DNA, 169 bp, Homo sapiens
cttccacctttcatactgcatactgatgacatagaggtttgtttgtgtcccatatcacaaagtaatgcacagcaagagagtatgaaaaggcccagccaaactgatagcagtagatatcccctgagcagcaagacaagctgaacagaagtgttcctagcccatgtacttt

SEQ ID NO: 666554 - DNA, 410 bp, Homo sapiens
  misc_feature (24)..(24): n is a, c, g, or t
  misc_feature (100)..(100): n is a, c, g, or t
  misc_feature (397)..(397): n is a, c, g, or t
atccacaatttatcctattcctanacttgggtggccagcctgccttccagattttttacttttaaaaaaatataccttaaaagtgaacctacaggcaggncatgaatgcctcatgccctgtaatgcccagcactttgcccaaggtgggcagatcaccctaaggtcaggagttcaagatcagccctggcctagatggcaaaaccctgtctctactaaaaaatacaaaaattagcttggtgtggtggtgggcacatgtaatcccagctacttgggaggctgaggtagggagaactgcttaaacctgagaggtggaggttacagtgagttgagattgtgccactgcactctagcctgggtgacaaagcaagactccatctcagaaaaaaaaaataaaagngaattacaacact

SEQ ID NO: 666555 - DNA, 979 bp, Homo sapiens
  misc_feature (979)..(979): n is a, c, g, or t
ggcatctacatcctcatcgctgtgggcgctgtcatcaggttcgtgtggcttcctggagctagctacgagggccatccaggaatcccagtgcctgctgtggacgttcttcatctgcctgggtcatcctggtgtgtctgtgaggtggtcgccggcaatctggggcttgtgaagcaaggaccagatcgccaaggatgtgaagcagttctatgaccagagccctacaggctggccgtggtgtatgatgacgcgcaatgaacgccgaaggctgtggtgaatgaccttccacgagacgctctgactgctgtggttccaggcacactggacgtgctgttggatcaccgtcagttggctcaagaacaatttgtgtccctcgggcgagcaacatgcatcaggaagcctcttctgagggaggactgccatcaggaagatcgatgacctcgttctccgggaagcatgtacctcatcggcattgctggcatcgtggtctgctgtgatcattgatcttcgaggatgatcctgagtcatggtgctgtgctgtggcatccggaacagctccgtgtactgaggaccccgcagactctggccacagggagctctggagtgccccctaagtgagccggagacttccgatggggccatcatcgcctgtgtatctaacgtttccggtattactctggctacacgtagcctctggactttggggctccgtttgtccgaacgttgctggtgcgtccagggctcacgtcacatgtaggtgggtgataattgagacggcctgggtcctgcggacggggcgggccctttgccggggtccagtggctggcgacacaggcctcctgggacatgccgaaaaccctggccctgggggggtccccccccccttggtgcacacttcccacccagacagtgccatcaccactaaacaaaaacccctaaaagtacaaagagacactctctcaatctcagaatgaataaatan

SEQ ID NO: 666556 - DNA, 643 bp, Homo sapiens
gctggatcgcctatcgccgtcgccacgtgcggcacatctttatgcccgctctgagatcgagggccaccatccaccagaccccagaattgttatccactgacatgcttgcactatgcacctgtaaaagttgcaggcagttaatgctagcctgtgaaagcagctgtggggactatatgcagagccacagaggcagagctgcccagagccttgggagcccactccttgtgtcagtgtggcctggatgtgagacgtggagtcaaagatcattttggaggtttgagatttaatgactgccctcctggattttggacttgcatggggcccatagcccctttgttttggctgatttctcctatttggaatgggagcatttacccaatgcctgtatccccattgtatcttggaaataactgacttgtaatgattttacaggctcacaggaggaagggacttggctggtctcagatgagacttgacttggacatttgagttaatgctggaatgagttaagactttagggggctattgggaaggcatgattgtgtatgaaatgtgaggacatgagatttgggaggggccagggtggaatgatatggtttggctgtgtccccccagccaaatctcatgttgaattgtgatcctg

SEQ ID NO: 666557 - DNA, 221 bp, Homo sapiens
acctgagatcagactatgctacagagctcatatgagtaggtccacaggcatgggtctaaacttagtactaatccaccttcccctggtcccacactcacagaggagccactcccggggtgacacaagcagctccgaatcaggaactgctgtcaaaatggagaaaggttctcagaactctgcattgtccacagctctccggtcagacgccgtgacgcagcgac

SEQ ID NO: 666558 - DNA, 903 bp, Homo sapiens
tcacccgggggtgagaaaaggaagtgtggggatggcaaaagaggtggacagttcaaaaacgtgcgggtgactcacacgagggcgagctcccctggtgtataagccgctcgcgcgggtgtccgtagagaacaacgggggggggcctcccaagatgagagccgtggcttcatcaaacgctgtacgccgcctcggtgtcgataaacaggagggtgcccgcccggaaaggcgaccccggacgcgcggtcgcataggtgatgccgaccgcctaggcgcgctgtagccggaggcagaaaggcacaccacgtttgccgttcggcaccatgccgccccgccccgatggggggtcgggaaagcgcccccactgcaagagcgccgcggggagaagccaccgcccctgcttgtcagaagggaagggtgaaggcaccagagacagttgtgcaggtgacacggcggtccctggcaccagaaggcacgccggtgtctagcgcgggccgcctcctcgccacacccgtgaagggcgtcctgctggagaatgggcgagagagcagcgccatgcggcctcttgccgcacacgcgggggaagccctatcgaggcaggtgcaagagaatgggggagaaaaacgctacatagcggtccgctgggatgccacagtaaaccactgatgccgttgtgttggtgaaatcggacaccacaacccttcgttcgtcttgtgggggactgcccacctggagcacctgcgacgactcccgcagatctgccctgcgctactactccgctgtcccaatagggacccctcttaatatggcaggcgatcaccatgtgagggcagcgagttgccgccatgggcaagagtttaacggcgctgtgcttccaaaaaaaacaaagccttctcaaacaaaaca

SEQ ID NO: 666559 - DNA, 539 bp, Homo sapiens
catcatcggcgcagtgggcatcggcatccccgtggtcatgatatttggcatgatttcagaatgatcttgtgctgtgctatccgcaggacccgcgaaatggtctagagtcagcttacatccctgagcaggaaagtttacccatgaagattggtgggatttttggttggtttgttttgtttggttggttgtttgtggtttgtttttttgcccctaattttagtattcattcggcattgctagataaaagctgaagttcctttatgtttgtcttttaaggcttcattcaaaattgccatttgtagttgagcggggggtttggtttgctttggtttaaattttttcagtggtttgttttggcttgttaaattaagcagaaatcctgcaatgaaagggcctatatttggtagcctttagccaagatattggacataaaagaatttttttgtttttaaaaaaaaccaaatgtctatcccctttaatcaagttgtaacttatattgaagccaatttgatacataataaaaaattatgccaatgtca

SEQ ID NO: 666560 - DNA, 188 bp, Homo sapiens
  misc_feature (173)..(173): n is a, c, g, or t
ctacatcttctccattacaccgtaggcaggtgtttcctctatcttaggggccatcaagtttcatcacgaaacaattatcaatataacaacccccgtggccataacccaagtgggtgatcctcctaagagtcgagcctggcagagctatgcagaggcttgggcagctgggccgntcggttattacaatc

SEQ ID NO: 666561 - DNA, 145 bp, Homo sapiens
cgtgaaccggccacacaggcacttctaaactggaaactttcatcctggctggtatggtgtggccaatccattcatctgaatgttctggccacaggcatgggggtggaatgggaacaaagtttattcataacatttggaaattcac

SEQ ID NO: 666562 - DNA, 349 bp, Homo sapiens; identical to SEQ ID NO: 627911

SEQ ID NO: 666563 - DNA, 210 bp, Homo sapiens
  misc_feature (92)..(92): n is a, c, g, or t
aaaagtggccattttcgttggtggtgttcagttgtggcggttgctggtcagtaacagccaagatgctgcggaatctgctggctcttcgtcanattgggcagaggacgataagcactgcttcccggagcattttaaaaataaagttccggagaagcaaaaactgttccaggaggatgatgaaattccactgtatctaaagggtggggtagc

SEQ ID NO: 666564 - DNA, 478 bp, Homo sapiens
aagcagtatacagactcataagtaatttattaaaataatggatctaatactcttacacttaaaatagtctcaaagattagttgaactataagacaataaaaaaatttttatgagtacctctgcacgtgacattcagtgacatactaaaaggtatttgtaatattagtgctaggtagcacatttaatatatatatattttgtttgtttaagagatgaagtttcgttgttgttgcccaggctggagtgcagtgccgcgatctcggttcactgcaacctctgccttctgggttcaagcgattctcttgcctcagcccctcgagtaactgggattacaggagcccaccaccacgcccagctaattttttgtattgtatctttttaagtagagatggtgttaaaccttgtgggccgggctggccttgaactcctgacctcaggcaatcaacccacctcggcctcccaaagtgctgggataaca

SEQ ID NO: 666565 - DNA, 314 bp, Homo sapiens
tctacaaaaaaaaaaaaaaaacgaaaagggacaaaaatttagccaggcttgggggtgcttgcttgtatccccacccatttggaaggctgaggcaggaggatcatctgacccggcggtttgaggttgcagtgaaatgaatttgtcccattgcttcccagccttggggatagagtgtgagactttgttctaaaaccttaaaataggataaaggggttaaaaattcaagggaaaagaattattccattaggttgtgaaattccttgaattccatattgtttggcttctaacattaaggttttggttgggaaccacag

SEQ ID NO: 666566 - DNA, 107 bp, Homo sapiens
ttctacagtgctgtgtagatgttgggactagaagggtcagtcgaagatctccccagtgtgcctgtaaggactattatccatagcctatatataaagcagagtcatct

SEQ ID NO: 666567 - DNA, 99 bp, Homo sapiens
  misc_feature (6)..(6): n is a, c, g, or t
  misc_feature (49)..(49): n is a, c, g, or t
  misc_feature (74)..(74): n is a, c, g, or t
atcttnatggcccaacattggttgtgggtagcgacaaaaaaaacaaagncacatgctgcctactgacttctggnaagttcctggtccacaacatcaagg

SEQ ID NO: 666568 - DNA, 204 bp, Homo sapiens
  misc_feature (16)..(16): n is a, c, g, or t
  misc_feature (66)..(66): n is a, c, g, or t
  misc_feature (88)..(88): n is a, c, g, or t
  misc_feature (203)..(203): n is a, c, g, or t
ggttccatccacgccnctaaggcccgttttttcccttagcccagacccctgttgatagcccagatncttgagggcaaactgtttgccncctcctcttgaaaatgattaggcccttagggacagtaaagctgtattttctggaaggaagactgtatcttctggaatagttttctagaaaactagtcatatacaataaaagtatnc

SEQ ID NO: 666569 - DNA, 222 bp, Homo sapiens
tgataaggaccatgtgtgatatgtaaaaatggaggagtagggacttggggccagccaagtagtccagaggtccagcttccgtgatgagtaacatggttcgtcctctcaaagagatttctcctagtagatatacttttccctctggcctaaaaggccaggctaacaaggctttaaaggcccaaaagaggaagaggtagttgaggccttcaggtggacctccat

SEQ ID NO: 666570 - DNA, 321 bp, Homo sapiens
  misc_feature (195)..(195): n is a, c, g, or t
ttaggcagggtcttgctctgtagctcaggctggagtgcactggtcaatcttggctcactgcagcctctgcctcccgggtcccgttcaagcaattctcttgcctcagcctcttgagtagctgggattacaggaacgcaccactatgcccagctaacttttgtatttttagtagagacagggtttcaccacgttggnccagactggtcttgaattatttaccttttacaatagttcagggactgtggacagggagatatgggggggaaaatataccttcatcttcctattttgtttccagactggattgtcttgcctgtttct

SEQ ID NO: 666571 - DNA, 328 bp, Homo sapiens
  misc_feature (157)..(157): n is a, c, g, or t
  misc_feature (176)..(176): n is a, c, g, or t
  misc_feature (240)..(240): n is a, c, g, or t
ctaacttgaatttcaaaagaaggataataatggaaatgcccggaagcttcaacatgtagttttaggctgggcacagtggctcatgtgtataatcccagcactttggctattattattaacttttaaaaacgtatggtcaccatatcccactaatcantttcccactctttcaaagntttttttaaattccacgctcaaacatattagagatgaaatcgcacactcacagactaaagaagnctatattcctatgttcgagaaaatgtacaaatattgattctggttttttttgtttcttttttttttcagatggagtcttgccgtctcg

SEQ ID NO: 666572 - DNA, 189 bp, Homo sapiens
taaacccgtctttgcgtctcgctcctgaatcgtagtcgacgttgagcatcactagactgatctatttaaacactgagtgggtgtggcagcgagagtcagtatatgggtcctatcctcctataaaggggtaggacagtatgactttggggcaacaccttcttacgcctccagtgtggcctatatagaatt

SEQ ID NO: 666573 - DNA, 130 bp, Homo sapiens
tagaggatacccgtaacagcgcaccaatgaaaatgaaaaattgcgatcctgatataaaccattctagagcgctcgttactggagggcgctcgttactgtgagggcgctcgttacggacggcgtgttacgt

SEQ ID NO: 666574 - DNA, 173 bp, Homo sapiens
tgctccttgtgcatgacatccacagcttttggagttatcctcttgaaatctcaatgtcacttggcacagtgggagagaggctgacgtatcaagcagtgaagtctccacctgctctgtgcttgctggttcactgaatgccactctcctttccactaactggacccatgttcttg

SEQ ID NO: 666575 - DNA, 791 bp, Homo sapiens
tatcgtttagaatgtaaagaagttttaagctaaattgagattatgtatcttttatttggtgctcatccttggtgctcttgtgatgcctgtccataacacttccatgacattttataatttcgtgtttctctcccttacaagactgctgtgattgctttgaggggtgaatacggtgtcttaaacatctctgtaaatctccaggaaataatttgcattcagtagatgtttgctgaatgactatgtaaactagaaggttaataaattggttgatagtgcaggtacaccatcccagtagctaaaatatttgtatataccatccagggcatccctttcttataatgcaggtaattaggaaaccaattttataatctaacaatgttgtgtatttagagaactggactagaagcattttagattattttaagagctgttttatttagtctctaaaaacaggacaaattttgataagttattccagtccacaattgactaagacaatggcagattcttatggtctaatccccttttttctgggcagcatagagattgtaccctgtattcttcttgcaaatgaaatagcagtaaataaaagattttatttctcttttgtgaactcaaaacatcagtaaattaacagatgaaaatcatgtcttatggattcatagtggtggcaaagagttggtgagcatgttcagtttgtgaattaaatattattttttaattcacagaccatagttgaacttgcagagacaggaagttgtggacctcagtatattctggagtactgttgg

SEQ ID NO: 666576 - DNA, 165 bp, Homo sapiens
tcgaactggcggaagtgcgagaaggggaaccggggctcgggcagctcccgaaggaagagcttcagggctccggtgataacgtggacgtcctccaagcgcccgtcatccaggtcaaggcgctcatcgtggtccaccttatagcgtagcttctggatggtggtcagg

SEQ ID NO: 666577 - DNA, 263 bp, Homo sapiens
  misc_feature (131)..(131): n is a, c, g, or t
gccagctgttcggcattgtcgaccgggtggaattttgccgtcggaatgccgatgccgttcaggaaactcttttgctcacgcggtcctgcgcgacttcgagggctcgggccggcggatggaccggaacgcgnccggccagcatctcggccgctccgaccgggacgttctcgaattcgtaggtcacgacgtcggaggcggcggcgagttcggcaagcgccgcggcatcgtcataggcggcgacgatactgccggttggcgacctg

SEQ ID NO: 666578 - DNA, 518 bp, Homo sapiens
caaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaaattatgaaagaattttcattttgcttgaagaggtacaaggatctatgaaagtcaagagacaatttgttgaatttaccatcaaggaagcagcaaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaaagggagctgtttaaatttaataaatctctgttagtaaaagctgcaaa

SEQ ID NO: 666579 - DNA, 155 bp, Homo sapiens
taaactttgtttggtagagacagagtctcgctcgtgttgcccgaggggggcagatcacctgaggtagggagttgagaccagcctgaacaacatggagagacccggtctctactaaaaataaagatactgtaggctgctgcagtatcacaaccggg

SEQ ID NO: 666580 - DNA, 511 bp, Homo sapiens
ttgatactatcttattctaacactttcttccaataccatggaggcttccaaatttatcaaaatctgggagtgtatgtgggccctcagttgactcactttgtatttttctagtttgtatctttcaatgaggatgcattttctgtttgcatgtagatggtaaattctattttgtatccactctacctcttacatctcatagatcctgtaggtatcctctggtgaatggaatacctctttaatttcaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaaagggagctgtttaaatttaataaatctctgttagtaaaagctgcaaa

SEQ ID NO: 666581 - DNA, 458 bp, Homo sapiens
tgctgaggtgatctagaggatcccgagctctctctgttggggacacatgggcagatgtgactgtgcctgtcactgaagtggggaaaagagggctcctgagggcccagtgaaccgccagcaaaccagcctaccacacccaccagaggcgtccaaaaggcctgatctcacccacagaggggggcaggagaggatcgctgtgagtccaggtgaaggagtcagccctccccaaccctcacaggcaaacttttactgctgccgcaggcttcctgagctaggatccccgattttgcgacctgtctcctcagcactaggggcaccagcaccaggcaggaaagcaaagaaaaactcgcagagtccatggggatgggcagggagggctccaggaagcgtcacatgggcacccagaaggcaagatgacacgggggtcttaggaatcgccaattgtgtacggagctcga

SEQ ID NO: 666582 - DNA, 321 bp, Homo sapiens
acgtagtgacaaattctcaaaattatgtgaaggcggtttatagtagaaaaatgaacattaaatgatctggcaacagctctggaggacagctccaattgcactcaccctcaaaacatctgtggcattgtgttgtgtgacaaaagtgcacattttagcctggccttgaattgtccccagcacaaggtacacctctgtaatgatcatgctgttttatcagcttcttgatatgccacacctgtcaggtggatggattatcttggaaaatgggaaatgctcacgaacagggatgtaaacaaattagtgtacaaaatgtgtcgacgc

SEQ ID NO: 666583 - DNA, 167 bp, Homo sapiens
gtctgacgattgtcataaataaatttgaaacgcatggactgcatccagtgtcacggcataaataacgggtaagatttgtctaatcagatgaatcattgctcaaatataattctacgactcgaagagagggaactaaaactcggacagcgtttcgtgaatctttcgtg

SEQ ID NO: 666584 - DNA, 108 bp, Homo sapiens
acagcctcgtgggttcgccagtctgctcgggtctggccccaccttgttggcttctacttcctcactcgtgttactccgagtaccttgaggatgttctggaagagctga

SEQ ID NO: 666585 - DNA, 152 bp, Homo sapiens
tatactaatactaagaactccccaagacatggagacgctccatcatggagtactttgaagaagccatgacctactatgctcagtcatcccgtaggtacaacggtccacggacgttgggcatgcttggaatttccaaacgggggtgcagctct

SEQ ID NO: 666586 - DNA, 103 bp, Homo sapiens
atatatagtaatcgcagctggttacagtagtatcccttatggggtaggtatacgttccaagacccccagtggatggctggaaccacggatagcaccaaaccct

SEQ ID NO: 666587 - DNA, 422 bp, Homo sapiens
gaagtcacgcacgcgcaacccaggccacagcgagtaacaatctctctgccgagtcttgctgggtaagggatgaatgtgcggacgcccgtggctgctggactgggagctgggaatgactctttgaaatgcctgcggctgctgagagacgcagctgagccgcgtataatatcacgttccaagcttgtaggctgatgtgtgtcgtgctcgtatgccagaaggcagtcacgctgcagagacatgctgcattgtaactcgatgccaggaaagtagagcggttcctcgccccctacgggaggcaagaccttcacctgcgtatctttgacccaagcccggaggacatagccagggcggacaacatcttcacggccactgaacggaaccgcatcgactacgtcagctccgcgtccgtatcgaccacgccc

SEQ ID NO: 666588 - DNA, 864 bp, Homo sapiens
  misc_feature (38)..(38): n is a, c, g, or t
  misc_feature (84)..(84): n is a, c, g, or t
  misc_feature (86)..(87): n is a, c, g, or t
  misc_feature (89)..(90): n is a, c, g, or t
  misc_feature (94)..(94): n is a, c, g, or t
  misc_feature (96)..(96): n is a, c, g, or t
  misc_feature (99)..(99): n is a, c, g, or t
  misc_feature (102)..(102): n is a, c, g, or t
  misc_feature (105)..(105): n is a, c, g, or t
  misc_feature (107)..(107): n is a, c, g, or t
  misc_feature (113)..(113): n is a, c, g, or t
  misc_feature (122)..(122): n is a, c, g, or t
  misc_feature (130)..(130): n is a, c, g, or t
  misc_feature (140)..(140): n is a, c, g, or t
  misc_feature (143)..(143): n is a, c, g, or t
  misc_feature (146)..(146): n is a, c, g, or t
  misc_feature (164)..(164): n is a, c, g, or t
  misc_feature (174)..(174): n is a, c, g, or t
  misc_feature (218)..(218): n is a, c, g, or t
  misc_feature (221)..(221): n is a, c, g, or t
  misc_feature (234)..(234): n is a, c, g, or t
  misc_feature (241)..(241): n is a, c, g, or t
  misc_feature (246)..(246): n is a, c, g, or t
  misc_feature (248)..(248): n is a, c, g, or t
  misc_feature (251)..(251): n is a, c, g, or t
  misc_feature (284)..(284): n is a, c, g, or t
  misc_feature (286)..(287): n is a, c, g, or t
  misc_feature (301)..(301): n is a, c, g, or t
  misc_feature (306)..(306): n is a, c, g, or t
  misc_feature (308)..(309): n is a, c, g, or t
  misc_feature (311)..(311): n is a, c, g, or t
  misc_feature (318)..(318): n is a, c, g, or t
  misc_feature (321)..(321): n is a, c, g, or t
  misc_feature (325)..(325): n is a, c, g, or t
  misc_feature (329)..(329): n is a, c, g, or t
  misc_feature (342)..(343): n is a, c, g, or t
  misc_feature (346)..(346): n is a, c, g, or t
  misc_feature (350)..(350): n is a, c, g, or t
  misc_feature (354)..(354): n is a, c, g, or t
  misc_feature (361)..(361): n is a, c, g, or t
  misc_feature (370)..(371): n is a, c, g, or t
  misc_feature (379)..(380): n is a, c, g, or t
  misc_feature (393)..(394): n is a, c, g, or t
  misc_feature (397)..(397): n is a, c, g, or t
  misc_feature (409)..(409): n is a, c, g, or t
  misc_feature (419)..(419): n is a, c, g, or t
  misc_feature (423)..(423): n is a, c, g, or t
  misc_feature (434)..(434): n is a, c, g, or t
  misc_feature (449)..(449): n is a, c, g, or t
  misc_feature (452)..(453): n is a, c, g, or t
  misc_feature (475)..(475): n is a, c, g, or t
  misc_feature (485)..(485): n is a, c, g, or t
  misc_feature (532)..(532): n is a, c, g, or t
  misc_feature (535)..(536): n is a, c, g, or t
  misc_feature (650)..(650): n is a, c, g, or t
  misc_feature (860)..(860): n is a, c, g, or t
gggaaaggagaaagaaatatacaaacaaatgacaggcngcctggtgaacatggtgaaagcctgcctctactaaaaccacaaaantnngnntggngnggnggnttncncctgtnaccccagcnactcaggngggtcagggntgngtntcactgaacctgggaggnagtgtttgcngtgagcagagatcacgccactgcactccagcatgggcgacagantgngactccatctcanacaaagnaaaananaancaaaaatcaaaatagaggggggggggtgggttngnngcggtggctggggngtggngnngnggtgggngtncatnagtnggtgagtgggaannggngatntggngtgtgtncgcggtggnntggtattnngggcttaggggtnnggncttgttatttgngacaacattnatgngcctgagaganattatactaagtganatnngtgaacgcgggaaaggacaganaacataatcntttttttttttttctgaggtggggttttgctcttgtgacccaggctnganngcagtggcaccatctccactcactgcaacatctgcctccaggctcaagagattctcctgcctcagtcacacgtttctacactcaagaagaaagtattacacagctggtgtgtanagactgggaattcagggtattatcttagaacgttgtctacccacataaataaacttttaaaatagtcttttgcctgtcacagtggctcatacctgtaatatcagcactgtgggaggctgaggcaggcagatcatgaggtcagctgttcgagaccagtctggccaacatgatgaaacccgtctcctctaaaaatatgaaaattagtcgggngtgg

SEQ ID NO: 666589 - DNA, 143 bp, Homo sapiens
gctcggtaccctctatccattatccatccatccgttatccactcacccatccatccatattcattcattgtacttaagaatgagctatataaaagtgaaaccacgggagttctagaagaacatatagatggatggatggatgg

SEQ ID NO: 666590 - DNA, 261 bp, Homo sapiens
ccccatcgcagcttgagtatttgtcggtttctgacagaaacatctcactggggagaatcttcatcttggccagctttgctgcttcttgtacctgtttcctccggccgccctcctctttcttcttcctcttctcctcttcaacccgtctcttttcttctctctctttcaataaagggtgtacctgtctaccagtatcaccactgtggccagtccttcgtggtcttcaaaccgcaccccaaagcttagggtacccgagctcga

SEQ ID NO: 666591 - DNA, 1312 bp, Homo sapiens
  misc_feature (181)..(181): n is a, c, g, or t
ttgggatctgcacataagtcttaaatataacccctcaaattgcataggtgacctggctgatacagagagacgaccataagatcaagtatgagtaagtcatgtacctcagcattcgagaagcttcaattcagaggtaaagagtggagttgtaccttgcctaactatctggctagtagggagngagaggtagtgacatgggaatacagactcattagtatttgtattccttgatgaccataggcgcaggagatctggctgtcacttcacttatgtgcagctccttatctacgtctgtgaaatatttctgcgaagcgtaccagagaaagtctcttctacacggttggtcgtagatacgtgttctataagcctagcgttagttcaatttagtcagaaaactactcttaggaccaagtcgcacgaagcacgagacacttaaattagaagacatcaactgttggcgtattttgagtagccccgtatcacgctaggcatatgtgcccacgatgtaccattctggtatgtagcgccgttgctaacgctccaattcgtgcttaggaatttgtaacaaaagtatgtctgcgctgcgcacgtttccagtgcatgatgtgtagggttaagacgcaagacgacaaacgtccgagaaaatataacacggtatggctccatttgttatgggctacaagactatttacgcacgtattaagagcgcgtaaggcgtggcacaaaaagaggtccgcaacgaagagggacgcagtaaaccctcaattgtactttatcttttccttagttagccgtaactgaaaacgtgggcgatggttaataacggcttggcgaaaaagggaaggtataacggtggtatgaagcatttcctgagggaggcccctgttctctagaaaccatcatatgggacttttcgccattataagttgcaagaagatggaggcggagctctaaaacaggtaggtgtagcccatttgggatgcccggccctgttgaggaaacaatccagtggaaagaactcggcaacaatagcttacaagaaccaaacagcaattgggcccgtttattacatccctgtgtttcctcgatggatatcgtgtaagcacgggactagccccatgccaacaacccatggtgtggggaatcttgcacagtggcgtgacgttcacgctttaaatgcgctctcccatttaaaccctgactgaatgacaattagttaaagtggtgcacaggttacacgaggctataccggacaataccgtatttggccagcaataaaactaagcagtgcaatggttacactcatgtttcg

SEQ ID NO: 666592 - DNA, 185 bp, Homo sapiens
  misc_feature (153)..(153): n is a, c, g, or t
ccagattaagatgtcagcacgtctcgactccatcgtggtctgcgccggcggaaatccggccactttctcgcatccacccactctctcttatttgcggagcacggcgcggcatggcgtccggatgatcggcgtctcagcgggtcccttcatccncgcccaggctggcctgctcgacagctatcgcc

SEQ ID NO: 666593 - DNA, 462 bp, Homo sapiens
agctttgggttcaaactgggtatcttggccctttaagcctcacactcacgtagtatcttttctgggacaacagtctatattgggtgggcctagggaaaaggaactgataaacatattctttaaaaatgtggttcatttcactttcctaagttaggcagtgtagcagggtataaaggagccaggatacagggcttcaacatccggctttggtccacttcattctcgatccagcattggcaggcaagtttcctcaaccggtctttctccattttcattcatctgtgcacaggggggctcagtcatagtcacctatggcagagagctttcacacagggttcaacgtcagttaatcacacattcaagcctttggaatcagcacgtgttcgcatcacatattcattcaacacatcaaaattggcagttttgatagcacatccatcattcaggtcacggcagctcggg

SEQ ID NO: 666594 - DNA, 161 bp, Homo sapiens
attgctgcttcgatgacgcaccacagtcacagcaatgcaggattcgatccacatccgtgacctacaccacagctcagacaacaccggatccttaacccactgccgcgaaggccagggattgaacctgcatcctcctggataccaggcaggttcattaccac

SEQ ID NO: 666595 - DNA, 987 bp, Homo sapiens
  misc_feature (52)..(52): n is a, c, g, or t
  misc_feature (96)..(96): n is a, c, g, or t
  misc_feature (100)..(100): n is a, c, g, or t
  misc_feature (112)..(112): n is a, c, g, or t
  misc_feature (117)..(118): n is a, c, g, or t
  misc_feature (158)..(158): n is a, c, g, or t
  misc_feature (176)..(176): n is a, c, g, or t
  misc_feature (180)..(180): n is a, c, g, or t
  misc_feature (184)..(184): n is a, c, g, or t
  misc_feature (186)..(186): n is a, c, g, or t
  misc_feature (210)..(210): n is a, c, g, or t
  misc_feature (213)..(213): n is a, c, g, or t
  misc_feature (235)..(235): n is a, c, g, or t
  misc_feature (258)..(260): n is a, c, g, or t
  misc_feature (273)..(273): n is a, c, g, or t
  misc_feature (280)..(280): n is a, c, g, or t
  misc_feature (287)..(288): n is a, c, g, or t
  misc_feature (324)..(325): n is a, c, g, or t
  misc_feature (363)..(363): n is a, c, g, or t
  misc_feature (441)..(444): n is a, c, g, or t
  misc_feature (446)..(448): n is a, c, g, or t
  misc_feature (453)..(453): n is a, c, g, or t
  misc_feature (462)..(462): n is a, c, g, or t
  misc_feature (464)..(464): n is a, c, g, or t
  misc_feature (958)..(958): n is a, c, g, or t
tctcacaaatattcacacatacgaagggttctagactcaagcagccccagangtaggaaggggcctttttttggaatgtcagttttagaaaagttnaaangactttattttncacannaaaatattaataataatattatcaataataataataaacnatgcaacataataaactntttnagangnctctgcaacatcctcttcccaganttntaggggcacattttatttcctngtttcacattcattttcagtctnnnagagaggcttctnctgtacnactcttnnctggcagagtagttcccagctcccagaactcaactnncccctcaccctgccaagcatggcttggcttggcctttnagaggaaggccctcccgggtctctgagtctctctttttccttggactcaatttccctgctcactcctgatttgtcaannnnannnccttncctactttntnccctcctcttttgccctcccccaaccccacggtggaagtgggtgagcagtcattctggccctcagtgaatgggcacgaaagatgagggagagtgtgtgtgtgttaccgtgaccaaaacactgcactatctggcagtcagagggtgctttcgctgggtatcgggagttggggacaaagaaaggaaatccaggctgtcttccagcagcggcagtagcagaggcggaggcggccgagccgggcctcatttgttagcgggtgtcgaggtaatggtcgccaccgaggcccgtcttctcctcggcagaggaaacaagacagatgggcctggacctggcgtgattaaagatgaaacgtggatccatcttcgccaaagctgaaaacgaggagctgcagcctcctcctaatttctctttctggtctttttctttcttccttcttcttgctttttctttttcttttttttaagaaagaaagcaagagatttgaatcttgcttcnggggggggcctccccgtggccctctattg

SEQ ID NO: 666596 - DNA, 631 bp, Homo sapiens
  misc_feature (395)..(395): n is a, c, g, or t
ctctctctctctctctctctctctctctctctctctctctctctctctctctctctatctctctctctctctctctcctaagataaaaaatgccctaacccacttcttaccacaaggcacacctacaccccttatccccatactagatattatcgaaaccatcacgcgactcattcaaacaataggcctgacccgccgcctaaccgctaacattactgaggccacctactcatgcacctaattggaagcgccaccctagcgatatcaaccataaagcttccgtctacacttatcatctccacaattctaattctaccgactataccagaaatccgctgtcgcctattccagccctcggtttcacactttagtaggccttacctggacgacacccnttttttattaaaaaaaaaaaaaaattgggttgtgggaagggggggggggcggccccacctccttcattaatctgggggggggcccgggccccacattgccctaaaaaggaggggtaaaaaaaaacgggccgggcttaaaaaagtggggaagggaaaaaccctggcgttcccccctaattacggttggaacccccctttgccccttggtatatacggggccgggcggggggccgttc

SEQ ID NO: 666597 - DNA, 341 bp, Homo sapiens
accgctcagtgcgtgattggcggcgcgcgagtgatcaacgagatacaggacccggcggccaacgaccgcatggacgatgccgagtggtacaacatagtcacgccgattctcgatggcatttccctggtgggtgtcggcggttcggcgctgaccactctcaggctgctcaaggccagcaaggcggcgaacaccggcaaaagctggatgcagttgctcaagggcctcaaccgccaggaacgggccaagctgaccaaggaactgttgaccctgcgggacccgagcctgacctccaagctgctgaagctgcaacagcgtgccggtgcgtcgcccaggcgctgttc

SEQ ID NO: 666598 - DNA, 433 bp, Homo sapiens
cgactccacatatctccattcctggtaccagacatgctaaatgtggctagagaaaacactcaagcatgctgatgggtctcactttaaatgcatgtctaggccaggtgcagtggctcacacctgtaatcccagcactttgggaggccaaggtgggtggatcacctgaggtcacaaatttgagaccagcctggccaaaatggcgaaaccccatctctactaaaagtacataaattaggctgggcgcggtggctcacgcctgtaatcccaggactttgggaggccaagacggaagatcgcttgaatcccaagatcgagaccaacctgttgcaacatagtgagactctgtctcacaacacatatatacacaaaaaaccccaagaaacctagctgggcgtggtggtgtgagctttgtggtccccagcttactggggag

SEQ ID NO: 666599 - DNA, 191 bp, Homo sapiens
acaaaaacaaaaaccccccaaaacaaaaccaaatctggaggcaccacattaccagacttcaaactacactacaaggctatggttacccaaacaacatggtactgtatcaaaataggcacatagaccaatggaacagaatagagaacccagaaataaggccaaatacatacagcgactagttctagatcgcg

SEQ ID NO: 666600 - DNA, 751 bp, Homo sapiens
  misc_feature (20)..(20): n is a, c, g, or t
  misc_feature (67)..(67): n is a, c, g, or t
  misc_feature (131)..(132): n is a, c, g, or t
  misc_feature (135)..(135): n is a, c, g, or t
  misc_feature (161)..(161): n is a, c, g, or t
  misc_feature (186)..(186): n is a, c, g, or t
  misc_feature (216)..(216): n is a, c, g, or t
  misc_feature (231)..(232): n is a, c, g, or t
  misc_feature (293)..(293): n is a, c, g, or t
  misc_feature (295)..(295): n is a, c, g, or t
  misc_feature (300)..(300): n is a, c, g, or t
  misc_feature (315)..(315): n is a, c, g, or t
  misc_feature (320)..(320): n is a, c, g, or t
  misc_feature (326)..(326): n is a, c, g, or t
  misc_feature (352)..(352): n is a, c, g, or t
  misc_feature (414)..(414): n is a, c, g, or t
  misc_feature (423)..(423): n is a, c, g, or t
  misc_feature (545)..(545): n is a, c, g, or t
  misc_feature (548)..(548): n is a, c, g, or t
  misc_feature (551)..(551): n is a, c, g, or t
  misc_feature (553)..(553): n is a, c, g, or t
  misc_feature (561)..(561): n is a, c, g, or t
  misc_feature (581)..(581): n is a, c, g, or t
  misc_feature (608)..(608): n is a, c, g, or t
  misc_feature (617)..(617): n is a, c, g, or t
  misc_feature (637)..(637): n is a, c, g, or t
  misc_feature (643)..(643): n is a, c, g, or t
  misc_feature (747)..(747): n is a, c, g, or t
gaatgcaattcattcatagnaacggaaatgcaaccatagcatggagacgctctgagaaaagatccanacccacctcatctcccagcccttcaagcagagctataaaaacaagtttgggagaaaaacacatnnccntccccaaagcagaggccccgcctganctcccccatcctcagcatctggggnggaccaggtgggacgaaggggatccaaggnccagggtggccaggnngcccagagctggggcaattctttgtaaactccaaggtttcataggtatgtgtgtgcatgantnacacngaacttgcctgaagnctggncggaancttagaagccagccctgggtcctagngcgaggctaggactgggcacgtagagggaaacagcacatcccttcctgaagcccctttctanggtaggcantggggtgcccacagctatggaggcagaacgggctgaactctgtatcatccctcctttgcccctggacattcttgggcagtgtcaatggcactgaaaggccaccagctggggtttggcaagantantgncntggcattnttttttttggtttttttttntccctccattcctggtgctggcatcantctgggagntgatgggatgaagaggtganctctgnattcagtctcttgtatcagaaggcgggtctcaaattggggtgagcgcattgctaaagagccagctctcgagcacaggtcatgagggatgagagtacgcactganccat

SEQ ID NO: 666601 - DNA, 463 bp, Homo sapiens
  misc_feature (147)..(147): n is a, c, g, or t
aaccccctttaagcagaggtgcaggatatgtcaataggtggatgcagatggaacgggcccttgacttccggagttcctgtccatgatggcaaaaagatgaagggccagccagtgaggaggagaccgaaaggcgttccgtgtctttgncaaggatgggaatggctacatcagcgccccaaagctgggtcccgtaatgacgaacctgggggagaagctgccccattaggaggtggattagatgatcagggaggctgacatcgatggagatggcccggtcaattatgaagagtttggacagatgatgactgcaaagtgaaggccccccgggcagctggcgaaggccgtttttttgatctctctcttttcgggggggccctcttttttcaacactcccctggggaccccggttttagcaaacccccattgattggctgagaatttgataaagcccccaaagatttga

SEQ ID NO: 666602 - DNA, 171 bp, Homo sapiens
atgggcccgcgttcagccctattttttggatgggaacgacgacgacttgttcctgtgactttctaccccacttatcctggacgagcctgtgggaaactaacaccctttacttgtaccttacacacgttactaccacgacacacactacgacactacacactgttaactacc

SEQ ID NO: 666603 - DNA, 109 bp, Homo sapiens
ctgagatggtacagcagattacttccatcagtattgagcgaggagtgggggtggaagtcagcatgggagatgttaagtcaatattttaataaatggatgagcagttgtt

SEQ ID NO: 666604 - DNA, 1622 bp, Homo sapiens
  misc_feature (1301)..(1301): n is a, c, g, or t
  misc_feature (1427)..(1427): n is a, c, g, or t
taaaaaaataaaaaaaacagggacttttcccgctacccaagcgtgtgttaaagccgcgcgcgtgatacgtggtttccgattatgtgtgtgccacagaagcagcaacgagaaagtgtggacagagccgcaagggttacaacgtttaagaaggttattctcttaaaagaaaaaagaaacaccatagggaccgtgggttcccattatgtgcacctttggagccattttctacagcatgtggcgatctctaagaagttaaacccacccaattatgtggcaaacaattcaaaattttttaaaattttaacctataaaagagtctcgtgaaaatcacatatattttctcaaaacacactgtgatttgtggtaccattgtggttctcattacacacacaaatatatatgtgtgaccgtgactatattccagagccaccgagagaacgcgggcattcctctcttgtgaaacaccagagggggtctcccctcctatagagatgggggggagtgagcggatacggtggtagacgcgcatattattatcttagacaagcttctcacctctccacacacttatcaaccatgagagaaaaacccccaaagggtggagaatcttaaaaaaacctctccaactgtggaaacacagacaaattagaaaccgagagtagtggggtctccgaggaggaagggaacacccaggtgggagaccggggggaaatctggtggaagcacctaccagcgtaatataaccagacaaaacggggctgcagaagggaacctacctaccgaggaaatcacacgacaccattttgtgcgacagacaaccccgggtccccccccgccattggttgtgcctctgggtaggacccccccaaggtgggggctactctttgacaaaccaagactgggtgccatattactccataaaatgcacccaagcgctaatcggtgttgtgttgtcaacaaaccaaatacagacacactccgcgtgggtggaagaccaccatgcccgaggcacccaggcagaacacgccttttcaataaaacaaacctcacggcgggggcgcctcgtggtaacacatatgttagcacatcatcacatcgtgggcacagccaaccatccattacaagcagcaaagagacgagggtagcgcccataagtacaaaataccactggaggattggggacagattaacaccacctggtggtgcgacaaccaccccgaacgagggggcaacacacactcacctgcttcacacaacagcggggggagccaaactgatcaatgtgggtcgcccacaaaaanagcctgtcttggtgcctacacaccaccaccgtcagtgttgcgtagacttttgtgagcgcacccgaagtattacgctatatagataaacaagccgctctcctacaatgtctgtctgcgcccatctcnacttagtccagctccaaccacaaaagaggatcgatccggggcctatcaaacaatatccaaacaacaccgggctgccacaaaatgtgtgctcgactccgtcacactcaaacaacgccagaagtaacactacggcgagcagacaaagctaaatatacgtccgttgatgaactcctccgacaaatcgaaacacgagtg

SEQ ID NO: 666605 - DNA, 368 bp, Homo sapiens
  misc_feature (226)..(226): n is a, c, g, or t
  misc_feature (340)..(340): n is a, c, g, or t
agactccatctcaaaaacaaaaaaaacaaaaaaaaaaagcaaaaacaaacaggtgagattcattttgataaaatagctgatttaacctaatatacctaaaacatcataattttaagataatcaatagaaacatttttgcaagattttatgttattttttaccatacgacgtcttggaaatcttggtttggaccagccatgttcaactgctcagtagccatgtgtgnccaagaggggccgtattggacagtgcagatggtgcatgagggtgttccgggcagtggggaacagcagtacagaggccctgtgggggcaccatgcctgctgctacgggaacagtnaggaacccccgtgttggcttgcaattgg

SEQ ID NO: 666606 - DNA, 126 bp, Homo sapiens
  misc_feature (5)..(5): n is a, c, g, or t
  misc_feature (93)..(93): n is a, c, g, or t
  misc_feature (120)..(120): n is a, c, g, or t
gaaanaatcatgctgtttcatttaaaactttctacttttcacaagaaaaagtcacacaattaatcaacatgtatattttctctatacataaanctctatttctctacggttttataaaanccttgg

SEQ ID NO: 666607 - DNA, 227 bp, Homo sapiens
  misc_feature (13)..(13): n is a, c, g, or t
  misc_feature (110)..(110): n is a, c, g, or t
  misc_feature (195)..(195): n is a, c, g, or t
  misc_feature (197)..(197): n is a, c, g, or t
ccttttgaagaancgactatagactccaatagaactccttattagtctgctttctgagcaggtgtaataatatgctctctatgggaactacgtagtcatttgttcaaccnacaattaaggaggcaccactcatagttggttacataattggcagatatcttccagtcaggattattttagaggccataaagaacnanatggttttgctataagtacattctccgttt

SEQ ID NO: 666608 - DNA, 1144 bp, Homo sapiens
aattttattcaaaattaaataatttaaatctagcatttaaatttaaactaatttaagtctagcatttacttttaaactaacttataatgaacgttttgaaatactacgttaatccagacctttagttgtcccatggctgttaataaagttgccaaacgaagatgtattatgaacaattcagcaataagacaacttgtcaacacagcttgcagaactaacacatggtaactcgttagctaactacttatagaacttggaactttgcctacctgaacatacgttatagactgacttacttgctgatgctgaaacttgaacttgcagcactgacacaacccagacatttccagcttggcttcttgtaagctctcttgcagcacatctaagatacatggaggtctttctatatataatctgcaaagcattaagctctgattctgtaagaggctgcatctcctttgacacaaactgtaaattctctccagcaaaacacacactaaacgaacacataacaacatggaacatgccgtagataaaacaaaacacacaaacaacagaaacacacagaagaaaaacaacgaacaacaagaaacaacaacaatagagacaacgagaagaaagagaggaagcgtaagacaacgagacgaaagacagaaaagacacacccgacgcaacggaacagacgcacacgacagagcgcagagaagaagagagagagcgcaagagcacacgcaaggcgagcgcagaggagataggagaaggaaggacgagccgaatggcgaaagagagagagacaagggagagggagagacagagagtgcgacaagaaaagaagaagagaaggcagcacggcagacaggggacaaaaaagaaaaggagaaagaaagaggagagagacataaggaggaacggacgggggcgcggcaggaggacagaagagagggtgatggcagcgtggtcgatgggcgtagacgggagccgcaaacaagggtgcggagctagcagggctcgtagacggtataaaaagctataaaaaagggaagaggctgaggcgaagggatttgtacagagaggccagttgtagaagaggatgaaggaggtgataggtataacgaagaccatagtataaacgaggagatgggga

SEQ ID NO: 666609 - DNA, 100 bp, Homo sapiens
ccaaacaaactcattattatggggatgggagtcaggtagaggcctccccatgcatgatatccagcgctgtcacacagtgcttatgttcacagtgcttaca

SEQ ID NO: 666610 - DNA, 1747 bp, Homo sapiens
tttttgtaagtactatccttccgttagttagctcgatggtctccgttgtgctggcgtcctgcccttcggagacagaggttgtctgtccagcggtgggctcagtgtaccgcatcgtagtgtcagctgccgtgctgttagtcagctaggtggagcgactccttgtcgtcacatgcgtggggtataatgatcgggtcggtctgttcacgcgtcacaaaccagatgtgtctggtgttgtgtgattacgcgttgtgcgtctttgttgcgtgcttgcgcacagccagcccgctgctgggtcgtgtgtctttgtgtggcgcggcggtccacagttgctcgcctgactcctagttgtgctccgcggcgaagtgtgtgtttgttggttactgccccctgctgacttgtcctcccagcatgtgtgttccccacgtgtgggctgctgttggggtcgtttgggtgcgggcgtgttttaatactatagctcagtgctgctcgtcttgttgagtttccaactgtcctccctatgtagtggcgtgttcatcactcgcactccacgcaggtgaagtagttgtgtgggttgcctcggtccaccccaagggctttcccccgttcggtgctagactaaatgggggggggcgcgactccaacggtatagtcgtgtttcaccgtcttggtggagtacgcggtcgtttgtgcggtatggtagctgttggaggtgcggtccacatccgtcttgcgcgtgcccgcccaccatccttgtgcgtccacggggtggtgtatatcaaccctggtcatgtttctgcgctatttcaactgggcgcctgttgtgtcggcgtgccgtctcgtccgcttcgcatggtggcttcccgccttggggggggtaaacttttcctatccggggcggagtgttgttatgacgcccgcgcgtggcttggtgtcttttcttttcttgtgggggagtgggcccccgccgaagtcctccccccacgctgctcccacgtgtgttaatgaggggccaccccacttgtcgtgccctggtgccagcttggtgtgtccactgatggggggtgtctcacactgtggcccccccctcttttatgttgtgtgacacaacgggggtcccgcctgggcgctaggctctgtccgccttctgggaggccccaccacaccgcaccgctggggggtgtgtgacacacagaagtgtgcccacttacacagcgtgtgccccacggtcgccccacacactcgggcgcccacagagtggcgccacagggtgtgtgacacacagagcccacacggcgttcagacttgtgccttgtgtgtgtctgtgccgtggggagatttttcttgtctgccgctctctggtgtcacccgctctcccactgtgtctcctttcacttgggagagtgagacctcgagagaggtgtgtgggctgtgcgctcccacctcttgtgttctccacagtgagttatctgttgccctctaagtgtgtttccccacacagagagggagaaggcgtggagaacttcttaaactcctaggaacccctctgaatagttagtttaattgctgttttctcctaagtggttacacacacttgagaactgaattgaagagtggtggtcgggtggctaacggaggaccaccctcacccttctcctttccccacttgtgccgcctttatatcacaattgcctgttttgtttttgtttgtttttttaactttcacataataaaatggagttttcttcca

SEQ ID NO: 666611 - DNA, 503 bp, Homo sapiens
cacgactccgagtttccactcatcaaatacgaacgattagatgaattctatcgaatgatttctttatgatattggccagggacgatttgcgtcattcacggggaactactggcatagctgtggctctcactctgtgacaggtgtgacatgtacgtctgtcggaattgggagaacctttgggtgctccttgatatcctaccccttgtgaccatcatttctgaaagcttgtttactgtgaaagattaaaacaaaacacatttagaatagtgcaattcgccatatatgacatctcagcatcttctgcttttcctggactccaaaattaaattgcagttcttgaaaatgtatgtatgccctttgttacagcaacagtagccttctgtcacaggggttatcttgcctctgcagttccagctacttggaaggttgagatgggaagaccgcttcagctcagaaggttgaggctgcattgagccatactcataccactgtactccagagaa

SEQ ID NO: 666612 - DNA, 850 bp, Homo sapiens
cttctgtgctgtgtgcgttgtcatttcggtgcaaccttgtgctccccccacgttttctggccccacacaaagtagtggggtccttctgacgccccctccgggtcttaatactgtgtgttttcctccttaacaaccgttggcgcccccacggggtggtgtctttatgcaaagacactccgcgcgcgcacttctaatgtgtgcttcacacccccacacggggggtgtgcctcccatacgtggttaattgaacaatgtcgctgtgtcaacacccatgtagactccgggcgttcatattgcaacgaatttatctccacccctctggttaggagaaacacacacgcgggcgtttctttgtttgtgccacaccacaacattcgttggaggcgcatgttcgaacaccacccctgtggcctttctgggcgaggttctctctcaccacaagggggacatgtttctggcgcccgcccgagtctgtcaaccacataaagggacctcgcgtgcaatcacggctggggggtttctccttgccccaagtatattgccttcacacccccttcgcgcgtgtctctggcggagtaataacacatctcgactctcgctcgtcgtgatacacccgctaggttaccgcgccagcaccgcagagggtctaccgccaacgggccaagtagacgccccaagtacccgatcgtcggcatactaggggcagccccccctcgcctgcacaacgcaacgtgcgcggaagccacaaggcggatgcacacaagaagtcgaaggaacagacggacaccgcacacaccacaggtacagataataagacagaccgccaccccgccccaccaatcgatacaaa

SEQ ID NO: 666613 - DNA, 369 bp, Homo sapiens
taagagtgaatgttacaaatcataacatgatccaaatttattagaaagtacttttaaaatcagacaaaagacttacaaattactagtttaaatttctattccaccatgtaaaacaagaatacaggatattggtcatgctaatattcaaaatgtgtttaccccagttcataattcctctgctcccctcctacctaaaatctaagaaagtattcattatatattggaagttcagaatttttagaaagccaactggatgctgattcgtatgattttctttacatgtacgatttacttttcagcaacctgtaagccatgtaaagagtaactccatatccgacaaaaaaactcaaagctctatatggctggaga

SEQ ID NO: 666614 - DNA, 139 bp, Homo sapiens
tgcaagctgtatgcttacaagagattcatagaggatcccgactcagtcggtcatcgtcttacctcgggcgtccgtcacgacaacatgcaagcatgacgaccagagttggggtaccgcagcctacgagattcagctaagt

SEQ ID NO: 666615 - DNA, 782 bp, Homo sapiens
  misc_feature (31)..(31): n is a, c, g, or t
aggcagtttggacttggagtcgtgggggggngcttttaacaatctaatttacaccctcttctgggtcacgctagaatcagatctgctctccagcatcttctgtttcctggcaagtgtttcctgctactttggattggccacgatgggctggagctgccttgtgacaagatcaggaggggtggggggtcataggatcgtccgcctgttggtggaagagaaggaactgaaggagatcagggccttggacatggccttcagaccagaattgagagaggaattttctaagctccagaacaggaccaagctgactgtacttgaaggagacattctggatgagccattcctgataagagcctgccaggacgtctcgggtcgtcatccacaccgcctgtatcattagatgtctcttggtgtcactcacagaggagccatcatgaatgtcaatgtgaaaggtacccagctactgttggaggcctgtgtccaagccagggtgccagtcttcatctacaccaggagcatagaggtagccgggcccaactccctccaggaaatcatccagaacggccacggagaagagcctttggaaaacacatggcccactccatacccggacagcaaaagccttgctgaaaaggctgtgcttgcgggtatggggtgggatctaaaaatggggacccctggacacttgggcgttaaaaccccatttttttttgggggggggggccattcctttttcgcgaataaaagaagccccccccacacgggacccttgcaggggttaa

SEQ ID NO: 666616 - DNA, 332 bp, Homo sapiens
tgggtgatcttgttgctgcttataaatactgaatggaattgatcagaagcaagatgcaatatcccgacaaaacgcaggttctccaatgcgaactttatggtgcctctgactaatccataagcaaaccaaaatttgagccctttagagtaatctgagacacagtcatactttcaccctcttgtactttattcctgagctccttattgcagtaaatcagctaatgttcttctactgcacattattttctataagtaaaaatgactaagacagtatgttcatgggccttaacgacgtatctttcattctctcccttcaggagaggggctctcaaa

SEQ ID NO: 666617 - DNA, 447 bp, Homo sapiens
tggtacccgttatcattgaggaggtgtgcggtgcagccctgggaaatacatccagaggactgcaggtatgtaagactctgtattcacagcagtgctgcgcccttacacaaactggcaattgccagtctcctcaagccccttctattattttccactcatacaccatgctgttgatgtttttatatcttttaacaacattgtcctgaaacttcctcctcttttagggctcttagatgttctcatttgttcacactgtaataatcatatgccgttgactcagccgctgtgaatattcctgctgtagtgatggctcctcccctccccaatgctcacatcttattcattccctccatatatggacagcaggcaaagcttcagggaggggaaccctgagcacaaaacgtgaatctccaaggaaataagaaaacggaggtggccttgaaggtg

SEQ ID NO: 666618 - DNA, 383 bp, Homo sapiens
ggatcctgtttacctaatggtagcatgctgtccagtttctgcgtgaacatccgttctgcgcatagtacctttgcagagctgcgctctgtttcctgcatagtgtgactcctgtcttactttatggtagtagtgtactggtctccacagcctgattacatcaaccccagagccgtgcagcatagggatcccttctacgtccgcggactcaccactctaggttataatcaacagagcatagtagctacccctgaaaaacgagtgattacatgccctggaatgtattaagacgaggaagctttaacaatcagaagtacttgcaatactgaaaagggtaatgctgtggaggtacttttagaacaaaatgtgagttcaacagacaccta

SEQ ID NO: 666619 - DNA, 219 bp, Homo sapiens
actggatggatctctagagtctgaccagtgctccagcgttaactgatattttggatggtcagcactggtgctcactgtgtcgacggaacttgtacatgtggaggcatgcacctgcagtgggtgaatacactgtcgaccatggctccagtcttaactgatattttggatggtcatgcactgcgtgctacactgttgtctgactggatactatgtcccatg

SEQ ID NO: 666620 - DNA, 245 bp, Homo sapiens
gatcttttcattaaagaatgttttggaactttactcgctgggccttggcctcttcttctcttttcctccctaataaccttgaaccaggggaacccagggtgtcttgggtgccctaactctggtaaagggaaggggagttgggaactctcttcgagtgccataggaatatatcctcgttgggagcagtggacacagggtctgtgattttgtcttcctcgggaaaggggaaggggaggacacgaccg

SEQ ID NO: 666621 - DNA, 350 bp, Homo sapiens
  misc_feature (36)..(36): n is a, c, g, or t
  misc_feature (52)..(52): n is a, c, g, or t
gagcttattacagcgtcaggcaggcgtcctccgtanctgactcccaaagtgntgggattctgggtgggagccaccatgcccagcaatcacaagggtctttataaaagaaagagagtaggagattcagaattggagcaggagatgtggtgatgaaagcagaggtaagagagggagatttgaagatgcttcacctctggctttgaagatggagtcaggggccatgatccaaggaatgggggtggcttccagaagctggaaaagccaagggaacatattagagtctccagaaggaatgcagccctgctgacaccttgactttagccttaatagacctagtttgggtttctggc

SEQ ID NO: 666622 - DNA, 148 bp, Homo sapiens
acagtgatgctgctgtgactctaaggatcccctctttggtttccctgatggtggtgatcccaggtaaactggcgctctgatgctgatgtgtggagtttccagtgcaaacttccctcccgggccctcagtccatccacaaccaagcaac

SEQ ID NO: 666623 - DNA, 131 bp, Homo sapiens
ggggagtatgctgacgctcgggaggtgtctatgaggctcagggagttatcagttatatgaatgttgttgagttggctggcagtctggaggagtggaggtgggttggcagcagcggctgtagggtggtctgt

SEQ ID NO: 666624 - DNA, 347 bp, Homo sapiens
gggggttcaccatgtggcagggggtctcgagctccgatctcaggtgatccggccggctccgtctcccagggggctgggaattataggcgtgagccacgaccgggctagtttggagtgctggttacttttaatggtggttaccttggttttaatgttaaatcgtaaacttatataatttaaaaaatggtttttaatttttaatttttaagtagagacggggttacaccaacgtggtccagggcgggtctcaaactcctggaactcaaatggatacactccccttcagcctcccaaagtggctggggattcataggtgtagagccattggagcctgggccttaaacttt

SEQ ID NO: 666625 - DNA, 284 bp, Homo sapiens
ttggtccgtgttggccacgcaccgtggctcacgcctgtatcccagcactttgggacgccaaggcgggtggatcatggggtcaggagaccgagaccattctggctaacacggtgaaaccccgtctctactaaaaatacaaaaaattagccgggcgtggtggcgggcgcctgtagtcccagctacctgacggtgcgttggcccaacgttggccaacgcaccgtcatcaccattataatcaccatcaccaccatcatcctcactaccaccatcatcaccatctcaca

SEQ ID NO: 666626 - DNA, 305 bp, Homo sapiens
accacaccgcagactattttgtacttttagtagagacgaggtttcgtcatgtaggccaggcatggtcttgaactcctgacctcaggtgatctgcccacctcggcctctccaagagtgcttgtggttacaggtgtgagccaccatgcctgtgccagggagagggtaatagaagtgacacaggaaagcgggtgtgtgaggctttagctgatggtggaggaatgatgctgaagtccctcagggagttaggatttgagtgggagaggggaggtcgcaatcttctgagtatgaaagttcgtaatactagg

SEQ ID NO: 666627 - DNA, 430 bp, Homo sapiens
aatatattcaaaaaagctttttagtttccacccccgaaatggagggttcaaggtatttgccctcccggggaaaaaaattttaaccccagtttgggattttttggcccctgtcttttcccatctttcaatgaggtggcaaaaatagggccaaattcaaagctaaaattggttttttgaattttaaaaaggtgccctttattttaagctgaccccccacttaatttaaacctttttaaaaaaaattatcccaaaaatggtggaaacgtgggaaaattttaattaatgttggagggccttaaattggaccccgggttaaaaaaaaagatcccttccccgcctattttatgtttaaaaaccacttgggtgattttagccttgcagggtttctgtaatttatgtagccccataaaggataacccgtttgctgtgg

SEQ ID NO: 666628 - DNA, 290 bp, Homo sapiens
tttcccgggttttttttcccccccgggcccaaaaggggtttccccgcctttttgggcccccttcaccccaagggggtttttttaagggggtgttttttttttttggagaggattttttgggcccccccccctttttgtaccccaaaaccggggccttttggggtttttttttttttgttaggaaaaagcccccctttcggggtttttttttgtggaaaaacccccttttcttttgggtggtttcctttttgggcccccccccgttcccctttagggttttgtttggccca

SEQ ID NO: 666629 - DNA, 854 bp, Homo sapiens
ggacgcgtgggtccgaccagcgtcgatgcctatcatatagtaaaaccagcctatgaccctacagggtgcctctcagccctcctaatgacctccggctagccatgtgattcagttccatccataagctcctcatactaggcctacgtaaccaacacactaaccatataccaatgatggcgcgattgtaacacgagaaagcacataccaaggcccccacacaccaccttgcccaacaaggccttcgacttacgggataatcctatttattacctcagaagtttcttcttcgcaggatttttctgagccttttaccactccagcctagccctaccccccaattaggagggcacttggaccccaagcaggcatcaccccgctaaatcccctagaagtcccactcctaaacaccatccgtattactcgccatcaggagtatcaatcactctgagctcaccatagtctaatagacaacaaccgaaacccacaataatccaagcactgcttattacaattacactgggtctctattacaccctcctacaagccctcagagtacttcgagtctcccattcaccaatttcccgaccggccatcctacggcctcaacccattctagtgtagcccacagtgcttcccacaggacttcccgtcattcattggctcaactttcctcaacctatcttgcttcatcccgccaacgtaatattacacctttcacatccaacacatcactttgggcttcgaaagccgccgcctgatactggccattctcgcacactgttgtcagactcattctctgtttgtctccatctacttgctccagggtcctcagcacaaacacacaccacagcggg

SEQ ID NO: 666630 - DNA, 874 bp, Homo sapiens
  misc_feature (583)..(583): n is a, c, g, or t
  misc_feature (748)..(748): n is a, c, g, or t
  misc_feature (766)..(766): n is a, c, g, or t
  misc_feature (773)..(773): n is a, c, g, or t
  misc_feature (779)..(779): n is a, c, g, or t
aatggcgctccgcggccggcgtccggagcatggcggacccccagcagctgttttatgacgcagacatgacagcccggcaaatacgttcgcaactcacggcatgattgatatccacgaccacggcactggctgggcgcagcacttggcacgccttcctttactcttgccagcagcaactaacgccctgcttaccctgcctggcatacttggcctgctggcacctggcgcctgagctggcacacgttatcattgtcagcatgcaacgcggccacctacttgcggctgtggccctggcactactccacgcccccctgtcacactgccctggcactgcagcgccctgctgcgcacccgcagcacgcactagcacgcggcacgcatccctgtcctgccctggcgcgcgcactactgcgcgtccacgcggcctactccctcaactctcacatcgcccacgggcaaccactcttgcactgcgccttgcaactcaagcccactctctcctgccctgctgtcacgcctgtgcctcttgcctacatctgcctacaccacacgcacacgctcttggacaacacccctctggccnacaggcctgaccatgtgtacttggcctctctctctctgccctctctctccttcttctctctccatgtctctacctctgcctaccgcgcgcgcactcacccgcagaccctgtctcacatgatcaggacatggctaacacccatggcagaaaatcatcaagaaagcncagactctgcgcagaccnttgcacnttctancaatacccacaagggagcacaacaaccacgcgacacgcgccatatctcttcccgggcatagggcaaacttgggattgcgactaaagcaccttaca

SEQ ID NO: 666631 - DNA, 533 bp, Homo sapiens
  misc_feature (15)..(15): n is a, c, g, or t
  misc_feature (62)..(62): n is a, c, g, or t
  misc_feature (87)..(87): n is a, c, g, or t
  misc_feature (111)..(111): n is a, c, g, or t
  misc_feature (115)..(115): n is a, c, g, or t
  misc_feature (148)..(148): n is a, c, g, or t
  misc_feature (161)..(161): n is a, c, g, or t
  misc_feature (203)..(203): n is a, c, g, or t
  misc_feature (211)..(211): n is a, c, g, or t
  misc_feature (244)..(244): n is a, c, g, or t
  misc_feature (250)..(250): n is a, c, g, or t
  misc_feature (279)..(279): n is a, c, g, or t
  misc_feature (287)..(287): n is a, c, g, or t
  misc_feature (292)..(292): n is a, c, g, or t
  misc_feature (294)..(294): n is a, c, g, or t
  misc_feature (303)..(303): n is a, c, g, or t
  misc_feature (310)..(310): n is a, c, g, or t
  misc_feature (343)..(343): n is a, c, g, or t
  misc_feature (348)..(348): n is a, c, g, or t
  misc_feature (389)..(389): n is a, c, g, or t
  misc_feature (403)..(403): n is a, c, g, or t
  misc_feature (421)..(421): n is a, c, g, or t
  misc_feature (442)..(442): n is a, c, g, or t
  misc_feature (448)..(448): n is a, c, g, or t
  misc_feature (458)..(458): n is a, c, g, or t
  misc_feature (486)..(486): n is a, c, g, or t
ggggagatggggagngttggcgtctttggggagccacgtcgaccgacggtgatgaacgaggngagcaagccaatggttattttaccnatgcgcgaggggtcaacattctcnaccnatctaggtatgcgctgggctcaaaagcaaagcnattggtggatctnctggctaacagtaaagctgttccatgggtaaggcttttctcnagcaaganatgcacagggggcatattgttggccaagagggnaagtgngatggcggggggtaagggcaccagggttnggtctggnaattntnttcaggtcnaacattncagggactcccatccaaatcttcaggggaagcnagtgnatggggagggacaccaatctgggctaaataaaggcgggttnaagggttagctgtnaggtttggggcggctcgnatatccgagggttttctacgnacagancgtgcataanatgggcctccatttgttctaaccatganaaggcacaatccagagtggctcccaggggtgggtgtggggtgggtgg

SEQ ID NO: 666632 - DNA, 353 bp, Homo sapiens
cacgaggctagcgcacgactactacgccaaggagggcacccgcatgctaagggcggacatgaacagcgagatgtatgacaagtacaggcagatgacgcacgacgctgcatagggtctagaacacatcataacttgactggcaaaaaggtgatgccgtgagccactgcgaaacaggcttgccatcatcccatagcacatgtaacatgtcatgagttactttcttaatacgtctctggatggaactgatgtctggacgctcattgctactggtgtgatgatgcttagagagttcagccaagagaatatccaagctctgaagttcttcgaacagtgaactcttgtcagtccagaca

SEQ ID NO: 666633 - DNA, 184 bp, Homo sapiens
gagggggtggaacacaagatgatcgcaggccagctccggaagccaagagctccatgcagttcacagctgaggccagcagagaggccagtttgtctttgctggcagaagatggtgctctggcatatctggcttcgaatttcataagtacctctgtgagtccgatacagatgggccccaatttaca

SEQ ID NO: 666634 - DNA, 801 bp, Homo sapiens
agcggaagctttccctagactcaggtcaatagtattaggaggttggttcctcagcggagggtcaggtgaatcaagacgccagatgcccttactttccagcgcctgtaagcgaagtaaacggccgatgggtatgtcctctgagcgggctcatcttccaacacaagaaagaacccgtcagcctctctcttggttgcctgcgcatgcctgcgtcgttacttgatcctcaggctcaagttactcgtatctacattttcgagagagatgagaaagtcacgattgcactccattttacataccgtacccatcgtatcaacatatctcactcataccatgtgtgtgactgacttacattgtgaacgatgagatcttgttctactatcaggcagacatgcttattatgctacaatctatattagggcattaggaataggtgtcatcgcaggtgaacttagatacacaattgtacctgttctttcattgttctggtacgcaccaacaatacgctgcagttaagtagacacccctctccttgaaaggccatggtacgacccctcgtcttgagtaatgactgtagcgtggtatactatgacacctgtacaatgccagaacggtaactgttcaaggtcatataacatgcatgctgtagactacgtacggtgggcacttacctaaatctcgtcttgtgctgaaacgcattgaacaggacactaattgccaactgactttgcgcccgacttactttaggtgtttacccaatcttctcctctcgaatccaagggggttccctatcgaagactcacg

SEQ ID NO: 666635 - DNA, 301 bp, Homo sapiens
ccgggttttttttaaaaaagttccccggtcccggcccttgaattgatttacataaactacggccaaggtttaaatggcccttaggtttatattttttagggcaagccaattgggccaaccaattgggaatcaaatgtcataagaattttttatataaatttttcaagaataaaaaggcctccccccccttaagtatttacaggctcccgggtcattgccggtttagggtattaggttgttttttttaaggccttgaattgatagaaaaatttgctttgtaataaaaatttcctttcccata

SEQ ID NO: 666636 - DNA, 187 bp, Homo sapiens
ttaagttgtacgaaaaacgaaaatccttcatactgcacagctggaatgggtaactccgatgggacacttctcgttccatcgtccattctggtgtaaagttctagtatacagacactccactcaggtcccccagagtctcatctcagttatcttgccaccatcgtgggaagaaagttctagaaattat

SEQ ID NO: 666637 - DNA, 181 bp, Homo sapiens
  misc_feature (149)..(150): n is a, c, g, or t
  misc_feature (178)..(178): n is a, c, g, or t
ccagccaggcgcccagagacacgtcctcgctgtgccaggcgcgcaggtagtcgcggctgaggcgcaggtagtgcaccaggtcggccgagagcacgtagccgcgcccagcgcgtagggcaggtagtagtcgcagagttgccaggcggccnncgccagcgcccccccggcttgacgcggncgc

SEQ ID NO: 666638 - DNA, 230 bp, Homo sapiens
atctgcagggctctcacacacaaaccccacagacgcctggtacacgtcaatgagcttcccccagggggtgctgagccgctgccccaatctcagccagctgactcgagcaggtccttcaccaggaccagcagtatctcctcaggacattttctgcccgtagatgccatgactgcttgcagggagtcggtagaactagctccacgaatctacggcagccccttgcctgggca

SEQ ID NO: 666639 - DNA, 394 bp, Homo sapiens
ggcgatctgaggatcccaggtcatagatttaggtccgttgccatgataatcctctgcacgtggtggaaagtagcaaagaagtatagttgcttcagtaacaggtaataaccagagaatgataaacaccagaaatatggaagccaaacatgatatacatctgtgtgtgaccaagatactattcatgaatgaaggaacagttgtataaacgatgcagcctatagggcaaatatcccatcccaatgataatacgcaggctagagggcttcgtcgtataacgcactgttcatggactccgactgtgaaagtctgatttgttcgcactgggctgtccgtggcattctacttaaaaccaaagtatgcaccaataaacgtcagaggcacagatatgcagaac

SEQ ID NO: 666640 - DNA, 1858 bp, Homo sapiens
gggcagtcctagtctttgcttactgaatgatatgggcaaggcaaacatagacgaagtaattccagttgggcttatagttcaaccaatccagcagtcagaagattggtcacaatcttattgttacttccttttttctcagtgcaacaggagaccaagaaatacgtataacatatatatttaaatgtggcctatgtagagaggcgctcatatattgggggtccttctgtgtgtcaaatatttctccccaaagtctattgtgcctgtgtctgtgtatacgcacgtgtgttatagctccgacgctctatattgggaccaaaagtgtgagtctagacacctcacatattgcgcatgtgtcatgcactgttggttcagttgtcgctaaggttttcgagagatctcttttttatgttctactatgctgtgggaagaccagccgaggaaagtgcgggtcttgaggggtccttttttgaaaggatacttttggtggccccctaaggatgcccctggtgggttggaccgaccgtttcaaaaggcgcgcttttgaatgtctgccgtgtggtacatgtgggcggtgaacaaaggcaagcaacacttcatctacttgttccgccacccccccgccgctttatgatagattgtgcccgccggctggttgagtgactaacaacagtgttatattgtgggctatacagaaaaagtaggaaggaaccccaatctatagtcgatagaaggagggagaataaaaagcagacacgatacaaacaaaaaaatgcataataaagaaacgaaggtagtctgtgaatcacaccttacacaacgcatcggtggggagctgatcgatttggggacccgtgctaaataaagctaggtgctgcattaggtattaactcccatatgggtaggggagagtttatcacgagaagcgagggatcgaagagatatagcgcggctaatggacggatacttttagctgaccacccaagggcacaagaacgcaacaaaaccgccagaaaacggcgccttaaaacaccgccaacaccaattcttacctccaaacccacccgtctacctattagaggcgcttacccgttgcttggactgcgatggagagtcatggcggggggggtctgttcccagttgtttgcgcccggtttgttttgtcggtgtgcggctattctctcacctgccttgctcgctaatctattgttgcccccgccaccgctttgtcgggcgggctccctgctgcttatagtcgcgcctcccgcgagcttggcgcgccgtgtgctgtgtcgcccttgtctgggccgttggtccgctactcgtattgttggtggcgttctccgcagcaacgcgattcctcctctatcccgttcgttctgccgatctcagagtctgtgtaacgcgctcggggtgccttgtttgcgggcgtcgcttgcggactggttgttttttccctgtgtcgttctttgtgtgcgctcctctctcgacgtctcagctgtggctcttcccccttctgttttgccgctcgcgtgttttgtttttctgcggaatcggtcgggtgagcactcgtcggtgtttgttctccgcggggggtcgtctgaatcctgcctgcgtgtgcttgctgttaggccgcctcgctctgtgtagggttcggctcgcggcgtggtcttgtcgagcgccgtgcgtctccttcggtcagctggggtggcctctcttgtgtggtgtgtcgtgtcgtgtgtcggcggtgcgctggcgcgttggtgtcgtgttctcgtcgccgtgggtttggtgttggtgggctttgggtgttgtcgtgtgctttgggcggggcgcgcgtctcggcgtgtttggctgctgc

SEQ ID NO: 666641 - DNA, 164 bp, Homo sapiens
tgaaagggccaaaagtaaaagccctgttttgtttttttgttttgttttgttttgccttttgttaaaacatgtttataaagttggcagttaatgctgaatttgtcaaaaaccccttccaaaattatacttgtttttaaaaaataaatgggtttccctaatttcca

SEQ ID NO: 666642 - DNA, 258 bp, Homo sapiens
tggagaggagtgtatgcaggactatttcattggcaagcaacagaaaccaaatccgaacgggcttaaacaaaggaaggacatttatgggtttacgtaactgaaaggtccagaagtagatttttcaactgtgcttcaggtatggctgaatccaggtgctcaaacaacattgtcaggactctgcccctctctatctccgggcctggctttcctctaggagagcttcatggtcaggatagctctctccaaggctctccaagg

SEQ ID NO: 666643 - DNA, 101 bp, Homo sapiens
gagaccccggcagcctgctgcatgttgtgggttacgatcaccacggtgaagcgctccttgagctcactgacaagatcctcgatggctagggtcgagatcgg

SEQ ID NO: 666644 - DNA, 1118 bp, Homo sapiens
gccaaaagctcggcatggcatgactgacgcggtgtttggagaccccgctgtgttcctgagcagttcggctccgtgggatgtgcactggtggcttgctgctgccgcctgctggactgtggagcctgcatgtgggatgtgtctgtgtggtgcttggctgctgtgtgtgtgtgtgctctccatgtggccttcactggtcaagacctgaatgtgacgatgatgctgtggcgaagttgggtggcttcctgtgtggccccctcacctgcccctctcctgggctccatgtgcctgtgttcctgcctcagtggcttccctgatatgctgtcatgccctggactactttgccctaccatgctgtgggattcctgtgcagtgctgttttgcttccatgcctctccgtgctccctatgccacccatggcatgtcttgcttgggcataggggtggggaacgcaaaagccactgtttcagcttgcactggccacctgtgctcgtgaaagattcaacttggcatgctgggccgcatctgtctttgcctggtggaaagggagcaaactggactgcaatgccaagcagtggaggctttttgcggacatactcaatgacgtaggccatgttccttgagattatggtccatgtataccaatctgtatcaccatgaccgtctacacagaacctaggcaagtgcatcgtgagtgttgctggtgggtgctagtcgggctgacatgacctgtgagcattgttcggaggaaaaacattgatgatgtgtaagcaaggaaagaactaggatatgtggtgaacttgggaggatatgggaactctgatgacctttggtgtaaggtgcgcttgattaagagatggatgtggttgttcttattgcttcgatttatgtgataatgggtgtgggcttgttttagtaacgtatataaaagtgagacaagtaggttattaagtctacctgaaggtatgggtatctcacgtagtgaagttgtgacgaagtgcagtcttgaacgctataaggtagacaaaagaggtatatagtaaagtaggagagtacttagagagcgaggagtaaggcagaaagagtgtggggtataatactttgtgtgattgaagataaga

SEQ ID NO: 666645 - DNA, 414 bp, Homo sapiens
tgtacatattacatatgtacatatcgcataagatgaacttctgtatctttctattttctgaaagtctctgaccctgactcaggcagctagtcagatgacccatacattataacgtttatatagtttagcccacaagagatacccactgtcaattctagattgtttcagattttaagtctgcttgctactagtgaaattctcatatctcagggattgcctttaaaggatgaatgtgcagaggctcgtttcgctctaaagagaataagcctttgatatagctgtttggatatacaggggaataactatccagatagtactggctctagtggtatttacatcggaacaaatacgccacatttagaccatctttggccctgtgtttcctttgttctctttgatgtacatgcacttgcc

SEQ ID NO: 666646 - DNA, 138 bp, Homo sapiens
ggcggtaccatatgagtgcagatgggatacatggctgtcgtgacatctttatgtgcaaattgtgatttcaaaaatgtcctgccagtttaagggtacatgtagagccgaactttgagttactgtgcaagattttttttt

SEQ ID NO: 666647 - DNA, 631 bp, Homo sapiens
catgtccagtggctaagggtgctgcgagtagcctgccacccgttcggctgttggctctgtgctgtctgtggtcgttgtgtcgtgacaacctgcgtgcggtagaccgtttcctgagtgcagcagttgcggcctgctttagccctgagctggtgatcttgctgtgcttgcctgctgagtctctgcttgtgcctgacccattctcttcgctggaccccactgccaatgcacgctgaccactgatgcctgacatgcctggatgctgccctggcaaagtgtgctgtgccatcgactgtgcctctagcacctggccacatcaatgtgtgtgatcatatgaatgaacgaatgaccgtctactggacttcgctcgtatgtgttgtgctgtctgtgcctgacacaggccacctgctggtgacattgtctggactgacgtgagcttcgagcacaagaagatcccgagacagtgtggactgagaattgacacatactttgtgctgactgatatcattccgagcgagcacaaatgactagttggtattaagttgacacagtagactgagaccgaagcgactcgctattagccagtaagtagtgatagtggtggatagattgaagactagcgctgataggttga

SEQ ID NO: 666648 - DNA, 685 bp, Homo sapiens
  misc_feature (186)..(186): n is a, c, g, or t
  misc_feature (188)..(188): n is a, c, g, or t
  misc_feature (198)..(199): n is a, c, g, or t
  misc_feature (202)..(203): n is a, c, g, or t
  misc_feature (205)..(205): n is a, c, g, or t
  misc_feature (207)..(207): n is a, c, g, or t
  misc_feature (210)..(210): n is a, c, g, or t
  misc_feature (213)..(213): n is a, c, g, or t
  misc_feature (217)..(219): n is a, c, g, or t
  misc_feature (222)..(222): n is a, c, g, or t
  misc_feature (225)..(225): n is a, c, g, or t
  misc_feature (236)..(236): n is a, c, g, or t
  misc_feature (256)..(256): n is a, c, g, or t
  misc_feature (258)..(258): n is a, c, g, or t
caaggatcatgttgatgttgaaaaggggagatgtgaaattaatccaaactgaaagctgttggaaccgtacctgattttgagccttgagaggaacgtggctgtggggcctgcgtcgcatggtgtgaagctgcaccttctgcttctttattctgggtcaaatctcttcctcattcttgtcctgtaatnantaggaaagannganngntnccnagntgannncgntcnagaccattacncttccttatgggatgttaananaagcttccttagtgtagcgagctgtgaccaatcaagtcaaatcgctataacctatgtcttgatcttgttggaaaatgctgcaacctgttaaacctctgcctctgactatgtaaatgagactttaactttccattttgagagtctgtgtttcctatgtgactatcctccaacttcgtgttcaaataaactccacgattcatcataaaaaaaaaaactaagtatttaagcttgaaaattgcaaagacacattatcatgtttatgcggctgtcagcattctatggaagtttagtgcaattaaactcgggaaaagggtccggtgcagtggctcacacctgtaaatccagcactttgggaggccgaggcgagcggatcacgggtcaggagaccgagaccatactgggtaacaaggtgaaacccgtctctact

SEQ ID NO: 666649 - DNA, 1130 bp, Homo sapiens
  misc_feature (118)..(118): n is a, c, g, or t
  misc_feature (326)..(326): n is a, c, g, or t
  misc_feature (376)..(376): n is a, c, g, or t
  misc_feature (381)..(381): n is a, c, g, or t
ggcacgaggcgggaagcgccgggcgagcccactgtgcggccgtcgtgggggaagcgaaggttcctgattccacctacctcctaagtgaaggcttccgtccctggagaggaggcggcgnctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacaggncgacgggcgctggatgtccctgcaccatcggttcgtggctgacagcaaangatanaggcgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatgcggcccaaagattgtcggtggtctgggtgggcaccaatcaatcacggacatcacagctagagcaggtgactgggtggcatcaaggccattgtgcaacctggtgaatgagcagacagccaccaggcccgggttgtgtgtgctgggcctgcttccgctgaggccaacgattccgaataccacttcgggagaagaacccgagaggtgaaccgagctggtacgggcgttcactgtacttggcaccctcgggacccacttcctagatgccgagccttggctttgtgcactcactatggcagcaatcagcgcatcatgacatgtatgattaccttgcaatctgagccgtctgggctaacagacctgtttgccgggatctgcagtcacctgagctttctgcgtttgatgggcccacgaacccagggcaaaggtggtcccctttgtggagaccgcgacctaaggattcctggttggctttcccacaagattaactgtccttcctccgaagcgccacaaatacccagcaaaacaaacatcaacacacgcgcgacacgacgcaccacccccggcgggaacacactccagatccccc

SEQ ID NO: 666650 - DNA, 146 bp, Homo sapiens
gccatttgtttcactgtggatgacaaggaacactcaattcaaggtcagcgtagcgaggggagcacagcggggacctggagcatagaagtcagtcctatttccaccccaaactcacacacgattaaagtgggcacaaaaagcaagcc

SEQ ID NO: 666651 - DNA, 1160 bp, Homo sapiens
  misc_feature (118)..(118): n is a, c, g, or t
  misc_feature (326)..(326): n is a, c, g, or t
  misc_feature (376)..(376): n is a, c, g, or t
  misc_feature (381)..(381): n is a, c, g, or t
  misc_feature (385)..(385): n is a, c, g, or t
  misc_feature (391)..(391): n is a, c, g, or t
ggcacgaggcgggaagcgccgggcgagcccactgtgcggccgtcgtgggggaagcgaaggttcctgattccacctacctcctaagtgaaggcttccgtccctggagaggaggcggcgnctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacaggncgacgggcgctggatgtccctgcaccatcggttcgtggctgacagcaaangatanaggngggggnaaaaaaaaaaacccccccccccccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatgcggcccaaagattgtcggtggtctgggtgggcaccaatcaatcacggacatcacagctagagcaggtgactgggtggcatcaaggccattgtgcaacctggtgaatgagcagacagccaccaggcccgggttgtgtgtgctgggcctgcttccgctgaggccaacgattccgaataccacttcgggagaagaacccgagaggtgaaccgagctggtacgggcgttcactgtacttggcaccctcgggacccacttcctagatgccgagccttggctttgtgcactcactatggcagcaatcagcgcatcatgacatgtatgattaccttgcaatctgagccgtctgggctaacagacctgtttgccgggatctgcagtcacctgagctttctgcgtttgatgggcccacgaacccagggcaaaggtggtcccctttgtggagaccgcgacctaaggattcctggttggctttcccacaagattaactgtccttcctccgaagcgccacaaatacccagcaaaacaaacatcaacacacgcgcgacacgacgcaccacccccggcgggaacacactccagatccccc

SEQ ID NO: 666652 - DNA, 451 bp, Homo sapiens
  misc_feature (238)..(238): n is a, c, g, or t
aaatctagctcggaccggtcacatgcctctcgcaggcagttctcagagcccggggatctccttctcctcaggcagcgtccaggtgtgggagttctgaaggagtgcttgcaaaacgcgggcacatcttggctgggaagtcacattgtactcttccaggcagatgagaccagcttgaggagtctctctcggcaggttgtgatcgggtctcctgcgcgtgtgtagctgagtccaaggacgnaagtgagctctgcagggaaacatgcacgaggagaagtactgcatcaggtgcactgaccatgtagtctctcatttagaatcccgaagaagatgtcggcagtgcagattgctggatagagatcacagcacagccgaggacctcacaggtagtctcctgggtagttaacgtgtcacgcggaggagctaagtaccggcgcatgagtctctagtgtcg

SEQ ID NO: 666653 - DNA, 171 bp, Homo sapiens
acattctacttttatgaatcaaactctcaatttcttccagactttcatatttgtttattttgggagctgaaatgtcctcagaagaaagtaactgttttggttattattaagctagatgatgagggccaaaaccacaaaataacagtggcttagacaagagaagctggtgta

SEQ ID NO: 666654 - DNA, 244 bp, Homo sapiens
cttattaaacataagaaaattcatactggagagaaaccctacaaatgtgaagaatttggcaaaacttttaaccgattctcaactcttactacccataagataattcatactggagagaaaccctacaaatgtaaagaatcgtggtaaagcttttaaccagtcttcaacccttactacccatagaaaaattcatactggagagaaaccttacaaatgtgaagaatacgtggcaaagctttaagca

SEQ ID NO: 666655 - DNA, 166 bp, Homo sapiens
ctcccatacggtatgactttcctagttctttagtcttataagtgattttattgtgtcctgaattttataattatattatgagaattattctctcttattatttcgtagatggttccctatatgatagtgtaacctgagagctgggtgggtgtgcgtgtttatcttc

SEQ ID NO: 666656 - DNA, 194 bp, Homo sapiens
gcggcgatctagaggatcccatgttatcgccaacacttgcccatccctcccttctttagcttctgcaaccagtactttctggtacacctacctctccggcccctcacctctctatcattatacatttaatcaacacatatttattgagaacctaccatgagctaggcattgttttaggtgtaggagataacata

SEQ ID NO: 666657 - DNA, 305 bp, Homo sapiens
  misc_feature (288)..(288): n is a, c, g, or t
cagcagcagggcgaggccagagaggcagcggtcatatgagactagtagatgccatttgaccatttgggccattagatggaaaggcaattacttgggtgaaaaaggagaacccttagtagagaaagctgcaaaagaccgaagcaaaagaaaaaaatctccagactcactggtgttccttaaaaaaccagctctggttcttggcctatctagagggctttgaatgacacaaagcctgaccctgccatgaacttcatgtttcaggcatctgctgatttgtctgctggcttncaggggtgggcttgtgt

SEQ ID NO: 666658 - DNA, 571 bp, Homo sapiens
tgtcgtgccggtaccctcatagggcagctggccagtaaggaaggagcgataggtgcaggagtcccgccactccagcccaggaggaaccacagggacagcgcctggtccatgtttgcccgtcttgtaggctttgatagaactgggggaaggtagacgcagcaaagcagagactggcgatcaagcccaggcccacgctggcctcgtcccagccgtcctgggcacattcacccaacacatcccatatccactggatggagccactggggcagctggagaagttgcgggagcccagtttcttccagaccatggctgtggaggaggggcccccggccaggcagggctgcaccggagggaggccggctggtgtactgaggccagcaagggttcctaagcacggctgtgggaggagccagtgtagggccatcggaccctgcagacctgggaacgatggtggagggcagggagcgtcccagctcggggcataccaccacattccaggcctcggcgtcctcgggcagagtctccctcctggtgactcagcccggccgcggcccacacgtccagcccctag

SEQ ID NO: 666659 - DNA, 102 bp, Homo sapiens
cacaatacgaaacgaagctcatcactgttctatgtaggtcctgtggcagtcacccaggtgtactgcatcgatataatcatccaagttccgggtcaagtctgc

SEQ ID NO: 666660 - DNA, 439 bp, Homo sapiens
  misc_feature (43)..(43): n is a, c, g, or t
  misc_feature (127)..(127): n is a, c, g, or t
  misc_feature (169)..(169): n is a, c, g, or t
  misc_feature (179)..(179): n is a, c, g, or t
  misc_feature (188)..(189): n is a, c, g, or t
  misc_feature (193)..(195): n is a, c, g, or t
  misc_feature (202)..(202): n is a, c, g, or t
  misc_feature (212)..(212): n is a, c, g, or t
  misc_feature (338)..(339): n is a, c, g, or t
  misc_feature (352)..(352): n is a, c, g, or t
  misc_feature (434)..(434): n is a, c, g, or t
atcacacccaagtgaagctgtggataagcccttaaactccagngccagaaccaacaacctcaactccggaatacacttgcaaggcactggaagatctaaaattcctctttaaacaaaaagataagtnatgccccaccaacatcctttcacctcaaagtaaggtgatccnaatactaganattttactnnaaannnctaaaanaaaaatcaanaaaaaaaaacaaacttgtacaccaccaggagttccattggcagctcgttttgtgaccagtttctcttaggtcaccatgggcctgctcctgctggttctcattctcacgccttcactagcagcctanngccatcctgattncccgttaatggaaaaagctcagcaactgctccaaagtacaggatccccttactccaccaattgctggttatgtaactagctnttcca

SEQ ID NO: 666661 - DNA, 765 bp, Homo sapiens
tgactaagaaattaaagaagaaaaccagcaaactaagatacttctgggcagacaacaaatataataaatgcttcagatgtcaaatacccatggcttgaaagctcggtgtaatttacttcaagattatctgactgctcttcttcaagagctggacctgtgctcttataggaagatgagtttgaactagccttgatgttttcttggcttgtccaatagacgtgaagagatgagtattgaacatcgctagcaagaattggaggtacaggatgtgtagcagtacatctgaccactatctataaatacattcggacatgggtgtccaaatctccctttcttcttcagttccttcctgtgtgcaatatatacccttctctgagaacgtgtgcggtgctaaaagagaatcgactgtccttggagcagaaccagttagtttatcaataggggttatgtcatgttattgtagcggtaccctaacttagatattcagggaggtcggaaaggtgaacagaatagaccagcgatagtgtaatcaaagcaaagaagtaatcgctgacagttaagtgtgaccaaaaaaattatatagttcacacatggattcctaatgtgagccatgtgggggttaatctctagtaaaggcagatagccacgtttgggtcaacattttggaggatatgggggtggcactgagaaaagactgaagttggtcagtgtttgctaatggaggaagattaatggcccgaaccttggctatctcgggggggataa

SEQ ID NO: 666662 - DNA, 216 bp, Homo sapiens
gggcacagatcaggtggatctacaacctggttaccgagcttcccctcagccaagtgaacaggtgcccgtacctagaagttagaatggtagagtcggagcaccaggttctctaaagaatagttccgcttcgcttctgtctgtccaggctgttctacagtcaggactgttgcgcttacctgtttccaggtctacagccgcctatcgtgtacaccagtt

SEQ ID NO: 666663 - DNA, 772 bp, Homo sapiens
cactgtatacagtggtattggaggactttcatcacagtttccagtatgtggtcttggcacaggacatgcactgtagtggtataggaactggtgctctatagactccctgcagtgaatagacgagcctgtttgtatcatgaggaaactgggcaccttctggactgaattcatcctacattccagcagagttacgcatgaagatcttcggactatgttctcaggtgtggacacgcaggcaaaccagcacctttagtaaagagatagatgatgaagctagaacgagctatttccagcgaagtatataactcatcgcatcgcatgatccaaccatgtctgttgatgatggtattacgcaaattgctgcagagatttatacctgactcgtactataaagagggacaccgacgcaatgtatttacactgtatgctaaagtgaactgtgttcttgaatgaatatctgatttcatttccccatataatcctgatgaacggagttacctataacagcctgcctatttggtggtataattgagcaaggactggtcatcgtttcatggcactaggtctggtgtctacgatatgttcttgaacgccttacgcatacgccttgttgtgatccgagatgtattattcccgggattgctgcactagatagatttaaacaactcgattgaaggactatcccagtattgtctacatttgggttctatcagtcactttatgccagttccacatcattacaggagtatatggagaatgggcaggccataac

SEQ ID NO: 666664 - DNA, 104 bp, Homo sapiens
actttcatcaattttagacatgggacacacgttgtgacgtctttattttaatgatataatctcattacccccagccccctccctgattgggactgcaagactgg

SEQ ID NO: 666665 - DNA, 383 bp, Homo sapiens
tatgcagcaaaattcataggtagaaaatgtatgatctttagggataattaggtctccagacactaattgaagtatatcagagataaaattaaaaattcaaggctgggtgcagtggctcatgcctgtaatcccagcactttgggaggccgaggcaggtggatcacaatgtcaagagatggagaccatcctgaccaacatggtgaaaccccgtctctactaaaaatacaaaaattagctgggcgtggtggcgcatgcctgtagtcccagctacttgggaggctgagacagcagaatcacttgaaaccgggaggcagagattgcagtgagccgtgattgtgctactgcactccagcctggtgacagagcgagactccatcaaaaaa

SEQ ID NO: 666666 - DNA, 1658 bp, Homo sapiens
  misc_feature (383)..(383): n is a, c, g, or t
gactgtacggctcctgtagctatagtagagcggtgacgtaggctgtgcctgagagaaagagtttgttgcagcagggacagagctgtcgtgtgttctgcctttagtagagcagatttgcatgacgacaatattgtgttgggggaaacaacccacgccgctgtttgtttgaggagaccaagtagctgtgatagaccgacgtgagaagccgcgtggagagtttttggttcgcttcgtcacacgggggtttttttccttctgtggggcgactaacacacggggtgtgcggcacacagaatgtgtgctcgtggcaaattatggctcctggtgagttgcccccgcgtttgtgtgtgggcccagccagtggccgtgttgttcccctgtgngccacggaggtgtgagccgggtgtgaaggcgccacacgtgtagataagccccccactggtgttggcctgcgtatgatgggggagaaaaatgggggagtgtcttgtcggccgccgtgctaaatgtgagcgccgcctgaggacagcaaggggggtgtaaagaggggcaacaaggcccgacggtgtgtttcgtcccaagggggccgcgctcgtggtgaacaccacgcgtcaaacccccgcgtctgaatgtggtgtacgcagcccaccggggctcccctcctcgggtgtggggtatctcgcggcagtgtgtaagaggagttgaatatgttaacaacctcttgtcctaaagaacatggttttggtgccaccggaggagttctgcttggtagaaaccgtcgggtgttcgaatagccgcgtttggtgggcgtggtagcaccgtctgttaataggcttgttgggtgcctggcaacccaccacatagaagagccccgaaggattactttggtggccacagacgtgcgctgttcctgctgaagggagactccctcccagtagagacgcactgcctctagaaggatgttttcctcgttacaatagtgtaagacgaccccccagaatacaacacgtgtgtggggaggttccactagagtggcgaaacaacagaagagtgtagagcacaagaatagaaagggaagtactaccacatcggccaacatagacctgctgagtctgtgggaccagtctccgtttctcccagagtgggggttctttctgtgggtttcctccccctcgcggggtctctccccgcctggggacccccacggagcccctagagagagtttctcccacagatgtttgcgcgcctttcttgtgggcaacatgtctcagtctccgcattctgtacactgtgtagtgtgttctcaatcgtggcgctgtgtggcccagagtgtaatgtgtacacaccacaagtgtaaacagggcaccagcgtatataagatattccagagtgtgcgccctcttctcgtaagagatgttctcccttgaagacgtggagaggaaacactgtgccccacaatagtactgggaggataacataacctccaccccctaccccagacattccttctctgtaagaccccttcttttctcaccatccttttaccagccaccaccaaaaatacaccacaataaaccaatcaccctaatccccttaaaagttccctgtagggataagcccatcatggtaagccagctggaaattaagattatgacgctcca

SEQ ID NO: 666667 - DNA, 135 bp, Homo sapiens
gacggcaagtctaaagtgacccatgttatgattcgctgtcaggaactgaaatacgacgttggtagagaagaccgctttgatctttgacagaccttgtggacaattataagaggattcctatggtggaaccattgg

SEQ ID NO: 666668 - DNA, 911 bp, Homo sapiens
gccttgctctcccacggcagaggagatcgtaggggtttcaatggccccgcagggcatatctcgcctggcctgcggagagagtgcttcagtaccacaaacaacggagggatatgatagtgcaggccatggtggataatacactcctttagaacaaaggacaattaacttttgatacccatgcattggttcaggacttggaaactcatggatttgacaaaacacaagcagaacacgattgtatcagcgtaaactgctttatcaaatgtcagcctggatactactctataaccgagatggtcactcaagctcaacaggaaataccagtacaacagctagatggctcatattggatgctatcaggaacatgacatggtcatcctaggagaaaaagtgaattcgcaatatctgcagagcacgagagatgacgcaaagactgaggaattgagattagaccaagttaagcaacaaactaatgcatgaaaccggtcgaatcagagcagataatagactggatatcaacttagaacggagcagagtaacagatatgtttacagatcaagaaaagcaacttatggaaacaatacaggaatttacacaacaaggattctcaaagcagagagtattattttcagaagacccagtaaggtacacattggaccgctggaaatttgcttacctttaaaaaccctggatggaatctaacagacttggagaacaagtcggaatctggcaagctacggggtttcttgcctggcaataagcatgggcattaatagaattctggaagtagtactaatgccacctgtgtggctgacgggtcctacatcccgaacgggagcacttccttgaacttgccgatgcacaaaatttcttcccgatttcgcagtaacggctcaaaagacgtgtcactg

SEQ ID NO: 666669 - DNA, 238 bp, Homo sapiens
  misc_feature (1)..(1): n is a, c, g, or t
  misc_feature (137)..(137): n is a, c, g, or t
nttctgcaaaccctaccaaaaaaaactctaccaccactctaatcagatttcaaacctttttttttggcggcaggcgcttttatcaatcaccgggcaactaacacattattttcccctcccactcccatactactaanctcatcaatacaacccccgcccatcctacccagcacacacacaccgctgctaaccccataccccgaaccaaccaaaccccaaagacaccccccccccccaa

SEQ ID NO: 666670 - DNA, 451 bp, Homo sapiens
ggtgactcaaggatcccttgcgcctactactacttcccgacatcacttgtatggggaaggataaggcccagcaatgacagctgaggcataggagggtacaagcactccttgctttctctcacatgttatctccggatgaaatttagaccaaaagataaaaccgtttggaaacatatgtctccagagtcatcctaacttggaggggagggaactcagaggatttaagaggcaaaacctcaaagccagctccccagaggaaaattctaaaaggtcatggtgagaattttccctcagttctacaatgggcttgaggttcgatggtcccaacccacttttaatctcaaaaacttcctccttgataacttgacacataaggtacaacagtaccatgaactcagttgctacgcagaaagagaacttttgaacggcactccatctcaggctggatttt

SEQ ID NO: 666671 - DNA, 841 bp, Homo sapiens
  misc_feature (62)..(62): n is a, c, g, or t
  misc_feature (70)..(70): n is a, c, g, or t
aaaaacgaaaggtaaagaagaaacagacggagaaaggaagaaaaaaaaagtaaaggaaaccnacacacangctacgaggagacaactccttggatcccaacgatcaggtggccatggttttgcaggggcttgcaatccagaagttacgaagcaaaatccacaaaaaagtagataggaaagccagcgaaggcaggaaacttcggtttcatgtccttagcaagctactgagtttcatggcacctattgaccatactacaatgaatgatgatgccagtatttaactgtaccgctctctttatggccagctccaccctcccgacgaaggccacggggattgacatcgcccacctgcgacacccattgggcgccttggctggtgcggctgatggtccaaattgaggaagccagggactttatggggctgagctattaaggaagcccctgggaagatgctgggtttcgaacctgtgcctaatagaggcaagggcgctgtacagacccagaaccgagcgttgaatcggacaatataaagagcatttgcatccgccataaaaaaaagattagactgattggcctaaggtggggcctaggcgggcggagaaggggatcgtgtggggacagttgcctctaatgatggataaaacattatgctaggctgaatgactcgtcggagtcaggtcgaacaaaagagggcatgcggagtagcgtacatgaaatggggcaggaatgggtaggaacagagttagttagctaacgcacgaaaagacccggaaagaaagagggttcggaaaggtcagatttatggatgagggagggtttgtggagggatgagatagggtct

SEQ ID NO: 666672 - DNA, 415 bp, Homo sapiens
  misc_feature (372)..(372): n is a, c, g, or t
  misc_feature (402)..(402): n is a, c, g, or t
tttttttagagacagagtcttgctgtgttgcccaggctggtcttgaacccctggcctcaagcgatcctcccacctcagcctccccaggtgttgggattacaggtgtgcgccactgcacctggtcattcttggggtttttaaaacaagctctccaggagattctggtgtgcaccaaagttggagaaggatttgtgtgcctaaatccagagagaggggaggtcagggcaggctggagtcggttcaggcttcagggaagagagtcctgagtttgtccttttcctagaggagtctgagctatggccagggaagaggggggacagcttgggtgggctcccctccccagctctgaatcccttgccggttaacctaggntgctggtttcttgggccttccttgccctgnaaaacctgggtaa

SEQ ID NO: 666673 - DNA, 857 bp, Homo sapiens
cacaagccacggttgcagctccagaacaaagaaagggctttaacgttttctccagtgatgacaaatcctctgatatgaaatctaagcaactgctaattatagtagttatacgtgttggctgtaactctgtgatgtctcttaagcaggttgggttttatgaaacaggatgtgtcttctttagtaccagtttacttgagttactgttaacctagaaaagtacataggtcatggtgatctcttaagattaagtgtagcagaaattttctgtggaatttcatgtggtaatgacagaaaagtgggcttagaaagtatccacgatgttacaaaaatttacatttcagaaaatatggtagtattgaatactgtgcaactgtgagagtaaatgtgtagacttaatggtatcataagcgttctttttgatgggcagtttggaaagcattgtgaaagtctgctgtttggcacagcaaacagtcaaaatttttgacattcagtatcctcctattttcacagtacaagaactttctgtgaaaatcttatttaattctgagccatatttcattaccttatttaaaataatcaataaagctgcttaaattatttttatatggactgtggtctctaggtagccttgtgatctatgtacacaatctcatttcatatgtcgatcggccaagaagtataaactgtcagtgttttaaaaaaaaaatataaaaaacaataaacaaaacaaacaacgggacaaaaaaaaaaaaaaatatttggcgggggggaaaaaaattagagagggccagaaaaagcattgtacaaaacagctagggcacaaaagggaggaaaaaggttttaaggacaccgcggga

SEQ ID NO: 666674 - DNA, 168 bp, Homo sapiens
atggatgtagaataaaaccagccatccataattgaatctgtaaggtcagtgaacttagccttttcaggttcaaagattacacaaacacaaggattttctttatcgtttcaccctttcaagaggttttctcttttattttggccaccgtgttttccataataatgaagt

SEQ ID NO: 666675 - DNA, 226 bp, Homo sapiens
tccacgctttatacttcttttagttcatggttttatagtagaggtttctatgtgtttttttttttgggaacattatatgtcggatacatatagggcttgggagacaatcaagtaacaacggaaaaggtgaaagtaaccatatctgacaaaattcccttgaattttaatccttggctggcaacatttaagactcaaagtcacgggtcatatgggattcaagtttttt

SEQ ID NO: 666676 - DNA, 152 bp, Homo sapiens
ggcaagcactcagcccagcctcgaggtccttctggggagagtttaagtgacagagtccggtcagggggcaggagtttcccaaggttctggcccacctgctgtctgtctgctcctccgagcccttggacatgaggcagccagatgtccccagg

SEQ ID NO: 666677 - DNA, 302 bp, Homo sapiens
tgaatgtaagtggtggtgaatgtgccggagtagtatgaaggtgcagtatattataagaagttctggtcagtaacggttgtcgagagcagaaataaatctttgcgcggttgaccggtggctcattccagaagcaggctgggatcgctcaaaatctaggttcccaaatgcatcagagtaagttcctagcatgctatatttcataatttccactatatcctcagcgtcttcttgggttgcttcctctctcaattccaaccttgctcgtgcctctgtcagacgaatcaaagattccaaatgccagg

SEQ ID NO: 666678 - DNA, 208 bp, Homo sapiens
tctctttcaggatcttgctattgggggtggccaaacgggattaaagaagctcaatcctggggtcactcggtaggatcctccagtttgaaaggagccttcggaatcctgggtcccgttcaacacgtgcccgaagcgtatcttgcgcttgcgttgtcctagttcgcaggggatccctctagaagtccgacctgcgaggcaatgcaaagct

SEQ ID NO: 666679 - DNA, 230 bp, Homo sapiens
tcgacacttcctgagtagctggattacaggcacccgccacacacctggctaattttttgtatttttagtagagatcgggtttcacaatattggccgggctggtctccagctcctgatctcaggtgatccacccgcctcagccttccaaactgttgggattacaggcgtgagccactgtgcctggccctaaatgccagatggaagtgccccattagatggaagtgccccat

SEQ ID NO: 666680 - DNA, 99 bp, Homo sapiens
taaagaaagggatttatattccaaagcaattcaatgtttcatttgaaaaatcctttcccaagtagaacattctcatcattttaagatttagttccagga

SEQ ID NO: 666681 - DNA, 225 bp, Homo sapiens
ctggtagacctaactctaaaaccaggcacagcctagggggcgggtagacacacactctaaaaccaggcacagccctagggggcgggtagacacactctaaaaccaggcacagccctaggggcaggtagacacactctctaaaaccacaattttcttcccacctctgggggtcagatttatgaatgaaatctcagctgggagggtccaggtgttaggtctacctgg

SEQ ID NO: 666682 - DNA, 1557 bp, Homo sapiens
  misc_feature (945)..(945): n is a, c, g, or t
  misc_feature (1313)..(1313): n is a, c, g, or t
ggatcaggcaacgggcagtgattagacaacgatagctcactgacgtccccgagcagaggaactttgctccaagtgccaggtcatatcgatatgagagggcggagagcagaacggtctatctactaggctatcagtctgtagtcaggcgcatcatatgcgacaacagtttcccgagtgatggagacttgcacgcctagcaggtcccaaacagctggcagaagtctggtacaaggaggcctagggggcccgccgggggatatccgacgcagctcgctgatgtctgtgatgtcgagcacacctcgtagccaagtcctagtcatccactacggcaacaccttcgagcggcgtacgtcgaagggacgcactaccattcaccatgaacacttgcaacccgagacgagacttgaaccagattgatcgaaggcagcgtgaaacaaatgcgcttgcgtactagagcactcattcccctagttgcaagccatagagtatgtcagagggaattgcatcgccgcattgtgcttcacttgcgcaactccagctggaagggacgtcggagggctcgatcttttccggaaagcgccttccaggggctaggggggttccactgggcacggattagagttgggaatgggtaagctcgtcagcaaatccggaggcaattcaattgcacacgtttgcgaagtacactgagagagcgaaatagctgcggccagttttcaacccctctgttgtcattgaccagtctgtgtgtgcccccagggaactcagtctccgggcagaggcgaccccctctgttccaaggggactgacatgggatgacaattctttgcatagaggtaagtcctcaccaagctggaagtggaatcccagagaaggcagagtcgttgtggggtaccccttgtgtgtgcaattgcatggcttcccacagattcgaacgtggaaacnttcgcaatcccttcgagtgttgacccccgcgagagagttacgcatatcccgaaggggcacgggtgggggcaaatgccactcccatatcaaagatagaggacctcttggggagcccctatctcggcgactcttgggcgcacaagatatccaaataagtaaaattgcacaccttgcgacaaatggaagccccttttcaccttagtggacatgccaagtcggaccacacccgccacttcgggatcggggtcagccaaccatggggtgggctgttagcacgagacaacgcgttccccaaggtgcatctgccggtggcacccgtatctagcgaaaaattggcctatggacatgtgtttggcgcaaaagaaccngtcggtaaatccctgttaatgagaggccgatcagagcgtgatcagggacagcaaccttgaagcgggagaccctgtgtcatgagggtacaaccctgtgtgagactccacacattccgggggggaacccgatgatatagagacatcaccacagctggtgaaacgcacagcagtgaacttccgatggagtagagggcgatcaagactatgagcgaactggtgagacgccaacaacagtgatctctat

SEQ ID NO: 666683 - DNA, 582 bp, Homo sapiens
cgtaattgtctaactgaagctgaaatcattggtgatgttgtatgcctggatatatgatgtcagcaatccgcaaatccttatgacatactggtcgccaggatttttgtaacgcacagcactgtgtatggacaggcagacataccttgcttaaagtcggtagcttgcaatggtcagtagcgtgcaatgaaggttccactacaaagaatagcagatatttcaccgttactggagtttctggcaggaatgcagcaaatagtggcctccagcaagagccttgcacgttgcaatactggttggtatgcccccagtacaggatatcttgcgtaacaattggactaacaatggggcatgtatccagatggagtcattacagagacagactctcccgagactatgggccacactgtgatagactagagaattggagaaaagtctgggtctttctataaactgttggaggtgacacaagctgagcgtcaagagttccacgttaaggcttcgagcaagtttggggctactggtttgcagttggggcttgttatgtacaaagcattgtggaagacagcggtgatatcgcagaat

SEQ ID NO: 666684 - DNA, 518 bp, Homo sapiens
gcgcgctaaggcgtgcctgttctgtgccggcagtaggcagcagagccgggagcagtagccgcgtgggagggagccatgaagcatacgaggtggagattctggacgcagaagacaatggagaagctgtgtgcgtggacaaggtggagcaccagccaccattgcggagatcaagaagcatcttcactaagagccatccgcagtggtaccccgcccgacagatccctccgcgctggaccccaaagggcaagtcccgtgaacggatgaggatgttctagcagaagctgcccgttgggcaccagggccacactgtacttccgggaactgggggcccagatcagctgggctgacggtcattccgtaacagaagatacgacggggaccccagttgatcaatcataccgtgtcatcatgtcgtacgttgccgagttgccacttcatactatggaccaacaaagtatgaactttagagtccaagtcggacgatacaagttggatgcaagcgtcgaccttgacatctg

SEQ ID NO: 666685 - DNA, 875 bp, Homo sapiens
  misc_feature (50)..(50): n is a, c, g, or t
  misc_feature (63)..(64): n is a, c, g, or t
  misc_feature (69)..(69): n is a, c, g, or t
  misc_feature (72)..(72): n is a, c, g, or t
  misc_feature (77)..(77): n is a, c, g, or t
  misc_feature (79)..(79): n is a, c, g, or t
  misc_feature (84)..(84): n is a, c, g, or t
  misc_feature (86)..(86): n is a, c, g, or t
  misc_feature (91)..(91): n is a, c, g, or t
  misc_feature (94)..(94): n is a, c, g, or t
  misc_feature (113)..(113): n is a, c, g, or t
  misc_feature (120)..(120): n is a, c, g, or t
  misc_feature (130)..(130): n is a, c, g, or t
  misc_feature (134)..(134): n is a, c, g, or t
  misc_feature (139)..(139): n is a, c, g, or t
  misc_feature (142)..(145): n is a, c, g, or t
  misc_feature (153)..(153): n is a, c, g, or t
  misc_feature (155)..(156): n is a, c, g, or t
  misc_feature (163)..(163): n is a, c, g, or t
  misc_feature (181)..(181): n is a, c, g, or t
  misc_feature (187)..(188): n is a, c, g, or t
  misc_feature (190)..(190): n is a, c, g, or t
  misc_feature (198)..(198): n is a, c, g, or t
  misc_feature (204)..(205): n is a, c, g, or t
  misc_feature (209)..(209): n is a, c, g, or t
  misc_feature (236)..(236): n is a, c, g, or t
  misc_feature (255)..(255): n is a, c, g, or t
  misc_feature (273)..(273): n is a, c, g, or t
  misc_feature (346)..(346): n is a, c, g, or t
  misc_feature (355)..(355): n is a, c, g, or t
  misc_feature (359)..(359): n is a, c, g, or t
cgcggtggctcacacctgtaatcccagcacttaaggaggcagaggtgggnggatcacgaggtnnggagntcnagacnancctgncnaacanggngaaaccccatctctactanaaatacnaaattagccnggcntggtngcnnnngcctgtantnncagctantcgggaggctgaggcagnagaatnncntgaacccnggaggnngagnttgcagtgagctgagatcatagcactncattccagcatgggcgacngagtgagactctgtctcnaaaaaaaattacgtatgataaacttcccacattttcagtggtgacttttaacacatgtatccagctgtgaaancactacccnatcnagatgtaggaactaacatctctggaaagttttctcatgcccctctgcagtcagtctcccctcgaaggcccacatcccctttaatctttaatcgttgagaacattttactgacaccaaagcattttgatcactttaaagtaatgatcatgcacaagaatttatggtcttgtgtaggagaccatgtgagaattcgggagagatgccgaggaatcaaccgagttcgttccaagacagctctgtgggtttgaccttgtggctggggggtggtatcctctgttcatattcatggagagggagatgtcctttactgacatattatttccattgtccttaatatatctgcgattacattatatgcgcagggctcaacgtatcagattggagcggggggtcacgcggtggacatgggacggtataaaacatccggggacgaacgtgggggaaataagcaggagcaaggcaaagaaagaccaagggagcagaaggtaagaggacttaacagtgtagtcgtgttgc

SEQ ID NO: 666686 - DNA, 219 bp, Homo sapiens
  misc_feature (10)..(10): n is a, c, g, or t
  misc_feature (58)..(58): n is a, c, g, or t
  misc_feature (66)..(66): n is a, c, g, or t
  misc_feature (192)..(192): n is a, c, g, or t
  misc_feature (219)..(219): n is a, c, g, or t
cccggcaaancaacaaaatcgaaaattgaatccagtcctggtctcaaacaaactcttnctctggcnttttttgccattaccgtgagacggtatctctgtaatcccagctactcagaaggctgaggcaggagaatcacttgaacctgggagacagaggttgcagtgaccgagattgcaccattacactctagnctgggtgacagaacgagacgccgtctn

SEQ ID NO: 666687 - DNA, 1018 bp, Homo sapiens
tctgagacttggtttcatgcctcccggaggccatctaagcccccgcagcggcgacttgctgcgcccttgggtctgccggtcccggttccaacaggctgagggcctgccctttgtcttgtcctgggatatctggctactgcctcgtgataaatggagatatatttgctcactgacacaatatcaatatactggcctgtgtgtattttgttctgaagacaggcagaccgtgtgcccaaaaaccaggacagggaggacttctaagtaccagcgagttgtctcatgttctgtcttgtcttgctgtttcttggggtaatctctgaatgttgacaatgcaccacgactgtgggtgctttagggctcacacgtttgtcaggaaacatcgtggaagggagagcgggctgtgggaatgtcttgaatggcatagtgtaggatgtggttctgggacctctgccacctgggttaatgggtctatgggctctagagcagaacagcatgacagcgtatctcctcctacttcttgagcgtggggttgcgtcttgtcgtctccactaagccagtagatgctctggacctgttagctgatagaacgagccactatagatagtgccagaagaaatttgtcctttcgggacagagtctccatgcagaaatgctactgcagccacttataggcgggcgaacgtcacttgatcttggcgggacgcgtcttctgctcaacgtgtcctggcgcgtcgtaggactcactgcctacatgaatttcctgagtctattacagtgatgttgcacattctctgggcagctgggatagcccgtgtgctcaaatacggttacgtcgtcttctcctggtgtaccccggtttggatttggcccctggcctgtgtggttgctggggcctccgcggcgacgggtgtccttgccggccgaaagtccccgattttagaaagttccggcccagccttccggtccggcaccggccgggggcctcttccgcccaaggggggcgccccaggccgttcca

SEQ ID NO: 666688 - DNA, 341 bp, Homo sapiens
  misc_feature (31)..(31): n is a, c, g, or t
  misc_feature (224)..(224): n is a, c, g, or t
aaaaaaaattatttttgcccctttcagtagnaacggtgcccccggagaagatcacccacctacccaacacccaacccattcaggggtagggattatggtgggttgttcagtgcccttcattattcctcagattccttaaagtatttgagaatattaaaaatgcggctgagctctgtggctcatgtctgtaatcccagcactttgggaggctgaagcggttggancacgaggtcaggagttcaagagcagcctggccaacatggtgaaaccccatctctactaaaaatacaaaaattagctgggcgtggtggtggcgcgcctgtagtcccagctactcggga

SEQ ID NO: 666689 - DNA, 301 bp, Homo sapiens
  misc_feature (64)..(65): n is a, c, g, or t
aataacgtaattcatgtatttttaaaagttggtgcttttaactactgtaatgtcccccaaatanncttgcagctaactatataaatacatttttataataattatcccctttttatcagagtatagtagagcaaatgaaatatgcttcatttaatcctcactccctgggttgttggttttatgccatgtttcagccagaatcaggaaactccagggccttaaagaggttttctcctcataagtgctagtagttatttgtggctcaatattatccagacccagtgggaatagtttttatgcc

SEQ ID NO: 666690 - DNA, 947 bp, Homo sapiens
  misc_feature (27)..(27): n is a, c, g, or t
atggaggggcgcggggaaggagggggnagagaggacggaggaggatatctcttcctgcttgcattgcattatagcgggcgagaacggaactggtttagaaaaccctttaatgtgtggacagaacctctctcccccaagaaggggttctacaagttgtggacccaattcggcacacgtgggttccaggtgcccagggatatgctccccttcccttccgggattgtgaccgaaaacttgtttgtgataggcccttaggagagacctgccacttaactcgtagccgagctttttttaaggaggaaaacgggcgccacgttccctcgttaaagaatgtaggaagacgcgcccccccccccctttttttgatgaaccttcaacccaaaaattaaatttcgggttcatcccccccaaagaccccggtttcaaccccgatgtgattagtcctccccctgatcaaatgtcttggggacaatcccccttccttatcaagcggttatcagaaatattgccaaggacaaaacaatatctgttgcgcccgtccatgtccatgattggcagcaatgtgtccccctcgggggaaatttctggcccaccaaaggaacgcccctcggccaaagttaaagatgcacgtacactatattctcgccaccataatacaatacagtgtcccagaagccccaaagtgtgaggtcaacatgtttctaaaccccggctttatgccagaaccaaaattggtgtcacttgcgactttgcagcacaaagaaaatctcattaaagttacaggggagctcattaaaatcagagcccccactagtacacgtcatcttggagacacacttgaacgttacaaacgtaaaaaatataatcaagtaccgcgagcgtgaagtaatttgattttaattgggtttttccaaacaaaaattaaaatttctaagcccaaaaaaaca

SEQ ID NO: 666691 - DNA, 242 bp, Homo sapiens
aatatctacagcagggagaagtaagactggagcagtctgttgctctgagtttcccaaatgaaatactgccttggctagagttgaaaaactaattgagcctgtgcctggctagaaaacaagcgtttatttgaatgtgaatagtgtttcaaaggtatgtagttacagaattcctaccaaacagcttaagattcttcaagaaagaattcctgcagcagttattcccttacctgaagtgtcaacgt

SEQ ID NO: 666692 - DNA, 121 bp, Homo sapiens
ctcgtctccgcgtctctcgactctctctgtcttcctctctttctctcgtgtttctctgtctctctctgtccgactctgtctttttctgtctgtctgtctctctctttctttctgtcgtctg

SEQ ID NO: 666693 - DNA, 137 bp, Homo sapiens
ccgctccttcatgaccgtccactgtgctatcgggcggtcttgtcactatgcttcctcacgttgaattatatgcgcttcgagagcctgatatctccccgacccctccataacacggctccatatggcaggctgaggtg

SEQ ID NO: 666694 - DNA, 1069 bp, Homo sapiens
  misc_feature (244)..(244): n is a, c, g, or t
gtccacgtaacaggattgtgatgccaggaggctatagtcgtagctcgtgctgccacactattctgccgcttctgcgtcgacaacgggacacgagagaagccagttcaaggccgcatagagacactacacgactgttcaatcctgctccggaggaactgcgtgaccgtcgagcgtgcaaacagcgtcgtgcctgagccatcgcctcactaaggttgccaacgcgaataataatctctctacgaanttggttcacaccatgcgacagaacggtgggccgacagtagatcgccatggtggccgtgtcgtagtaatacatttcatggtagcagtgatacatgcgtatagtatagcctcttatgatgcttggaaggaggctcctggtatgctattgcgccgtgaagtcatggagttgtaatcggtgacctcgtagcctgttcgagttcagtgacaagtcaaagaatcgcagatgaaagcaatggagtcgtgtgccatgtttgtgatgggccaatttcgatgaccatggggttcataggctgctcctgaaatgatgccggtgccgtagagaggctcgcctggcttcgtggagacacctggaatcaaagagtgcgcacgggtgcccctgattggcacgcacacaggtggcgctctgcgcactgcatcacgtaagttacccagggtgctacgtaccacattaacgctttggaaaccaaagaagcttctgtcgtataccaaattggagcgctgcgactgtattcccgaattggaccctgggacctcaaggaaggtcctcgtgaagaatcttcactacatcttgttgagagcgaccgaaagagaacttctaaacacctagaacactctaattttggctactctggagggcgtgtgcattccaaagcgaatacacatagggctcctatgctgcgttgtgatttcagcctttgattcccataataattagatttgaatgatgtcaaggctggtccttgcatccgagcacgagtggctacgggcgaatcgcccagtgtgtccctaggttcccttggagattacggaaggaaaggggatggcc

SEQ ID NO: 666695 - DNA, 313 bp, Homo sapiens
tagtactacgagagccgttgagttcgcgggcaatccgtgcttgggagaatcctgattgagcagagtttcaatgcgaacggattcaaaatttgatagttgttggtaagccttagagatggtacgcttgatgttggtcatgatgtgcctttcttatgtgcttggtagcttataagcataggtcatcatggcctttttggtctatttaatatgtgttgcacttgattgtaaacgcgggatcctttcagcatcagattagacgattgcatcaacctttgcttatcattgggcacacttcatcacgattgttgtttag

SEQ ID NO: 666696 - DNA, 200 bp, Homo sapiens
gacgagatctgtggggagctactgttatagaatgagtacataaaaagtcccagtgacggtggaaactagctagtagattgcaaccatgtaatggaagctgctgctgagatcccagtcctgcaggctgtgttctttcagaaagatgcgatacacctccacgcatacagacctttctatcgcatagcttcacactatacaac

SEQ ID NO: 666697 - DNA, 1424 bp, Homo sapiens
gagcggcgcggcagcggcaggaccgccgtggcgcctagagtagctgaccctggtggtggagcgctggggcgacgctggctgcagtggacccggtgacagctgtgatgcatgtgttctgcagatgtactaggttttgacaagcttgcatcatgcgtgagtataagctcagtctgttcgttggctcatggagtgctgttggcaaagtcgtgctattgaccttgtaccaactttcgcttcacaggcaattattcttgtcagaacaacatcaccgatccctaacgattagcacacgattctatatacgaacacgcaaggctttgaacgtacggaatgcacaaccacgtgctacttgctctgaacactctttgggatacttgcaggtgacaccgggaggccacactttaccactgcaacttgacgtgggcatttctataccagttgcaacacaaacttggaccacacgcgcacctttgccattttacgctatatactatcccaatcaccaggcgaccaggtccagcactcttaacctgaaatttaacaaaggaaccctgcagcagacacacgcacttactttcgacgctttaacacgaaccacctttgacgtgacctgctttcccagcttagaactttcaaatgcactgcgtaaccttacacgctcgtgaccctttgcggcacggactgcacaccgaacgttgctacgcggggaacacgggagcacctcgacggggctaccacacgcaagctccttaacgcaccagcatgggaagcacaaggctggcgacactccagaggcttttggtttggccggctctctcgtttcgagcgacaaacttcccttatccctatggccccactaagcacgtaccggaagcctcctacagttcaacagccttggctgacaccaccgttagtaacgaggacagtcgatatcgtgaacgttgaagcctcccttaaggagcttggccgcggggccgagaagaactatattaacacgccatcggtgatcgcgatcatacagcgtttcccccaaggcattggcgcccattggagcggatcacacactgcgcggcccgtttctgtggctcagatcacacttgataggggttttccacgatttccaccgctggtgctttctcacggcctcctgtgagcgctgctttcaacacatcttagacttgactcatagagcacactggtggcgcaactcttgtggtcgacggccatctcgtgtgtgcgagaccaccccccgatggtgtgtttccattgtgacagacgcgacacactatcgtcgtgcttatggcggccctccacacgactgatgccgacacgccaggcggcatgtgactccagacgagcgtagattttgtcagccgaccctcgattctgagtggtgttaagaagccccgtttaacccacagagt

SEQ ID NO: 666698 - DNA, 427 bp, Homo sapiens
cacgcggagagagagagagagagagagagagagagagagagagagagagagagagagagagagagagagagacatagagacactgcgatcgaccgcttccccttcccttttattccttccctccctcaccttctttcttttctccccccttctttccctcttttccccttcctccttttctctctctctttctttcttcttcttctctctttcccctctctcccctctcttctcctctctccttcccctctcccctttcttccccttcctcttccttcttttctctctctctcttctttccttcttctttcccttctttcctttcttcttcttcttgtcctcttcttttccttcctctttcttcttcttcctctcttctcctcttctctttcctcttcctcctctcttccttccccccctccccctc

SEQ ID NO: 666699 - DNA, 169 bp, Homo sapiens
taatattggggggtgacatttataaaaggtattgtatttatgtattccttttctaatacttcattgttagtatacagaaatgcgactactttctggagtacccttcatggcaccgaggttaaggaacctgacaaggatcacctgagaatgtgggatactatccctagcc

SEQ ID NO: 666700 - DNA, 158 bp, Homo sapiens
atggcgacatacaagatcagtcaacttcagtaagatagatactagaaacacatatttatggtctttctgtgacggggatgtgaataaggcttatccttaaggccttcattctttaaacaaacaggttgaaatggtatgtggtaaaagagaaagacggg

SEQ ID NO: 666701 - DNA, 160 bp, Homo sapiens
atttatgtttatcatgtcaacttgcattcataaattacattttaaagtatcaaatgttttacttagctccaaattccacaagatttgctaagttctgcacaggtttggccactaatatacagtgttcttgcagcataggggatggagaatctgtaacaga

SEQ ID NO: 666702 - DNA, 420 bp, Homo sapiens
ctagcgccgtacagcagcccatgcgcaaaaccctgagatttcccggcgaaacgcttcgtaatggcggccaatttgtttagctcgttattctggtgtgcccgcatggaaattaaggtcaactttctcgacaaccttcggcttgaagccaagttcgatgacttcacggtcattgccgaccagcccatccgctacaagggcgatggttcggcaccggggccattcgactacttccttgcttcgtcggcgttgtgtgcggcgtactttgtgaagttgtactgccagacgcgcaatattcccaccgagaatattcgcctgtcgcagaacaacatcgtcgacccggaaaaccgctacaaccagattttcaagatccaggtcgaattgcccgcagacatctccgacaaggaccgccaaggcatcctg

SEQ ID NO: 666703 - DNA, 866 bp, Homo sapiens
  misc_feature (552)..(552): n is a, c, g, or t
ctgtgtgtttagggtcagtgtggggcggggagtagtgttggaagtccatgtcagtcattggtttcctagttagtgcaaactcaataagcctgtatttactggaagccatttttctcataagattaacactatgagaaaccatctactgtatatacacccccagatgtatatcgcttttctgatttgacttttggctgattgcttttgaagttaatgtggtttagtcaactgaatgttctaaacatctccctttacctacctggtcggtactcctggtgagtttttgaaaggcagtgtctttcccacagagattaattagaagttagtgtgtgcagtacacttgaccctatgtttgacacacattcagtatatggtggtgattattgtttgaaaatgaaacagagctctctgatggaacctgaagaagtgggattggcacttctagatggatatatgggttgtgtttaactgctttgaatgttagtaagggaaaagtatccacttactattgttcatttctttttttcccagccttaagaggcaaaatgattntctgccacaacgtcttgggttttcttttctagcctgtcttttcatggcttagatattgcagaaaatttggtagcaccagtcataactttttctcttcttgcagacctggttgtggttttgaaaacctagaatcaagtgttaccatgaaggtggaatcagtcattgcacccgagctattcttggtggcacagggccaaatttctaacgggggggccatatggtaagggggtgtggagagcaatttatagacgggccaagaaaaaaggggggaacggaggagaggagagggcaaaacagtgctggggaggttcggc

SEQ ID NO: 666704 - DNA, 524 bp, Homo sapiens
ccagatcattgcataaatatatagtagcataaccatctcacttctaggaatactagtatatcgtcaactcatatctccctatatgcctagaaggaataatactatcttttgctcataatagctagtctataaactcaagagccactccctcttagccaatattgtgcctattgacataataagtctatgccgactgcgaaaagcagcggagggcctagcccatactagtcctcaatctccaacacatatggactagactacgtaccataacctaaaccatatccaatgctaaaactaatcgtcccaaacaattatcatgcactaccacttgacatgagctttccaaaaaacacaataatttgaataaagaaaaccaacaccacagacctaattatggagcatgcatccctcctactaatttataaaagcaacatcaccaaacaacctatgtagctgtgtgcacgagaccttatcctacagacaccataagacaaacaccatatcaatataatagctgatctacc

SEQ ID NO: 666705 - DNA, 353 bp, Homo sapiens
tcactcagacagtatggaagaaacaagcgtctgggagaacacatgggacgaagtgatactcttatatcatggcttgtagtttaaatgttagtttgactcaatttgacagtttcgggtcttggtttctgtggcaggttttaagctcttcttttataaatagttgctttccaagtctgaaatctatacattgtttcagtaatgaattcattatgtaaatttgcccagtcattcatctaaagggaataaacgttaaatggtttttttaaattttgacttgtgtcacatatgagaatataaagtatatctgtacaataaaggaaaatgaaacatcaaagtatctacctcaggtaacg

SEQ ID NO: 666706 - DNA, 877 bp, Homo sapiens
gaaacccactccaccttactaccagacaagcgttagccaaaccatttacccaagataaagtataggcgatagaaattgaaacctggtggcaatagatatagtagccgcagagggagaagatgaagaaattataaccaagcatagatatagtcgaaggactaacccctataccttctgcgataatgagattaactagtaaataactttgcaaggagagccaaagctaagacccccgaataccagacgagctacctaagaacagctagaaagagcacacccgtctatgtagcaagaatagtgggaagatttagtaggtagaggcgactaagacctaccgaggcctggctgatagctggttgtccaagatagaagtcttgagttcaacttctaaatttgcccgacagaaccctctaaagtccccttgtcaatgtaactgtgagtccaacagaggaacagctctttggacactaggaagaaagaccttgtagcagagagtcacaaaatttaacaccgcatagtaggcctaaagagcgagccgactaattaagaaaagcgttcaagctcaagacccattacctaaaaaatcgcctagagacgactagtaactgaactcctcgcacccaattggaccaatctatcacccgtatagaagaactaatgttgagtatcagtaacatgaaaatcatttgtcctccgcataagcgtgcgtcagatttaaacactgaactgacaattaacagtcctattatctacaatcagacagaagtcattattagcctgcacgtcgaccaacaagggatgtcataaggacagttaccccaagtcataggaagtcggaaatctgacccggctgttgaccagaaaatacgttgaatcc

SEQ ID NO: 666707 - DNA, 687 bp, Homo sapiens
gtgacagctgtgaggttgagcccgaggagcctggatggcggagaacaagcacaagccccgcagtgaagtcaaagcagggcaagaaggaggcggagtgacgagctgatgcgccagtgcacccggtggagctggctgatggagcccacccctgagctccctggctgaggtgctcatggtggaggtagagaacgttgtccacgaggacttccaggtcacggaggaggtgaaagccctgactgcagagatcgtgaagaccatccgggacatcattgccttgaaccctctcttacagggaagttcagtgcttgcagaatagttgcagcgcttggcccagcgtgttgtgtggacaacccacatctacctgagcgacatgggcgccgcgctcaccggggccgaggtcccattgagcttgcaggacgtccttggaatgagaccaatattcctaagcggctgtacaaggcccttctccctgctgaagaaggaatttgaactgagcaagctgcagcagctgcctggggcgggaggtgcaggagaagatcaatgccagacccaccgtacgataccttgctgcagggaccagctacaagatcatcagcgaaggagcttggccttggagaaaggacgacaaggcattgccattcgaggacgaagttcctgtggagcgcctgatgggagctcgttgctccc

SEQ ID NO: 666708 - DNA, 383 bp, Homo sapiens
ttataacccacgatcactcagtctttacaaacatcaggtaagataagaccaggtctattaattctactctctcactaatctattgtaattgagacaggatcactctgtttaacccaggctggagcgcattggcgcagtctcaattcaatgaaagccctgcttctcgggctacagcaatccactcttcctcaaactccccagtaactgccaacacaaccagctaataagggctattaattctcattttatatatgacaataatgagccagagggaagataacagcagttttctcagaggtgcacataggtaataatatgcagcaatacttggacccatgccctctgcattttcggaaggacttggttccttagcaaaggtggtt

SEQ ID NO: 666709 - DNA, 127 bp, Homo sapiens
  misc_feature (61)..(61): n is a, c, g, or t
  misc_feature (71)..(71): n is a, c, g, or t
  misc_feature (79)..(79): n is a, c, g, or t
  misc_feature (91)..(91): n is a, c, g, or t
aaaaattacagcaacattatcaaagacaacatatgtaaaatgtttgtacattaccaatatnagtggcagtnagggcaanctgaagaataantagactgagtttccgggcaatgtctttgcggcacga

SEQ ID NO: 666710 - DNA, 564 bp, Homo sapiens
  misc_feature (564)..(564): n is a, c, g, or t
agcggagttccaccagtccagcaggactgccgtcggctccgcggggggggcgggaccgggcaccccggggacgctgcgaggagtcgctcctacggcttctgctccgttctgctcgcgcgtagcgcgttagcatcacgtgctggacaactactgcgcttgtgccctctggacctcttgctacttggctgtgttctgctacagacgtatggctacaggtggccacgtttccctggaggaagccaattgctggacttgttcaggtgacatactgtactacatcggtctgtagcagcacacgtggctggaacgcatgacaacatagttcctcgattctcgtcgcagttgacggtattggcgtccttggcaactggggcacatgactgggacacttgtgaggacccagagagatcgtaccgcagacaagcaaagtccgcacacgtcagatgggcatcatgacagggctaataaacatgggtgacagaattttgcttatcttgcaagggacgttttcgaaacgatgggtacactggcgtaacacgcgacgccgaatattgtgcactgacn

SEQ ID NO: 666711 - DNA, 207 bp, Homo sapiens
taatccaagtactcactttgtccaaatgatcctagtaatggcctagaaatatctttctcttaccggtaatgaatcaattttacccaggtatattaatacgagaaaaaatggtatggaaaacacttagtatgcagtggataagaggaattgggtataataatgggggggggattatttttaatactaaagggtgcggaaggggtaccg

SEQ ID NO: 666712 - DNA, 240 bp, Homo sapiens
tcagtgcccccagaaacgaagcggcccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctaaaa

SEQ ID NO: 666713 - DNA, 581 bp, Homo sapiens
tcagtgcccccagaaacgaagcggcccggacgaatttctgagtcaccgtcgcgagaaagcgggctgagccgccattttgaagcctggcaaaccgaagcaagaaatgctgccgtgttggatctttgccatgcccttctgttgcctgagatggtgatgcatgtggctgctggatgtgctgtctggtggctgcccctgatgtgatgcttgtgtgtgatgtgcctgtggttgtggtggcctgctgatgctgcttcctgggccctggacttggcactggagcttggtgcttgctgacctgctggcccctgcctgccagccagcccctgccctggggccccatgtgcctatgccttgcccattggatctgaaggatgcccttgtgctggaggtgcaagctgctgccagatttgcacatcacaacttgagcaatactgcacattgggccgcagcagtggggcatgcacagcatagacgttgctctgggccctcccttgcgggccacccaacacaggcaacgcagcaggcacaagccacagggtacccaagacacccaaggccacaaaccacgggcctaaccccgtggg

SEQ ID NO: 666714 - DNA, 331 bp, Homo sapiens
tctctggatcaggccacattgcctgaatctccacaagggtagaagggcgtgacaggcccgcagcaccacacgtggtataggagagtcctgacagtcaccaccctaggaggcctcctacctgctcccacgctcacctgcaagctgtaccccatggcagccagagggcacccgagagcacccgagtgagggcctgtccctaccctgtccagtgccctccatggctcccacctccctcagggtcaaagcccaaatcctccctgcagcccacatggtcctacccggcctgctctgtccgttccccaccgacctccttttccctctctcccctcct

SEQ ID NO: 666715 - DNA, 144 bp, Homo sapiens
ctcgacaccatatgtaacatcccaaaggggagacagttccagcctgctgcatccggcggctggcatgcctggtccctgtgcatgttgccatctgtgatgctgaggaaggggctatattcaaagccacctgacaacatacggctc

SEQ ID NO: 666716 - DNA, 474 bp, Homo sapiens
ggccggaactggtcgatgtgaggcacctaaaaaatgtctaccgcagttttcaggcgtggattccgtgaaggaacaacaggctaaacccaagagggcagctgtggcagcaatccaggttcatcttacggaatgtcaccgattagtcatgcgataaatgttctggatcttcacaaaataagacaaaaaaaaaaacacagcaagaacaaaaaaaacaaaggataaacaatcagaccaaaaaagataaaaaaaaaaaaacatataagcaagagagtgaatggcacatgccctgtagtcctagtttactcaagagtgctgacgccaggagctatcacttgaagcacagaagatccaaacgctgcagtgcagctgagaatcatgaccactgcaactccacgcccagagcaatacgagcagagacccatgtctctaaagaaataaacaaaatactgaaacatattcacgtctccacacaga

SEQ ID NO: 666717 - DNA, 300 bp, Homo sapiens
tcccccctccccccgagcgccgctcccgctgcaccgacctcgctccctgttttaagctcgtgctaagctagcgccgtcagcgactccctttatgcgccatcatgattatctaccgggacctcatcaaccacgatgagatgttctccgacctctacaagatccgggagatcgcgtacgggttgtgcctgggggtgcaggggaaaatggtcatgtggacagaaggtgacattgatgactacctcattggcggaaatgcctacgatggaggcccctagggcgaaggtaccgaaagcacatgaa

SEQ ID NO: 666718 - DNA, 599 bp, Homo sapiens
catggtggtgcacgcctataataattacaactacttgggaggctgaggcaggagagttgcttgaacccagggggcggaggtagcagtgagccaagatcacgccactgcactcaagcctgggcgacagaaaagcacgacctgtccttaaaaaactaataatctatcccttatacttaagatattgccctctattgtcattatctgcttaccagtattcttgtctgacagagcctgtaactactctaattctcattaactaacccatttctcctttacctctgggaacttctctatcttctccttagaccccttagacagtgaaaattcaatcaaaatgacgagcaatctcgctctgtcagacccaggctagagtacagagagacacacctctcagactcaagtacagacgtcaagacctctatgggattacaaagacaaatacctcccatggccttcgggcgaccacgaaacaaggactaccctctccaaaaaaccatacaccaataaatcagaacagcatatcttgggcacacaccacaagtaatacagacgaaagacataagcacgcccgtattacccaagccaccagacgaacaatg

SEQ ID NO: 666719 - DNA, 307 bp, Homo sapiens
gaaaatgtgacggccaagctccaggctacggaaggtcattccccccgaccagcagaggctcatctcttgccaggcacagcagctggaacgactggccgtaccatctttctgaactaccaacactccacgacacggacgtcgacccctgcaccctgagtcctgacgtctgacgacggtggtcctcgccgactcttcgtgacgacccctgacccggcaagacccctaacccctggacacgtggacgccccgttgaccacccactcgacacaactgtgaacggggactcctctacgacgtcgaccctgca

SEQ ID NO: 666720 - DNA, 765 bp, Homo sapiens
agcgggaggaggagggactcggtgggaggatgggcttgctctcaatgtggcgcaagttgaaaagtgcaccagaccaggaggtgagaatacttctcctgggcttggataatgctggcaagaccacgtcttctgaagcagcttgcatctgaagacatcagccacatcacatcctacactagggtttcaacatcaacagtgtacaatcacaaggtgtgtaaactgaatgtatgggacattggtggacagaggaagaatcagaccgatactggaagaatatatttggaaaataccgatattcttatatatgtaatcgacgagtgcagacgagaaagaagattgtgaatgagacgggtcaggaactagcggtaattgactggaggaagaaaaactaagtagtgtgccagtgctcatctttgctaataagcaggattagctcacagtcaggccctgggctctgaaattggcagaaggaccgaagcctggcataccatccgcgaccgagtctggcagatccagatcttggctcagtctctcacaggagagggcgttacaggatggcatgaacgtgggtctggcaggatatgtcaatgcaaaagaatgacattaacatctagacgaatggagatgcaggagctgccggagagcccgacattcggtcctgcaaaaacatctaattgggctgctttctgacccaaactgttactccatctgtgtacagctccagctgtttgaagagacgggaccaacacggcttcacacagaatc

SEQ ID NO: 666721 - DNA, 326 bp, Homo sapiens
tccgggccaaaaaaaaatcccctttttttaaaaaaccggggggttttttttccccccccccaaataagggggtttgggaaacccacccccttctttcccttgtacccctttttttttttttttaaaagggcgctgtcaaaaaaatttcccaaaacctcctcaaaagccttttcaggggtttttgcagttccccccaacatttttttttttacccaccccccttttttttccccccccccctttttttggccccccttcctgtggaaataaacccccccccccccatttcttttttttccccgggggccggggcctttttttttcaa

SEQ ID NO: 666722 - DNA, 714 bp, Homo sapiens
  misc_feature (15)..(15): n is a, c, g, or t
  misc_feature (61)..(61): n is a, c, g, or t
  misc_feature (94)..(94): n is a, c, g, or t
  misc_feature (111)..(111): n is a, c, g, or t
  misc_feature (118)..(118): n is a, c, g, or t
  misc_feature (148)..(148): n is a, c, g, or t
  misc_feature (171)..(171): n is a, c, g, or t
  misc_feature (523)..(523): n is a, c, g, or t
actccttgatattgnttctcataacacagtttttcatttgacttacgtgtgtcagtatcanttctcctacctgtccccgttcctttacaggacnttttaaatctaatattnatgtttntactaaaattacagatagatggcatagggnaatgaaacgttgaaaagaagaantaaatataaggaagagaatatatggtagtaattttctgtggtaggcagagaaagtgaggtttagctcagctgtgacttggcatctaggttcacacagcttgtgatagtcaaaaaagaacctgtgttgggtatggtggatcacaactgtaatcctagcactttgggagccgaggtgggaggattgcttgagctcaggcatttgagactgggtaacatgggagaacccctgtctacaaaaaaataaaattagcagggcatggtggtgcacgtgtatagtcccagctactggggaggctaaggcaggaggatcgcttgagcccaggaggttgaggctacagtgagccatggtctngccactgcacttgagcctgggtgacagagggagaccctatctcataaaaaaaaagggggggagctatgctgcatagtggcacacacctgtaatctcagcactttgggaggctcaggcaggcagatcacttgagctcaggagctcgagaccagcctgagcagcatggcaaaactccatctctaccagtacca

SEQ ID NO: 666723 - DNA, 499 bp, Homo sapiens
ttttcacaggggatctacatgctctgactatctcgggatcaggtacaattggtggctgtcgcaattagcccaggaactagaggaggagagtgactaaagaccgaatggataatgagtgggtagccacccagttggttgtgatcattcgtgtgcaatgagataaaggcctcagtagcgtgcgccgctgctgtgctccttacccgctatgatgctctagctatatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctgggtctttgcattgagattgg

SEQ ID NO: 666724 - DNA, 112 bp, Homo sapiens
ttccaaaattgtcccttctccaagcaccaggtctagctctttcttgtccagtctgaagaagccttagggcatcttctctttcctggacgactttatctaatgcatccatggc

SEQ ID NO: 666725 - DNA, 202 bp, Homo sapiens
  misc_feature (37)..(37): n is a, c, g, or t
ggatgtggtattgagtggccatgtgactgtgagtganaaagatagaccctcttccctagaagcaaatctatatatatctttctgtgatttcagaatcagctgatggcaagtgacagaaaaatccagaattacagtggtttaaactggatgctgatttctttctttttcttttttctttcttttttctttttttttttttttt

SEQ ID NO: 666726 - DNA, 835 bp, Homo sapiens
  misc_feature (59)..(59): n is a, c, g, or t
ggggggggggcgggaggggggggggagggggaaggaggcgttctcacgtgaccacgganagattgtgtggcttatcaggccaaaagaggaagaggtcgtggtacttttcaacgtggcagagggggctggagacttcaaaaaatcaggtagcagtcctaaatggactcatgacaaataccaaggggatgggattgttgaagatgaagaagagaccttggaaaataatgaagagaagaaggacagacgcaaggaagaaaaggaataataaatatgaagtaagggggggacagagcaggacttgcacccaccattttttttacctgatttttgttttcaaataagaatgtaagcattttacttaaattttactgtttgcgaggagtctatagaaattttgttttaagtcttcagatatcttgagaaatagtagactgtatgttgaaaattgtactgaaataaaggagaaaattgttacgtaccatatttgtaactatcaacttttaaaacttttaccgtttttgttacatgcattggaattctgcttttgtctataaaatatggccaagtacaggtctgtgaaggcctgattctcttccttccctgtttggaacctgtggattgtggagccaacgttagctcttcttattaaacaaaaaaaaaaagggcctccgttggccttaggggggggaactctgcggccggtcccttttagcgagggtgtaattgtggagccctcggtgactggctgtcttggtctcgggttgttggggtggcggggagggggtaaagatcccatcaagggaggtatacgggtcttccatatactcaggggata

SEQ ID NO: 666727 - DNA, 363 bp, Homo sapiens
gtgatctagagcatccccgctgagtggcatataactctggggctgggggagtgtaaggataagaagcaagtgaggttgggcacaggtggctcacccctgtaatcccagcattttggagagagacagaggtgggcggatcactatgaggtcaagagttcaaggccagcctggccaacatgttgaaactccgtatctactaaaaatactaaaaagtagctgggagtgatggtgtgcacctggtagtcccagctacttgggaggctgaggcaggagaatcacttgaatccgggaagtggaggctgctacacaggaggctgaggaaggagactcacttgaacccaggaggcaaaggatgcagagagc

SEQ ID NO: 666728 - DNA, 969 bp, Homo sapiens
tgaagtggtcgcagttcctcctaagtcttgccagaaatagctctcctcatcatgagagctgatcccctcctcctggtccatgtggccaagcaaaggccttagtacttgttgtcttgcttgctgctttacatacgtggctagaccgatagtgtactaaagaaccatacagagttgacagtctgtgactcatggagtttcggcatgtgctttaccgacagtcccatttgatgatccttttcctcagcttgacccgcatgtaacgggactcctcaatgggccactgaggattctggccgaactcaccgcagactgggcaattggagcagcattgatgaaaatcggcagagtatatgaggatagagatagtagaataaaaattccttagatcgtgagtcctataactcattgaatcatggttttaattccgaaaagcatcagatcgatgtgaaccgagacatttagtatgggtttgccaatgagcaatactctagaggaaggccactgttatccccctcaagaacggttgtcgagccctcctggtcatattcgtatccgtaactctggatgaccatcccggagacaacacagaacctctactcggtatatgcatggtcacggtatatctgcgcaaaaccatggggatttcaagattggccctggaactgaggacaggcagactatctcatacagtgtgtggatcagggaggtcagaccactccttggagctgtgcctgatagtgtctctgattaacaaggatactatggacctatgtaggactggtatcctcgagttagaagtatggcgaccacggcactcttggatctgatttccctttgtttgccactggactctgaagttgcctcatggatcagagagagaaaacggtcggcacgaaatccagagtatgaaacccaggtaggccagggatccgcaaatcaaataacaagtcacagagagcatgagaaagt

SEQ ID NO: 666729 - DNA, 500 bp, Homo sapiens
  misc_feature (348)..(348): n is a, c, g, or t
tgtttcccttggtctctacttccctgattccctcctctcctacttgtctttctcttcttctctccaggagctgagaacagcccccttcctatttgaggctggcctgtccatgcgcacccttggcctcacatcaatggaggatcacccatcccttcctcgtgctagaaacccaatggctgtattccataagcctgcaggactcttgctcttctccttatttaactacaccagcttaggagtagcctacatgctccatcttcatttccttaccccatctactccacagtctaccattctcttgctgaggttacttacctggcctctttcctctacactcttttccacacncacttgtccaggtgcacattaatacctacacctgactatcctacagattacttggaattcaagatgttgggggaataaactcaccatcttactctatatgtctgcctgtccttcagcatttctcatgtgggataagggtgctatgattcacc

SEQ ID NO: 666730 - DNA, 379 bp, Homo sapiens
  misc_feature (72)..(72): n is a, c, g, or t
  misc_feature (101)..(101): n is a, c, g, or t
  misc_feature (198)..(198): n is a, c, g, or t
  misc_feature (218)..(218): n is a, c, g, or t
  misc_feature (293)..(293): n is a, c, g, or t
aaacccttcatggcccggtgtggtagtacatgccctatagtccccagctactcagtggctgaggtgaggagntcacttaagcttagcagttcacgacactnttaaaaaaaaaagcccaggcgttgtggctcacacccataatcacagcactttgggaagccaatgtgggagaatggcttgagtcccaggagttcgagnccagcctgggcaagctaggnagaccaccctgccccgcccccaatctccacagataataaaaaaaattagctgggtgtggtggtacacacctgtgntcccagctactcgggaagctgaggctgcaatgagctgtgattatgccactgcactccagcctgggtggcagagtgagcccctgtct

SEQ ID NO: 666731 - DNA, 416 bp, Homo sapiens
  misc_feature (1)..(1): n is a, c, g, or t
  misc_feature (117)..(117): n is a, c, g, or t
  misc_feature (334)..(334): n is a, c, g, or t
  misc_feature (343)..(343): n is a, c, g, or t
  misc_feature (364)..(364): n is a, c, g, or t
  misc_feature (379)..(379): n is a, c, g, or t
  misc_feature (410)..(410): n is a, c, g, or t
natttgggaaaattgtcagtcattatttctcccaatgttacttctgttcctttccttcttttgcttttcagttttggaagtgtctgttgcgaaatcttcaagctcatagattctttnctcagttctttcctgtatactaatgagcccattgaaaagcattattcatttatttgacagcactttctttaatctttcctgggaatttctacctctctggttacattatccatctgttcttgtatttccattaaagctcttagcatattaatcatagctttaaaaaaaaaatgccgggcccaatcaattccaaaaccctggccatatctgaatctgnattctcatnatcgttcagtctcttggaaanttttgtgtgtgtgtntgtgtgcaagtgtagggaaaggcagacaggngtaaaa

SEQ ID NO: 666732 - DNA, 311 bp, Homo sapiens
gtccaagctcatccgctgctcattgcccagcaccctagatcgcctgcttcctctggcgccagaagaaggcccacctgactggacgatccatggttaacggaggcactgtggccgagaagctggactgggcccgcgagaggcttgagcagcaggtacctctgaacgaagtgtttgggccggatgacgattatccgacggtctccgcggttaccacggccaaggctacaaaggggtcaccagtcgttggcacaccaaaggaagctgcccccgcaagaaccaaccgaggctgcgcaaaggggcccggattgggg

SEQ ID NO: 666733 - DNA, 92 bp, Homo sapiens
ggtcctccaaaatgttcagaagtttgcgtacctggttggcgattactggttggagactggagagcaggcaggaaagcaggcagaagagcaag

SEQ ID NO: 666734 - DNA, 1581 bp, Homo sapiens
  misc_feature (312)..(312): n is a, c, g, or t
  misc_feature (1327)..(1327): n is a, c, g, or t
  misc_feature (1380)..(1380): n is a, c, g, or t
tataaaaaccctcttcattaaatggaaacatacaaagaatagtcaaaccccttctacaaaatgccagttatcagggcggcgggtttcaaacgccaaatgtggatgtgttgtgggtattgtcaaatgtggaaattattaagttgggcggagatgagaacgcgaatatatgtggagagaaatgttgagacgccatataaatggcactgtgagaatgctcctgtgggaacgcctgtgtgtggtctaccacaaatatatgtgttgagagcgcccggtaaatatgcgccggttccgagaatactgtgtgtgagcaangggagagagatctccagaaatgttatctctctgagagggtcttttgtaaggagaggggtgtacacaataacagaagacccacatgataaatatgtgtgtcgatatactaaccaccatgtgtgtctttgcagatatatctatatgtgagtgtgatacacagtgtgtgtgttttctctctatatattaagaggaatctattaatgaggtgggaaacgctccccgaagtgtgttgtatgtggtataaaatcatccccttgatatgggccaagtatgtctatatacacgcgagtattgtcgtgtgttactacagaggagcagtggtcgcagcgcagcatcctcatctcttaaaagaggggagtaatattataaagacgccgcgaggtgtagaagattagcgcttctgtggttgtgggcgggaggcgcccaaatgtggcgccctccttcatcctcctaaatagtaatagagggagggcagggtaaagagagaggcgcctacaagagacgtctcgagaagaattgtagggtggtcacaaaaaagggggtcctcaccaaagtacaaacaatatactctctgcggccagaacaaaaaaacagaaaaaatctttctctagaagaagagtgataaaactcacaacaataaagcgaggatatataataccccccggtgtattcccagaaaaaggggccctatatttgcaggaggacacacgtgtgagtgcgtcgtcgctgattaggagaggggggccgcatatggggcaaaattgtgtacagcattattcccctccagggatgtcaacccatcttcgggcgacgcccactacaatcggggggacaataaacatgggggtataacagcggcggagagtaacaacgacgcatcaaagataaaagagccccttaaagatattatagagcgagaagccatctttaatccgcgaaattctgtcggagcaaggtttggctgaaaaacctccacacagagtttgtggctaattagagcccccgcgaagaagcngagcacacaaataaacaacaagagaggaggcatgtatacaacacacagtgtgncccccccccgttaatctaacgacgggacgcacccaacagggagcagcagcagagggcattatacacacgatatatcatataaaaaccaacggacgaacggatgcttgaatcacattagtggtagagggagccacactaataatacttataggtatgattacatagatgctgagcaagcagcctgaagcgacacataccaac

SEQ ID NO: 666735 - DNA, 1685 bp, Homo sapiens
  misc_feature (1159)..(1159): n is a, c, g, or t
  misc_feature (1267)..(1267): n is a, c, g, or t
tatagggcccaggatgtaaaactggattcctggtgcgggtaaaacttccaatcaccaacacttatagggcccacacacgagttctcctggaaaattttaaaactccctctcaaaaagcgtggttattttattccaaagtgtgagtttgtggagtctccagcgagtgggtctttactcgagtgaggaattctcgtgggtagccgagcggcgggccacacgaaggggccctctccacaacacttttgtggagacactctcgccgagagcgacacagagagtggtctaccagcttcacacgagggcagagggggctcccggagctccactcagtgtgagggagtgagagagagagtgttctctatgtgtgacactctctctccttctctgtggtggagagagcgctctctctatctcgccagcatatatatatctctgcgtggggaaaatacatcatgaggccacacacccgacgggggcgctcttgtgagagagaaaagattcgacaaacgtgagcagcgtgaaatatagcgccatatatacatctcgctggggcaccccagcgtgatgacacccacaacaacaaccctctattatcacgcgcgtgaacacacagcgggtgatgtgtctctatcacacacccgagagcaataaatctctgctactcactatgtgcgcgcgagagaaagagcctcagaaacagcggtggctctcacgagcgcgaagccgcttgtgtactacacccgtgtgatagcccgtgtgcgcgcgcggtctctacaaagcatcatcatctctcacaagagagagaggcgacgcgctccctggtaataccacccctgatgtgagaatagaaaagaacgccaatttggtgcgcgcgcagtattacgagccaaggtcgcggcgcgcccacaaggacgtgtggatccacgcacgtgcgccatcacacatgtgggagcaccccagacaaagaactcctgttgccacaagccaactgttgccacacgggggcggcccccctattagtagaacagcggcgaccatgatggcgtactctcctcaaagaacgccgtggttggagccacctataagaaacacaaaacccctctcacaccccgcggctgagcggaagacaaaataacaaccataccaacgtggcacgagnacacactaataaatctccccgacagagagaacaactctctgaacacaacaacccgcggtggtgccctagtcgtacaaatacaaatagaaaataacctgccgttcaccnatacaggcgccgacaaacaacgatggggtgcctccaacatatctaaacagacacccgcaacgttgtcctctctcacgacgaggacgcacacacgttgtacacaccaacgggtgtgtttgacccccacagaaatacccgcactcgctttcctatgtatttcgccccaaaaaatttattgtgccccccgcggggggtcagcataataaaccgcgggccccacagatttgtgtcctctctctcataagaaccacccccccaccgtgttcagtccgtaccttattgtgccaacccacggccgtccttcttacccgaggcggggtcccccgcagatgttctttgtgtccacaccagcggcggtagtctttctctagcctctcacttctccccacgccgccaactacgtgtgcttccctcactt

SEQ ID NO: 666736 - DNA, 125 bp, Homo sapiens
tagagaacccgtctacccacaggctgggtagattggccgagtccctttaactttttttaaccttcccttatgagcattgcctgtgtggggtgggcagtgagggtaataatgactgtgtgggttga

SEQ ID NO: 666737 - DNA, 941 bp, Homo sapiens
  misc_feature (466)..(467): n is a, c, g, or t
gaagctgtatagaatcattcgatagtggctcgtgcacatggctgtggtcagattggtcctaaatgcctcgtcaatgtatcctggtattctatctatgattgaaatcaaatactcactaatgaaaagcattatttcataccctcttactctccatatctacaagtgtaagtctttcactcgaggttacatgtttctcgctataccctctaacctttagtcctctctacgcacccatatcataatcaagtatgtgacattgagttagacatcttgtaaaggcacaaaaataaagagactacatatttagagagagtccctttagtaaatcagaataatatattttgtattatgaataatatacaaattttacaccctaatttatactgtatagtacaattaacggtttcttgcatgggagaacttccttaagaaggcttcagatatgaagcaagttctggagggatcnnttggaggttcctttgtcttgttttgacttacagaatctttttttacgagtaatcttgagacactcctgaaagaagctaactatggtatagaaaaggataaccaccacgtagctgaaggctaagattcaggtccgaactctcgaactaactagcttgtaacaaagcttgtgtaaccctgagtaaggttactcttgtctctctgggcctatgggtttcatccattaaaaacagaggcgattgggctaaatcactagtcccttccgagtctaatatctgtccttcctacatggaatacctggtccccataggatggttcatctaacctaggtgagccaatgtcgcggctccatggcatttcataaacaggcaagatttaaacccgggggcttatcagggttcctcaaacgcaataaggtggaagttccaaccgcggaaatctctgtttgaatcgcccagggcactcgacataagcag

SEQ ID NO: 666738 - DNA, 241 bp, Homo sapiens
cccaagaaaaacttttttaaaaagggtttttaaaaagggttggaaaattccccttaaaagggccaatttcccttttaaaaggggaccagtttttttggaaaaaaatacccccaaaacaatttttaaatttttcccaaaaaggcgtttggtggaaaaaagaaatttttttttaaaatttgggaaaccccaaaataaattttcccggggaaaccaaaagggaaagcccctttttaaaaaaaat

SEQ ID NO: 666739 - DNA, 120 bp, Homo sapiens
ggacagtagctctctcttcctgccaacggtgtcacactgatcgaaggaagaaggcaacttcaaacaagagtgggtcgcccttcacactcccatctctatcagtgagctgctagtgacggt

SEQ ID NO: 666740 - DNA, 438 bp, Homo sapiens
gagacacggagcatgaaggccttcgagcagacttaccgagagaacctgcggatcgcgctccgctactacagaccagagcgaggccgggtctcacatcatccagaggatgtatggctgcgacctgtggcccgacgggcgcctgctgcgcgggcatgaccagaccgtctacgacggcaaggattacatcgccctgaacgaggacctgagctcctggaccgtggcggacaccgcggctcagatcacccagcgcaagtgggaggcggaccgtgtggcggagcagctgatagcctacctggagggcctgtgcgtggagaggctccgcagatacctgcagaacggggagacgctgccgcgcggacccgccacagacacacgtgacccaccagcccgtctctgaccatgaggccaccctgaggtgcatggccctgggcttctccc

SEQ ID NO: 666741 - DNA, 121 bp, Homo sapiens
gtgaatgattccgagagtcacacctcgtcgcggtacacgaacatgatcacgtcggcgtcctgctcgatcgctccggattcccgcaaggtcggagttcacctggacgcttgtttgggacgtt

SEQ ID NO: 666742 - DNA, 295 bp, Homo sapiens
  misc_feature (81)..(81): n is a, c, g, or t
ttatccccaacacattgatattctgtccgaaaactaaggtaaatgatgcttaattaatataacaaaccaatcattgatcantgtctagaatggaaacatactgatatggaaggaaaatcaatggaaaaatctgaagagctagggggcccctggaaaggacccccaggtggctgtggaaacaacatggagcttaaatgaggtcatggttccccttaacaacaaagaaggaaagctctgaagtgctgttttaataccctagagccttgctccttctggaattcttctgtccccatca

SEQ ID NO: 666743 - DNA, 179 bp, Homo sapiens
agtgctgccatccatgtgatattccatgagagctgacagcgatctgcctagctgtgtctggtgatcctacattcactactttcactgcctaatgcatcctggacctcactcaaatgtgcacagaggcctccacgaagtaatattttttggccgatactcttcacagatggatgaatgtg

SEQ ID NO: 666744 - DNA, 468 bp, Homo sapiens
  misc_feature (35)..(35): n is a, c, g, or t
  misc_feature (152)..(152): n is a, c, g, or t
tttcactttcccagaggcaaaagaggccatctggnaggccaggcccatctgggctcttcccaggattcctagcaggctccacaagcccccacgcagcaagcaggaggggaggcacagaggcggcagctctccaaggtgctgaactggcactncttcagagccaccaagggatcattgcagacatgaggccccagggctggggacttgctattcctggtcttctcatttttgtggtttttctgtccagaaccaccggccttagagatgctctagtgcagtgcgttaaaaataaccctcctcccaccctgagaaccttccagctctgcaccaagcgtcacttgggccgtgagtgtgggatctgtggctgcccgggagacgtggtacctcccccaccccgcacccccgcaggagcacactttgtggcttctcaggacgagcccctttctcagtctgaccccaggagcctcc

SEQ ID NO: 666745 - DNA, 186 bp, Homo sapiens
agcatactttggatagaaggcttgtacacttggggaacacaattacacttagcatatatggtagcgggtaataactagcaccacagttacagggaattcctttacatacaccaacttggctttcacttttaaaacaaaactcagaatccatggctcagtaggatacctataatggtatggctcagc

SEQ ID NO: 666746 - DNA, 414 bp, Homo sapiens
tttttaaaaaaaatttggtagagaccttctgcccaggctggtctcaaactcctgatctcaagtgatcctccggcctgggcctcctgaagtgtggggattacaggtgtgagccaccgcgcctggccaatttttttcctttttaaatctggccttcctgagtaaaagatctggaaatttactttggatattctctactgcacagtggaaagtctaatgtcatcaggcatctttgccatgtcctctttagctatttttttcccccttgggattagatggaagcaaattccaggcaatggtatcggtaaattactaagtatcaagtatgggcagaggtcattctggctacatggtccagggaaaacttggggggcaacctttttcctactaactctccctagtcctggggggccagct

SEQ ID NO: 666747 - DNA, 958 bp, Homo sapiens
  misc_feature (85)..(85): n is a, c, g, or t
  misc_feature (92)..(92): n is a, c, g, or t
  misc_feature (96)..(96): n is a, c, g, or t
  misc_feature (172)..(172): n is a, c, g, or t
  misc_feature (175)..(175): n is a, c, g, or t
  misc_feature (316)..(316): n is a, c, g, or t
  misc_feature (327)..(327): n is a, c, g, or t
  misc_feature (336)..(336): n is a, c, g, or t
  misc_feature (435)..(435): n is a, c, g, or t
  misc_feature (852)..(852): n is a, c, g, or t
  misc_feature (866)..(866): n is a, c, g, or t
  misc_feature (950)..(950): n is a, c, g, or t
ctgcacgtagcccggcgctcggcatggctctcctggtgctcggtctggtgtagctgtaccttctttctggcagtgaatggtctgnattcctntttntttgatgtgatcgaattaaccccatcaaatttcaaccgagaagttattcagagtgaaagtctgtggcctgaagaanccnatgccccaaggtgtggtcaccgtcaaagaataacaccagaatggaagaaagcagcaaccgcataaaaagaagttgtcaaagtcggtgcagttgatgcagaaaagcaccattccccaggaggtcagtatggggtccagggantccccaccaanaagaatccnggacccaacaaaaacagaccagaagaaaaccaagggggcagaaccggtgaagccattgaagaagccgcgccgagtgccccgcgccagcccgtgaaggancgccccgggggacgaagcggaggaaacagtcctggaaaacaaggcagaagtgaaagtgcaagtaagaaggatgtgattgagctgacagacgacagccttgataagaatgtgctggacagtgaagatgtttggatggttgagttctatgctccttggtgtggacactgcaaaaacctagagccagagtgggctgccgcagcttcagaagtaaaagagcagacgaaaggaagagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctccngagctgcttgagantatcaacgaggacattgccaagaggacgtgtgaggagcaccagctctgtgttgtggctgtgctgccccatatccttgatactgnagctgcag

SEQ ID NO: 666748 - DNA, 738 bp, Homo sapiens
cttcttaccagtgtggcccatcaggcttacaccatgctctgttctgacttctacatgtctcattatgcatgaccaccaagtcctagcagaagatagtatgccatctagtaactcagaggagattttgaccatgtccaacagcgggcgtcttttttcactacagatgggccctttacactaagaacaggggtcagggttgactcacagatccacaaagcccagagatggactggacactgggtagccattcaacaaatgctgattattaaatggtatgtctttaagctgtggatttaaaataaaattttgttgtttcattagaaaggtcaagaaggtttaacactgatctcttgatttcaacagcaccaacagccacagtgaagcctcagaattaacacactaggttagtgctcacctacagataacaacataaccctctactgaagccaagaatttcctaatgattacaagtctgataatgaccaactcagaatatcccagcagagctgagttctggtgagaacaaacaatgtgaagggagatatgcctaccactttataaaatggacagtggtgaggtgtaaatctattcttttaatggcaacacccaagaggacatcaatacgtatagtatagccaggcacagtggctcgtgcctatatatcccagcactttgggagccgagcggcagatcacttgacgtcaggagtttgagaccagtatagttgtgccaacatgg

SEQ ID NO: 666749 - DNA, 252 bp, Homo sapiens
cgatcacaatatgagccacgaacacactgacataggaataatcatatacggagactccctgtgatacctaagccatctgaaatactgatgggcaccatgtatctatagcagagtcccaagtttcatcagacactgaaaccaaccatgccagtcgtaacggtctaccaggtctccctcttctgtcataggccatgaggtctccccctctaggtggtgagtggtggaaggaagaggaagcttccgagctctgat

SEQ ID NO: 666750 - DNA, 1220 bp, Homo sapiens
gtggttatgattcggagggttctgccgcacggtatgaggccggtgtgccttcttgagcctggaggacaaggcacgcgcagaggaggctttctctggactgggatggaaaggtgtctgagattaagaagaagatcaatgtcgagtccgtgcctggcaaggtccatggtgatcgtactgcaaggagaccagcgcacctagcctcccgagcacctctggctgtggtgatcagtgggaggtggaggtgctctgtgcttgtcttgtgtggcctaattgggcgtgacagaagcctggacgagcagcacgaggtgctatctcgagctgctagtggtggaacgggaccacaacgtatatcacagtggcctcctactgggcctcatcaggtaggtgggaataaagtcaggcagtgtctcgattgcgcatgagaacatccaagaatctccactcattgttcagcccagctattctacggaaacgatcaaagtgagtacctggaccggtagtcgaatgcgtaccgtcgccctggacctccggttcaagcccctcgggctacctcttgctggcttcagaagaagggatgctgcagccatggcagaggcaaggtgaacagtgcagaggcaaggagggagccaaagtttctctgatgtcgtccgtgatcagcttcggaacaagtatccctggataaacacagagggagtcgcgcttagcgcgtcttatgcggaatcgcaggacgaagggtcggataggagccctgggtgtcctagtccacggggctacgcgggaaaggtccagtcctttgtgagatcctttaactgacaggcacaaggctgacaccgtatggctcttcatctcaaacgcatttgaccaccagatgaccaaagcgggggtccttaaaatgggactcatgcaggtccatgtctcatcatgaaccggacgcctgtacgtatacccacccctgtctgaaatcggcccactcgttgtactacacaggagccccggaagagcctgtgtccttggccccacactgagagtacacgtggtagggaagtgagagaaagggtccgctcgttgagaacctagtaggctctacaacactgtctcgtgaacccacgggcgagaagttgaccatactatgaaaatatcggaactatagcctagacaccactagctaaaccaccagagcgtccttgtagacaaattagctatcaacagaataccagtca

SEQ ID NO: 666751 - DNA, 699 bp, Homo sapiens
  misc_feature (247)..(247): n is a, c, g, or t
  misc_feature (292)..(292): n is a, c, g, or t
  misc_feature (304)..(304): n is a, c, g, or t
  misc_feature (311)..(311): n is a, c, g, or t
  misc_feature (442)..(442): n is a, c, g, or t
  misc_feature (451)..(451): n is a, c, g, or t
tctccgccttttggtcgctctgtttttgctttgttttttgttttttgttggatgctgtgctgttgtgtatttcgctcctttgttacttgtgtcttcttctcggttgttgggtatgtattggtgtttcttcttctgtgtgttgctgttgactgttcatttgtttaactcccccccccccccaggcctcacgggggccgcgtttttataatatggtttgagaagatctctcgcgcgctctctctcgctnttggagcgctctcctctttgtatatatagactccccctgtaatgngccctctctcgngacctcnccctctctggggatttgtttctccagaaaccctccggtttccccccgcggcgcgtttttttatttgggtggagagagatcccccgcccctgttgtccttggccccgggttctcccttagggaacccgcgtnttggccccnggtttccctttcccctcttgggcgcccgcgcgcgcccccaccgcgattggtgtttaaaagcttttctccgagggcccgcggccgcgccccacccactttttttttttttttttttttttttttttttaggacggggtgtgataggtggcacggagaattttggattctcagggatgggttcgattctcatagtcccccttctgtcgtcttctaacagccgtatagtagtagtaggcggccagctctag

SEQ ID NO: 666752 - DNA, 328 bp, Homo sapiens
tgggagacagagtccactctgtcacccagggtagagtgcagtggcatgatcttggctcactgcagcctctgcctcctgagtttaagctattctcgtacctcagcctcctgagtagttgggattacaggtgtgcgctaccacgcccagctaatttttgcatttttagtagagatggggtttcactatgttgtccaggctggtctcgaatctcaggtgctcttcccgctttggcctcccgaagtttctgggattataggcgtatgcatctggtaacctgggctaaagttttactttttttttaagtaatggtgtaaatttttcccccatg

SEQ ID NO: 666753 - DNA, 322 bp, Homo sapiens
cccgggcaattaaatgtaaaacggccccccataaggggaaatgggcaaattagccccaaattcggccgcaaggataaacttggtcgagtctaaaaatgactggggccaagcgggccacaaggtttttttttttttttttttttttttttttttttttttttttttttttttttttttttttttttttttttttttttttttaggacggggtgtgataggtggcacggagaattttggattctcagggatgggttcgattctcatagtcccccttctgtcgtcttctaacagccgtatagtagtagtaggcggccagctctag

SEQ ID NO: 666754 - DNA, 263 bp, Homo sapiens
  misc_feature (13)..(13): n is a, c, g, or t
agagtagtgattngtgatttaagaaacaaatacagccaatgcccccaaatatatatctgtatatagtatctatgtgtgtatagacacacacacacacacacacacacaacacacacaacacgcacaccccctacgcacatacacgcctttactcattcctcagcctggcctcacacctctctacacactctcccatacatatgtccaacactatgggagggggacaggggcctaccagggctaagacactacaacacagtgtg

SEQ ID NO: 666755 - DNA, 555 bp, Homo sapiens
  misc_feature (5)..(5): n is a, c, g, or t
  misc_feature (348)..(348): n is a, c, g, or t
tcggntctacctgtcatctggtatatctcaagataaacaagagatatacaagataaacaagagatatacaatccttttttttccccctatagacggtagtctatggggaaactggggcaataaaataggtaattacaatgaaggctatagcttggatatcaggagttagtctagctccctctctagctctatccgtctcctttcccaagcccctcggcccttacgttgtggtttaaacagctctgatcatatcaagttatttggaataacttttaaaaaagtggggaagatatacagtccagtgaccatatgcctcagtagggaaaaagggtgtttatgtataccggnctcagaatgaagcgttccggtacctccaaatttataataattttccaaatattttctcagcttttttcaacacttcttttacagcatcctagatcaaaaggatggagtttagagatttttattaaatattctttaagttattcctagggtatgctaggtactatggtatctcgcaaggatataatgataagtaaacagacaaggtag

SEQ ID NO: 666756 - DNA, 608 bp, Homo sapiens
tgaagtgttcaaagctctgtaaaatatttggcgccaccacgagacccctgtctggaatgtccccctctcgtgagaaaaattgagaactcgtgttaggtgtccacaaagaagggagaccagggctctcttttgggagacacactataggagaaaaaacacctctggtatagagagaggaggtttaaaaaaatttaaaacacacccactatgtataggccctctaaaagcactgcccacccacactttatatagaaaagccgtttcaatagctctaaaacacacccacgctaccttgaaaaatcccccaacattattaactggacatcctccacaacacccaattgggacccaattttatccacccttattgaaagaaacttaatagtttagtataaagtgaaccatggaaacattttcctccgcataagcctgcgtccagatttaaaccactgaactgaccaatttaccagccccaatatcttaccaatccaacccgaccagtccattattaccctcactgtccaacacccacaccaggcatgctctataaggaaaggtttaaaaaagttaaagggactcggcaaattttaccccggcctgtttaccca

SEQ ID NO: 666757 - DNA, 375 bp, Homo sapiens
  misc_feature (207)..(207): n is a, c, g, or t
actcggggagctcggattttaaggcagtagcttgccaatgctcccagctgaataaagcccttccttctacagctccgtgtctgagaggttttgtctgtggcttgtcctgctacagtccttggttccctgaccaggaagcgaggtgactgacaagccctgtggagccccgtggagcgtccctgcagaggactccggccagcctgagtnacgcaatccaaagagcgctcccgggtaggaaatggccccggtggaacgccttgccagagcagcgcatagcaggctcccgagaagggattaacactggcttgaacaaccgggaaggaactggcacttgaagtccagacatcttaagctttttcaagattagtcttttgg

SEQ ID NO: 666758 - DNA, 107 bp, Homo sapiens
ctttcctgctctgctcctacttttcaggtttccttctcttgtgtgtcttctacaagtatgtttctagtcttcttatttccctatcttctctcccacagtgcaaagca

SEQ ID NO: 666759 - DNA, 214 bp, Homo sapiens
  misc_feature (15)..(15): n is a, c, g, or t
  misc_feature (22)..(22): n is a, c, g, or t
  misc_feature (24)..(24): n is a, c, g, or t
  misc_feature (31)..(32): n is a, c, g, or t
  misc_feature (45)..(45): n is a, c, g, or t
  misc_feature (55)..(55): n is a, c, g, or t
  misc_feature (74)..(74): n is a, c, g, or t
  misc_feature (98)..(98): n is a, c, g, or t
  misc_feature (104)..(104): n is a, c, g, or t
  misc_feature (116)..(116): n is a, c, g, or t
  misc_feature (139)..(139): n is a, c, g, or t
  misc_feature (156)..(156): n is a, c, g, or t
  misc_feature (159)..(159): n is a, c, g, or t
  misc_feature (161)..(161): n is a, c, g, or t
  misc_feature (188)..(188): n is a, c, g, or t
  misc_feature (190)..(190): n is a, c, g, or t
  misc_feature (192)..(192): n is a, c, g, or t
  misc_feature (198)..(198): n is a, c, g, or t
  misc_feature (202)..(202): n is a, c, g, or t
tataactgaactccncacaccngnttggacnnatctatcaccggntagaagaacnaatgttagtataagtaacntgaaaacattctcctccgcataancctcgncagattaaaacnctgaactgacaattaacagcccnatatctacaatcaaccnacnantcattattaccctcactgtcaacccancngnggcatnctcntaaggaaaggtt

SEQ ID NO: 666760 - DNA, 315 bp, Homo sapiens
  misc_feature (102)..(102): n is a, c, g, or t
agcgtccgaggaggcggcggcggtggcggcagcggcggcggcggggctgtgggtctggtgcgggagcgagaggcgaggaggtggcgggccgtgtttctgagnctggcggcggcctgtcggagcggagagcagcgcccgcgcctcgccgtgcggaggagccccgcacacaatagcggcgcgcgcagcccgcgcccttccccccggcgcgccccgccccgcgcgccgagcgccccgctccggctgacctgccaccagggagtgggggggcattggtcgccgccgccggcgcgcgggcggagcatgggggtctgggct

SEQ ID NO: 666761 - DNA, 386 bp, Homo sapiens
tgatatggagtcttgctctcacccaggctggaatgcagtggcgcgatctcggctcactgcaagctccgcctcccaggtttacaccattctcctgcctcagcctccgaagtagctgggactacaggcacccgctaccatgcccagctaatttttttgtatttttaatagagatggggtttcaccatgttagccaggatggtctcgatctcctgacctcgtgatctgcctgcctcggcctcccaaagtgctgggattacaggcgtgacagccacgcccggcccaatcagcccttcttaaacacctagaaataaatgtgcttctctcccaactccaaaaagttcctataaggaaatgacctcatccacccgttacagaatctctatttc

SEQ ID NO: 666762 - DNA, 169 bp, Homo sapiens
agccactccaccttactaccagacaaccttaggcaaaccatttaccaataagatagcgtagaaattgaaaccttgcgcaatagatatagtacccccagggaaagatgagaaattatataccacagcataatatagcaagggactaacccctatatctctctgcataatg

SEQ ID NO: 666763 - DNA, 809 bp, Homo sapiens
ccccatctgtagaagccggagagcctgatgccaggccagtctccatactggaggaagctgccccatctgtagaagccggagagcctggtgccaggccaatctccatactggaggaagctgccccatctgtagaagccggagagcctggtgccaggccagtctccatactggaggaagctgccccatctgtagaagctggggagctgggtgccaggtccagtctccatactggaggaagctgccccatctgtagaagccggggagccaggtgccaggccatcctctgtgccttacaccagcccttcgctgtaggaaccttttctacagagacagcgataaagctctcgagtcacataaccgctctcctacagtgtgcgcttcagtggctttcaggatattcacaaggttgtacagacatcaccaccatctagttctagaacgtttttatcaccccaaaaaaaaccctgtgcccatgaagaagtcactccctattcccctctcccagccctcggcagccgctccttcctgcctgtggatttgtgcattctggacacttcgagtacgtggttcctacatcccgctcgtttgtgactggctctgtcactcagcgtcacatctttagggtccatctgtgccgtggcgggagtcggcgcttccttcgtctttgcggctgagcgctgttctgccccgtggacggagcacatttgtgcacgcacccctcctccgttggacgcctggcttgcctcccctgtctggctgttgtgagtccagctgccgtgagcttttgtgtaccgcttctgtgtgggcac

SEQ ID NO: 666764 - DNA, 305 bp, Homo sapiens
cgaaggggtttttaaaaacccccgtccgggggggattttccaaaccccccccccccgccggggcccggagggggggggtaaatgggccgggaaatttaaacccggtttttgtgggggcccccccccaattagttaaaaagggggggggggggtttttcctcccccgggggctctgagcccggttaaacgaaaaaattggggttttgttaactgaaacccccccggggattgccaaaaaaaaaaaaggggccgcgggtttggtgcccttttgaagggttttagggaaaacccatttttttttttta

SEQ ID NO: 666765 - DNA, 1067 bp, Homo sapiens
gaggcgctcttcaaagagatcttctccagtgatccagaagaccaatgctgacatcaactgccaccaaatgtcaagactgcacatgcagcaatgtgaccccttcatccgagccatgcagcactaccacccagggtgtgaagccgatggggtccctcagtgcactggagcggaagcagacgaaccaagaagagcgagcagcaacaataagacaggacatgcacaaacacagacagcgcgagacatccgtgaatccaggaaagcaaaggcagagcactgataaaccatgcaacgacaccgggacggcacagccccgagcccagggacagagaagcgcgtaccgaagggaaagaccccatgaggagggacagcacgtcggacagccaaggagccaaaaaggggacgacacaggagctccatgaaggtagcaacagacgagcaaagaaatgataaagcacgagagaaaaagcacaaggagcagcacgcagaacaggagaggagagaaacggaaggagagacaaagaacaggacaacaaagaggagactagaagggagcgaaccaggccggaaagaaacgaacaggagaacggcaagaaggctaaagcgtagaagagagcggaggcgaaaggagggaaaagaaagagaagcgaagcgaaacgacacggagaagagacaagagagagaaaaaagacaagaccaagggaaggagcgacagcagacgcaaggacgcaagagagaggaagagaccgaggaggcgcagacagtaggagcaagcgacagcggggaaagacggagaagagagaagaaggagggagaaagcagcgggagagcgagagcggaagagggaggaggggaagggagggcgcgggcggggggagcgcccagagagcggggggggcaggcggggaggacgaggggagcaagagcagagagaggagagagggagagaggcagagagcgcgcgagaggcagggagagggagcgggcggaggcgcagcaagagaaaggaggagggcccgaggagagcgaagagcacgagggggcgagagggaagaggaggaaggacagag

SEQ ID NO: 666766 - DNA, 487 bp, Homo sapiens
  misc_feature (340)..(340): n is a, c, g, or t
  misc_feature (487)..(487): n is a, c, g, or t
gtagttccggctgctcgggaggctaaggtgggaggatcgcttgggcttggaaagtggaggctgtagtaagccatgatcatgcctctgcactccagcctggacaacaaagcaagacctcatctccccccgcccccgaaaaaaaaaaaaaaaaaaaaaaaaaaaaatttgtgtggggggcctggggccccggaaaaggtttttaaaaccttgcggtggggggggggggccccggggtggggaaggggtgctcctagaagcgtgttccctcgaggaaaacccggggtcccgagaacaaagtggtcggggttttcctccacaatataaaaaaaaggcgccgggnggaacacccggagcagcgtgttctgaaaaaaattcccaggatagaaggagtgccggagggtacatcaaggcgggttcctatataaacagggaggggctcccaagggaggagtccgcgaattacaatatcagcccgcggcctggggan

SEQ ID NO: 666767 - DNA, 748 bp, Homo sapiens
catgagaagggattcatcaagtccatgtccttaaggttgccatgcacgcacagtaagtccagtccgaatcgaagaaatacggtaatgtccatatcttcaggggcgccactagtacaaattcacatttggaaatcaacacaaatgcactgtttcactattacatacgtcggataaatgctgtacctctagaaaagttgatcagcgcggtctcattctcccctagattttgtccttgaatccatcaaagcatcaaggttccacaggccctacattctagaggtaggatctctgtagagtatcttcaatagtagcctaatatactcatttaaccctttcctcctaagtcaaacgccccttctattgcacacaacgagtgcaacaaaggtctgctcgattagtttgaaattgaggagtatagtagtatcaacgcatcattagaccttctatgctttttgctgaaatccactcactaaggtgatgacctatattataatctagtatgtataaaacgatttggtgccaggcgcgatggctcacgcctgtaatcccagcacttgggaggccgagctgggtggatcacgaggtcaggagttcaagaccagcccagccagtgtggtgaaaccccgctctactaaagatagaaaaattagccggcatggtggcgcgtgcctgtaatcccaagctcctcaggaggctgaggcaggagaatcgtgtgaaccaagaagccgcaggttgcagtgagccttga

SEQ ID NO: 666768 - DNA, 896 bp, Homo sapiens
ggccactgcatagccccgtccatggaagacacgccgttggtgatatcgaagcagaagacggagcgtggtgtgcggggtccccacccaggtgttgtgtacggccttcagcagtcacatcctggatggtggtgacccagtttgcggaagattgggctaccctggtctccctggatgcccagcacgctgtggcctacgtgacagtcgagacaaagcctgtgtctctagccaccaaacatgtccgttctggttgcagcgactcgagcctcctctatccactggtctttagtcgaaagcacacctgtggtagcgttatagtgtcttcactgatagcgtggacaagcagaagcatggtcctcctctgccagtcggccagtgagacgggacaagtacgcactggatggcggcttgaatgcgcgcttgacggtgaagtgctgatcctggagtgttgccaggcgtgttggtcgtatcttggcacgcgctcgacctggccctgcagctagcatgacgccattgattctccgtagacccaccgcatagcacccagctcacggtagctcgctgtctccctctccgctccccggttggacggtgcgtgacctttgtgcactagtccccttgtgagccacgtacgatgatcacgtcgtgtcttcaggcacgatctcttagctctggttatctagcgattcatctgtgcatgatcgggccgggtgggcccggtcccggtcggcagtcgcgcactggttctcaccaggacctgaagtcgtcagcattgtggttctgaggacatttggtggacattgagtcatccaggcgtggttcatgggccccccgtgttgcaggactcacttgtaggaacgaaactttcttctcattcaaagagctgactgtggtattcc

SEQ ID NO: 666769 - DNA, 334 bp, Homo sapiens
ttttttgtgagacagagttttgctcttgttgcccaggctggagtgcaatggcacgatcttggctcatcgcaacttccccctcccaggttcaagcaattctcctgtctcagcctccgaagtaggtgggatgacagccatgcaccaccacgactggctaatttcgtatttttagtagagatggggtttctccatgttcgtcagactcgtctcgaactcccaacctcaggtgatctgcctgcctcggcctcccaaagtgctgggattacaggcatgagcaccacacccggcagaaaatccatcttttaggtctgtccagactcacattatgtcgacg

SEQ ID NO: 666770 - DNA, 539 bp, Homo sapiens
gggaccagtgttgctgacagggtgacactgaacacaacagttttcctttaattgttaaatgcggtgcatcgcacagctgtgtgtgagtcaattaaccaaggcaggcagggggactctgttgttttacaagcgaagggaaaaccaaagtaggcagagaactttcatagagaggagagggcctgaactctgagataaaaagctgcagcagaggcctgctggagaacagtggtcggatctgctggctcaccttggtgaacacagtgaccacttcataagcctcaggtggtgtgactcgctccccgggcatgcttctcaccacgtagatttgatcctccacaaagacatggcccttctgttgcaggtttgggtggccaagtcagtgcacacgtaccattcagtggtggcggtgacggtccctgcaggttcacaaacagactatgtaaatgacagcaagggagggaagggagtccatcagtgacgagcagctgcaggttgtacctgagcaatgtgtaccatccttcctgagcaggtgcctgggc

SEQ ID NO: 666771 - DNA, 198 bp, Homo sapiens
caaaccacaacaaaaaaaaaaatgagaaaagaggaggaaaataaatggtcatcagttgataagaaaatccctctctctctccttccttatctccttccagcattttccagggcccctcccaaattccaaataagctccctgcgctggcttccttgtttcagagtctgcttccatgggaaccccagctgggtaccgagc

SEQ ID NO: 666772 - DNA, 624 bp, Homo sapiens
agcggagtgcgcaaagcccggtctgctccgatgccctggtccctggaggctgccatgtaacatgtgccagtcgctgggcgaccagccactgggcccaaaggctgccatcccttggaagcgctgcacggaggagggctgggaacagagtacccaatgacgagtcgactgctggtgcattgcggcccgacctctgacgtcaacgaggctggacaccttctctgtccaactatctacatcgtatctttggaccaagtgtggcccttccccctgagcgcccagccgtgttcagccatgaggctgttgccagtgcatggacagtggaggcgtcctcagcctggagctccagctcaatgcggatactctttatggagagtggggaggttgctctgccagggagcttgaaggggaaggtgtcaggggtgttggggtgtttacctcctccaggaagcctgtccaggttgctcccacgccatcctgacaattagggaccatggcttagcccaattctggatcaacaaacatgtcctgagtattcactctgctacagatgggcgggtcaaccaggtcaactcagtgtctggggtttcccagtttggtaaggctcacttcctgctcattactggc

SEQ ID NO: 666773 - DNA, 118 bp, Homo sapiens
gtctctgggagaatgggcagttcccaatcttgggcccatcactggcagacctcaagaacaattcgacctgcggttgttcttcagccatggttgcgactggagggaccggtacgagctc

SEQ ID NO: 666774 - DNA, 232 bp, Homo sapiens
acaatgtgcacatacatgtgggccttatcattcaggtgtggatggtataggaagattcacagaattgccaaaaacaattaagggtgcgacagaggaggccacaaggggctggttcaatggacatggggaaggaagtagggttaaccaaagagggtggcagatggaaataagtcttggcgactcatgggccacagccagcattagacaggcatggatccttgttcaccagcca

SEQ ID NO: 666775 - DNA, 812 bp, Homo sapiens
cgtggactactggcgctgtgcacgctccagtgcactgagttattgcgcctaacgggacatcgacgggctacatggttgaacctgtgatcaagtaccggggcttcgtgtgcgtcgtcaccaaacgtgtgcttcccattgaggcaaggaccgaaagtaatactacactcatgctcggttccgatgctgcagcgcccgatgtaccgctttgagatgtgggtataagctggatcctggtgctttcctccgtgtgactctacgtatcgagttaagcatcggaggtccagggaagctatagcggaatgatgattctacaagatgcttctggcgcaggagactgataaccgcttccaaacactttgccgcagttactagtattccaagcaaaacgcattccttgtcggtgcacaactgggaggtaaccgcaacgggcccacccgcctggtgcgtagatgtggaatatgaaggagttccgaagccccatggggggcaaaggtgcaaatccgtggagcgaaaattgcctaatcaataggttggtgcacacttctactagctcaaattgcttactcgtccgatccgaacgaacgatagcgtgcgtgggattgaggctgaaatgggccgctaacgtggaaggctcatggtggaaagagattgaccgccctgttgttggagtacgaggaaagcggatacgtgggcgccgcaacataagtgtttccttaaggcgtcccatgaaacgttggttcatttgggacctccagagaccgatttgcccacccattgccccattagacccctttgggactggctgttccctg

SEQ ID NO: 666776 - DNA, 810 bp, Homo sapiens
attttttcagtctatccatttgacaaagggctaatatccagaatctataaagaacttaaacagatttacaagaaaaaaacaacaaccccatcaaaaagtgggcaaaggatgtaaacagacacttctcaaaagaagacatttatgcggccaacaaacatgaaaaaagactcatcatcactggtcattagagaaatgcaaatcaaaaccgcaatgagataccatctcacgccagttagaatggcgatcattaaaaagtcaggaaacaacagatgctggagaggatgtggagaaataggaacactttcacactgttggtgggaatgtaaattagttcaaccattgtggaagacagtgtggtgattcctcaaggatctagaaccagaaataccatttgacccagcaatcccattactgagtatatacccaaaagattataaatcattctactataaagacatatgtacatggatgtttactgaagcactgttcacaatagcagagacttggaaccaacccaaatgcccatcaatgatagactggataaagaaaatgtggcacatatacaccatggaatactatgcagccataaaagaggatgagtccatgtcctttttcacggacatggatgaagctggaaaccatcattctcagcaaactaacccaggaatagaaaaccaaacaccgcatgttctcactcataagtgggagctgaacaatgagaatacatggacacaaggaggggaacatcacacgctggggcctgttgcgggtaagaggccagtggagagatagcattacgataaatacctt

SEQ ID NO: 666777 - DNA, 305 bp, Homo sapiens
gtgatgtcttcgaggagcctatgtcaggcatgagggaagctgggattcctgagagccctgatgactcatatagcagctatggttcccactgcactgacagcctcatgaggtcctcccctgttttcaaccagcgctgctagacgaggatgaggaaaatatacaaggcaaagagggagatgttttgtccagacctactaggccgaacagaaaaggtttacgtattagaatctgtttccttaaaaagtgatttgactcctgttcttaaacacacgtggtttgtcctaattccagaggaactggacgtt

SEQ ID NO: 666778 - DNA, 834 bp, Homo sapiens
gagagaactagtctcgagtttcatattatatatcttcgacgtaagaacaagaagctttactcgtgctcggaaacagcaaaacaggaggcacaggggataatgacggcccctgtttcccattttcccctccatgtggaaggcaccaggcggggaggtgggctctcgctgggattgggcaggtcagcggaaacaaaaggcttcctgtagttatatggcgcccaggcacagtggggcagtgagcacagacccaaaaagatatgtcctgagccacagagttcatgagcggagaagaacattctctggtggctcccacgtcaaagagggcctccgaattgaggccccttggacgtgggagacaaagctctgtggtctcagaagaacattgacctttcccgggtccttgagctcccacttgtggtgcccggccggtgccacccagcccttggcggataaaagagggctggtgtcccccacaaacgcctgccagtgttagagccctttgacaattggccagtggctttggtgcccaggacctttgggcctgagaggcctgctcctttgaagacccaagccagcactagacacccgcctttcagcaaacgggtaagtgagagcccggatggcaagttccctcccagagtgccgcaatgtgctggggttggaacgccttgtttcccccgttgggcattccaaccccttttggtggccctgagcgtcgggagagcgagggcgcacttagagggaccctttggcctatccagcagcttggtggttgcttcggtgactccccaaaaaaaccccattacacgcgagcacccacgaaggattggaaag

SEQ ID NO: 666779 - DNA, 359 bp, Homo sapiens
aattccggctctcctggggaggcccacggccaggagggctccgcagccgcccagctggacgtgttgcgcctgcgcagctctttcatggagaggcgaaagaagggctccgcgagcctgaaggatgagctgctcagagcgctgaaggagctgatgctaaaggaccaggaatgtgagcggctgtccaaggtgcgggagcagctataacaggagctggaagagctgacggccagcccgtttgaggaagctcacaagatggttgagaatctaacatgaagcaagcggcatctgaaaagcagctgaaggaggctcggggcaagatcgacatgctgctggcagaggtgacagccttgaagacgctg

SEQ ID NO: 666780 - DNA, 137 bp, Homo sapiens
tagacgccagggttcggttatctagagcatcatagatttatcccgcgtaaaagacagatagaactctcttattgaagactgtgacattatcccagctcgcctgcagggatctattgaagccactattacatccttca

SEQ ID NO: 666781 - DNA, 325 bp, Homo sapiens
aaggatcccctgggttggggcgcgtggggtgtgggcggggaagaacagagtctcgctctgtcacccagtctagagtgcactggtgtgatctcggctcactgcagcctccacctcccaggttcaagctattctcctgcctcggcctcccgagtggctgggattataggagcgcactaccacacttggctggtttttgtatttttagtggagatggggtttcgccgtgttggccgggctggtcttgagctcctgacctcgagtgatctgcccgcctcggcctcccaaagtgctgggattacaggcgtgagctgtgccgcgcccacaa

SEQ ID NO: 666782 - DNA, 509 bp, Homo sapiens
  misc_feature (12)..(12): n is a, c, g, or t
  misc_feature (34)..(34): n is a, c, g, or t
  misc_feature (67)..(67): n is a, c, g, or t
  misc_feature (168)..(168): n is a, c, g, or t
  misc_feature (182)..(182): n is a, c, g, or t
  misc_feature (217)..(217): n is a, c, g, or t
  misc_feature (292)..(292): n is a, c, g, or t
  misc_feature (354)..(354): n is a, c, g, or t
  misc_feature (361)..(362): n is a, c, g, or t
  misc_feature (420)..(420): n is a, c, g, or t
  misc_feature (456)..(456): n is a, c, g, or t
  misc_feature (501)..(501): n is a, c, g, or t
aatcaaataacnggtgccctgaattcatctggancccctcttaagccccagtgaggtacatgatgtncttggtccaggaatagccaaggcaaagatccatccttcatgactcagtgggtttgtgcacaggcacacacctccacctgttatatacctgtttgtgtaagntcatacttggtctnagccacttgttgtctgtaaaaggtaattgtccttnctaatgctgtacaggggctcttggggttcggctcagctcaacatggcttgacatggtggcacactgcgcccagtnagagagagagagagccaaagctgtccgttttgcagatggacaggaaggagccaggacacagntcagctnncacgcccagagagagaaaaagttaagctctgaccctgaaggcaagggagagcaggctnacagctgtgtgtggaaccacggctcaagcaccaagnagggcggacagtgtgagagagctagtgtaaggctgttgatgagantgttgctg

SEQ ID NO: 666783 - DNA, 194 bp, Homo sapiens
tcgaagaccaccggcagggtgctgtggacagatggttataaataccagctaagggagattttttatattgtattctttttattatattttaccaagcatcataaaggtcaggtaagctagggagatttcatcaggccaaataaaatttttgtcggtctaccacaatttgaagaaaacttcattagcaatataat

SEQ ID NO: 666784 - DNA, 992 bp, Homo sapiens
ggtctgtcacagtctgctcctttttttgtccgccacacgtaactgagatgctcctttaaataaagcgttggtgtttcaaaaaaaaaaaaacaaaaaaaaaaaaaagaaaaaaaaacaacaaaaacaaaacaaaaacacaaaaaaacaaacaacaacaaaaaacaaacaaccatcccacaaaaaagaaaacacgaagaaaaaacaaaaaacatggtccgcacaacaaaacacatctgagtgggtgtggcgccacgacaacccacgaggagggcgcgacaaaacacaatcatgaggtagggagaacgcaggcaagacagtagaggatcgaccaccgacagatccggcgcatcagcagaaagcatgacaagtcacaacacaacaaatgagaatgcaggacggccgataaagaacaaccgcagcgcgaggagaaacacacacggagggaacataccaacaagaaagttggggagcgaaacaaacaatgcggtctagacaaaaaacaccgcgcacacaaaacacaaccggcccctagaaaagaacaacccgcccggcggagaagaaccacaagacacaacgacaaacgaacacaacaagcagtgcaacaacacgaccggagggaaacaaggagcgacgagagaagagagaagagacacaaaagagaaggcgcgcagagaccggcacagcaaggagaagagaaaagaaacaaaggaggaggggaggcagggagcaagaagcagggcaggcacacaacgacagaggagaggcgcggaggcgaaggcagacgagagcagcgaaaggagaggaaggagaggggaagagagggggaggagcgaggaaaagcaaagaggagagagaaccggtaaagcgcaagcgcaaggaacgacggacgaaagaagaacgcaagcagcaacgagaagaagcagaagagaagacgagacgaagggagcgaggcacagcacagaggagcgcaggcagagggacaaccgcgagca

SEQ ID NO: 666785 - DNA, 339 bp, Homo sapiens
gtgggcagtagagctggcttcaccgccctgcacatgatgctgacgaggccctagggcagtgggctggtctagccgggtttcctccgacaaagaggtcgtgctgtgatgctgccttagacgctggcggacgagatttccagcaagagccccgtggcggtgcagagcaccaaggtcaatcctgctgtattcccgcgaccattcggtggccgagagcctcaactacgtggcgtcctggaacatgagcatgctgcagacccgatacctcgtgaagtcggtccaggccacgactgataacaaggaactgaaaaccgtcaccttctccaagctcttattgcccag

SEQ ID NO: 666786 - DNA, 736 bp, Homo sapiens
agcgtaagggacactttgcacgacttgatagaattgcgtcatcatcatttgtaacagcaacacaaccggttcacgctctggcacactttactgggtttgggcgttggtaaggtctcagtcaaaccctcacgccaggctacacaaccgttcttgccaatgggcagattaaacatgctggccgcaaccgggtgcataacccgtagcaccgaaattcatctgtgcttgagtgtagtcggcaagacgtcctgtcggtggttgcagcacatacgcttcggctagttcccaaagctctttttcgatcattgattgacctgaccaaccaacgaattccatgcaagcgtgacagtacacgcttgatgttgccatccagaatcggagcacggtcgttccatgcttgagacagaatcgcagccgtagtactgcggccaataccgggtagtgcttgcaaagcattctggtcacgtggaaggttcgcaccatgcaggctcaacacagcgcttgggggcggcattgtagatagactggtgtagtccgtgaaactatccagggcatggaccaaattcgcgatcagatccaggaaacctcaaaaagtacaagggtctgggtgagcctcccaagaatggtcatcgtagaattatttaggtttcttgacgacccaatttggggctaagagagtaaaagggctttggaaaaaaagggttcacactccgcaaccactttttagaccttggacgtg

SEQ ID NO: 666787 - DNA, 731 bp, Homo sapiens
taaaaaagatgggggtcttactatgtgggctaagcgggtctcaaactccttgcctcaggtaacccttctgcctcagcctcccaaagtggctgaaattacaggcatgacccaccatgcccgactcccctttgggtgtaaaagtgagaataattagtgtttgtgctcacagaaatgtgttttaaggatgataagggcactaagtgtgagaataagttgtagggtgaagttaagatagtgatgccgggctcatagttaaggtgcgtgaattcagtgcatagctacactcaattatcataccttccataacctctttctctcacagattttaaagccttcgtggtcttctcatagggggtataagagtcattaaaccaaaattacacttctcctcgtgctagggttcccctccgcttctccctcttctggcacagctctgatggtgggaaacaagggcacacattaagagcccagtcccaagtagtcaagagcctgagaggaagggatatggagagtaatccttcatatctccaggagtgcctgtgaaaaagctgaggaaggggactggggaaagcacacaaaatagggaaaaccttccctgggggtggggaaacgagacgacagtgcacagcgtgctacataccataaagaattcggtgtcacattgttaagccccaaagattgatgtctcgcttggcctgtgcaacgggctggacctggacaaacgcatgggc

SEQ ID NO: 666788 - DNA, 268 bp, Homo sapiens
gggacagctattatctatctatttgaggaaactgaggactcggcatctctagcacgggctcaacttcgaaactggcacaacagagctgaaacagctaaaaagaacccccccctttaaatggttttctttttgaggcaagttggctgaacagagaagggaagagcgcaagaacgagaggacagcgacgggcaggcagtgtttgtgtagaagcgcagcgccagcagaatcagagttaggcaaaggacgaccttcaggccagtggatgggt

SEQ ID NO: 666789 - DNA, 111 bp, Homo sapiens
cccgtcgcccgcctgcgcccccgcggtctgggtctgcagcatgctcatgtaccaggacgccacgtagttgaggctctcgagcacgaatggtcgcgggaatacagcaggttg

SEQ ID NO: 666790 - DNA, 446 bp, Homo sapiens
  misc_feature (108)..(108): n is a, c, g, or t
  misc_feature (239)..(239): n is a, c, g, or t
  misc_feature (305)..(305): n is a, c, g, or t
  misc_feature (341)..(341): n is a, c, g, or t
  misc_feature (395)..(395): n is a, c, g, or t
cccgcacactcgctttttatttcggtgagttaagaccatgttatcaattccatctcagaggtgctccaaccctaagaggttggtgggttttccaaaaactttaaatancttaaaacgtttccatacaaaaagggctccacaacatttatccgcgcagactgagggcgcctcagtaggctgtacttgggtggagtagtccttgggggacaccaccaagcctctgccttgtgggggccccncagtacaccttctcaataatatccaccatctcctgcttgtcctccatgggccagttaatcttggtngtgttggcagtccccaagtcaatcataatgtgcttngtcctgaggaaaaacatgacagtacatggatcgtataactcatacattgtgttnaagtcaggcacttctgtaatatgcacaagataaataactgcaaaattttta

SEQ ID NO: 666791 - DNA, 268 bp, Homo sapiens
gagtatccaacagagatggaatacaagaggatcccgaagtgcactcagccagcagggtagcgagcacaaccttgacttaaaaataatagcgtctctcaccccaccagaacatttcactcgtcctgatcgctacaacctaactcggggcctgcatacacaaggtgaagctacttgattaggtgcagcggtttagcttgcccactgcactagagatcggaacatgagtaagcattggagctcactcggccagggcttgcccacgggctca

SEQ ID NO: 666792 - DNA, 136 bp, Homo sapiens
taaaagcccagatgcattttctttgagataacttaaatttttggtttcccaaaaggttcctttatttgtttaaaattaggggcttttcccttatattttatacacatcctggttttggggatagatgcttaaatcc

SEQ ID NO: 666793 - DNA, 367 bp, Homo sapiens
cagcgcactagcctcataaagctggtcagtcgtcataaagtgaagtaacaatttatgaccctgctttaaaaaaaaaaaaaaaacatagaaggggcggggcgtggtgggctcgggggtgtaatcccagcactcgggcaggcagaagcgggtggatcacttgagatcaggagttggaaaccagcttggccaacttggcgaaacacggtctccattaaaattacaaaaatagtcgggctggggggcgccccaccccgggcccccggtaatcccagctacacggagggctgaggcaggaggatggcgggaccccaggaggcgcgggttgcagtgagctgagatcacgccagtgtactccatccgggagaca

SEQ ID NO: 666794 - DNA, 909 bp, Homo sapiens
tggcacgagggtggcctgtccactgtatcccaagcagcccggcgcgggcgccgcgccggcgtggcggtgaggctccgggcagcatgggggcttcggtggtgactgtcaatcaagagcgcgggtagggtccacggcgcgggcgagaaggggtcccacgaggaggtagccggtgaagaaacgcggctggcccaggggctaagaagcggacagaatattctgccgagatgggcccaaggcaccggtcacgggctacgtgcagcttccctgtaactgatcggtgcgcagctagatcgcagtcacgcagcactacactcgggtatcttgccctttccgcggcagatcaccaaaggatggctggtgctgccagagatgtgatgcaagcttgcagaccgaacgagaagatgcaggggtaccgtggatgaggtgccgaggagagagaagcatgctaggtacgatgaaggagcgtgcgggctgtaccagcgagtctgaaggcgctataagatgtgcggcggacgaacgatccaggtgaggaacgaatgatcacatggagcacgaagacttcgagtctctgcgcgctcatgaacactctcctgaatgggacacaaggggtggggactgcgatggtttctcgaccttctgatgttgcccgatcttcgacttgaatgagttcttggcacccaaatacaccatagagcgccgttgaggcagcgaggctatcgggccgccttggcggcaaggagtgaaatgtgggccttgcgcagggaagtcagcacagggcggttactggacggggggtgccccccgcagaagcaatgagcagcgctgcgcgacctggtctggagccacggagcgggcgctctttaggaccgcggcagtggcgctgagcgctggggacccaggtccccgcgt

SEQ ID NO: 666795 - DNA, 345 bp, Homo sapiens
  misc_feature (18)..(18): n is a, c, g, or t
cctcagactaccaaaatngatgtcacgtcaaaaagcaaatcaagcaaattcaaaagattttcttatttgagtgcataatgggtcataaagcagcagagacaacctgcaacatcaacaatgcatttggcccaggaactgctaacgaacatacagtgcggtggtgtttcaagaagtttgcaaaggagatgagagccttcaagatgagaagagtagtggctggccatctgaagttgacttcgaccaactaagaccaatcatggaagctgatcctcttacaactacacaagaagttgccgaagaactcaatgtcgaccattctacagttgtttgggatttgaagcacat

SEQ ID NO: 666796 - DNA, 203 bp, Homo sapiens
ccccccccccccccccgggggggggggggcctttttgggggttttttttttttggggggggggcccaaaaattttttttgggccccccccctttggtggatattctccccccggggggggggggggggggggggggggccccgcccccccttttttttttttggccccttcgggtttttttttttttttccccccctttttta

SEQ ID NO: 666797 - DNA, 542 bp, Homo sapiens
tactttcacaggaacggtgattatttaaaaatatgcagaacttatttcatctatgctttagaaattagcggtatacagggtaataagtggaaaagaactcaaaataactaataccaaatatacacctatgtattagaattcaaaaaagcggctttcggtgaggtcaatcagctatattaaaaaaggacacaaattccaaaacaagatgctgtgtatatataaggggacatggtaagtttcctggcggctttaaacccagggatttattccagtgaaatttccttttaataatcatttagacagaagcatgcaaatagtctcaggatctacttaagaacctttcccaaatccactagttacactccccttttcaggaactaagcagggtatccggggtagctgcttcctcctcggcatcagctcggttggctttaatttctggcaagtgtccgggccaaaccggtgcccattcatcatggcggggaacagcaatctgttctcccacatcgtatataacaatctgtccttcagaatcacccaaa

SEQ ID NO: 666798 - DNA, 137 bp, Homo sapiens
  misc_feature (117)..(117): n is a, c, g, or t
aacagcccatctggtgattccagcacgggaggagaaaccatttcagcaccctccacagcacataaccggtcagcacggggggggtgtcggggctacccccagtgctaggacctgcanaaaaatcatactgccactcc

SEQ ID NO: 666799 - DNA, 361 bp, Homo sapiens
tatcgtcaccaactgggacttgacatgtgagaagatctggcaccacaccttctacaagcgacgctgcgtcgtggccccggcaggagcacccattgctgctgtacctgaggcccccctgcacccccaaggcccaacacagacaagatgactcagattatgtctgacaccttcaacactcctcgcgtcatgtacgtggccatcctcgcgccgctgctgctccctctacgcctctgggcgctccactggcattgttcctgtcctctgtagacggggtctcccataccgtgcccctctactagggctacgccctcccccatgccctcctgcgtttggacctggctggccgctacctgactgacta

SEQ ID NO: 666800 - DNA, 218 bp, Homo sapiens
  misc_feature (201)..(201): n is a, c, g, or t
gacttgttcatggacctcattgagtgcagttttaatagtgctaaggaacaaaaaatataatacagggattttgttaacatacggcataggtcaggaaaatgaaactatcattttatacaggtgtcataatttcactttattggtgtcttaatgtatggcttaaaatatatacatatagtgtgggcctcaaattattttttnaatctggggggctcaaa

SEQ ID NO: 666801 - DNA, 1048 bp, Homo sapiens
tggctttaataatgcatattctgttcacgcaaaaggtgcaaaggacaaaaagcaggggttaaactgggctgatgaaaaactcaagcaggagtgacattttcatagttttcatgtgaacaaccttaaaactaggagaaaattagaaaagctcacagcgtggttaccacagaagcacgcccaattttcacagctgtgtctcctcttaggaccttgggctaggggtgagaaaagcttgtgaaaacaggtggccctcataggtggactgggataaggtggcagattttttttttttaaatttttatattttttgtggaactcagtggatagcgtgcattcacaacaagcctccaatctcaaagacggggtggataaaaaagaagggcaccaagattcatgtggcaaattacccaaattttctcctctttctcctcttttgtgggaaattattcccggcgcaatattatataagcataaaatttctcctcttataggggtggagggggtttgtggctggacagggaaaggggaccaggtttgaaccctaacaagtggcatttgtgttaatagaaactcctaaggggggggacaaagaaggcgaggcagctcttagccctgaagcaaaagaaagaggacacttcgcttcgtgacctcacgtgtactcccaaaccttagggaacgccgggtgaacaaaaacagcgataacaaaacccctcaaaaaaaacacaaaacaaacaaaaaacaacacaacaacaggggcgccccaaaaattaccccgcaggggacgcccaacaaagacaagacacacgaatcttgtgacaaagaggtccccaaaaaagaggcgacaaataacaaaagcaagagagcgcgcgattccacacacgccacacgcgagaaaaccacacgcacgggagaccacgtgagacagagcccccatgcgcgggggaacaccgacgggcaccccaccaaagaaaagagccccagcaaacacaacaagggaaatggacaaacacacatacgcggacagatcccgcgcataaaatacggacga

SEQ ID NO: 666802 - DNA, 194 bp, Homo sapiens
tgcaaggctgtacgtgcccaagtcgtatgatggaaagcgttcggggtaggcgattgctgcgacgcgtgcagtgccccgcgccctgcgagatcttcacctcgctggagtacggaccggtgcctggagagccacgcatgcgcactgaaaggagaagccaggcacagtggctcatgcttgtaatcccagcactttgg

SEQ ID NO: 666803 - DNA, 2091 bp, Homo sapiens
  misc_feature (2014)..(2014): n is a, c, g, or t
agcgggagggtgagcgggcgggacccggactgccggcggctgggtctatgctgggtggaggtcgtggccatgcatggctgggccaggtgcgcgggggcatgcctggggcccgcggttggtcacctgccgactggctggtgctgctgcatgcagcggcgatggcggcctggcagcacggcatcgtgaggaccatcgatgcgtgcggcctgcgcgctgggccttcgctcagagctcgcgcacggtgggcccgatcacacctaactcgacatcgatcgcagcaatacaacggctggtgacacccacaggcactggggaacgtcattgcacacactaccctagccacgcagacacctggctggtccccgcgttaacactcaactgggctctcacagtctctcattgcactctagccgtattgtggctacctggaactcccacgcgcgcgcgcaccttgcacaacgtgtgccatggagacagaactcgggacagccacattcacgcccagtaagcgcgctcgcgcacgcctacccccggaacgccgcaggaccccgcaacacgcggactggcggaaggccatccccactaggctggcgacacctaggcggcaagagttccaaggattgcacaccaatatcattggcctgatcaaacaaacgagggcgctggcgacgggccaccacagttcgacaaaccgttcttatgggcatcccttcgtccgcacccatggggcggcatctcccttcctatatgggatccggacacacagtagggggccaacacacggtggctccgccgatttcaagaggagcgaacaacaaagggtgggagccacatgcccccacaccattggcgggtcgattcccccatttggccaaggggcgcaaacgagttaccgcaactgaggggttggattccattccccatatgcgaacaggcaacgcgaaacgcgaagctgcgtgggaggaaggacaacccaccccggacaggaagggggcccacaccgcaccggcaacgttcccgccaagagcatgtcacgcccacaccaaagcggcggatgactgacacgcgagacccgcacaggcccacccattaggagggaccacgagagcgaaacgcacacacgagacgcatgcagatcaggcggcagcacatgtactacacgcacagagctaccaaaaccacacagccgggagtaggcacaccgaattagcgggcgaccgccactatggtgcgcgcgcgacgcgcgcacaccgtccctcacaccgtctcagtgcgtaacacacgaaacaagatgaaccgacgcgatgtccaagagagcagcgacaacacaggcagcggatacgcgcagacgatgtcaccgccgcacagctacgcaggccccacgtaggggaggagccaggaccacccgcgacgactacaacgagagcaacacgacacgccaaccagcacagaggagagtgcgcccacaatcgagcagggccgcaaaaccacagcccgaagccgtacacgagcgttcaggggagccagcgagcttcgacgggattaaaacaacacacacacaaggaagcaaccatctatcccccagcaaaacaaagattgggtggccacgccgaaaagaacattcggagcgcgaaggatggggccaccccagaacacggcgagttcaccgcccccacccacgcgctcaccagaatacgtggaagaacagacaccatcgcggcgccgactaccggaggcgacacgtaccatccaccccacgccagaatgtgggctatggcgcattacgaactagggggcgggggcacacatctaccccgcgtgtggacagaatcaacagccagccgaaacaagacaggcgtatgaggaaaaccatgtgtcgacgcagcgcggaacaacgtcaaaccccactcccgcgagacagtgtagcacaccaaacacagcgggagaggagcgacgaactctggataaacacaacgaccaagctctcacgcaggtacgcaccaagacgacccgnacaaatagctcaaacagccatagacccccaaatcatgacaatccgagagaacaaagcagacagcctacacacaacac

SEQ ID NO: 666804 - DNA, 294 bp, Homo sapiens
ggctggggtgcagtggtgcgatctcagctcactgcaacccccgcctcccaggttcaagcgattctcctgcctcagcctcccgggtagctgggattgcaggtgcccgccaccacatctggctaattttttatatttttggtagagacggggtttccccatgttggccaggctggtctcaatctcttgaccttgagatccacccgccttagcttctgaaagtgctgggattagaggcatgagccaccacgcccgccccagtgtctcttattctaagagattcaaatttccttctac

SEQ ID NO: 666805 - DNA, 433 bp, Homo sapiens
  misc_feature (15)..(15): n is a, c, g, or t
  misc_feature (52)..(52): n is a, c, g, or t
  misc_feature (428)..(429): n is a, c, g, or t
tgaggtttagcccanagttccccaatgaagccggcccgcctagaagccctanttttttaatttttccgagactgccttacaggttgttaagccccacctgcgcccccggccctgttggtgattttgatgccttaaaaatggcccccccaaacgtattgaagtgcctgccctggtgtttttaaacacaagaaggcctttgattacccttacaaggaatgtgtagggaagttttgttcaggcatgagttataatgctgttaactatagttcagtgttaatgaatcagttatttatattaaataaggtgtttttaaatagaaacatacctaaaaggttttatattgtatgtatgtagatctggaaggttgtatattaattggttaatgaaaatatgactagatcatcttctactggctgagagtttatttnngaaa

SEQ ID NO: 666806 - DNA, 242 bp, Homo sapiens
  misc_feature (216)..(216): n is a, c, g, or t
actctagcaggatcctgcgttcgacggtaccaacaccttgtggaaggcgtgaggaggtggatcacctgaggtcaggagttcgagaccagcatggccaacatggggaaaccctcatctctactaaaaatacaaaaaaattggctgagcatggtggcaggcgcctgtaatcccagctacttaggaggcccacatgtctggttaaaactccaactgccnattttttctcctattcgtgacacata

SEQ ID NO: 666807 - DNA, 224 bp, Homo sapiens
cttccatcccggttggtgtttgaaactacatttcccagactgtgtggcccaacatttaaaaataagagtcggggagttcctgaccatccgtggccaacatggcaaaaccccgtctctactaaaaatacaaaaattagcctggcgtggtggttcatgcctgtaatcccagcacttggggaggccaaggttgttggatcacaaggtcaagagatccagaccatcct

SEQ ID NO: 666808 - DNA, 491 bp, Homo sapiens
cagtgaaaagctatgacacacaaccttatgactgcatttctttggtctctggtgagtgtacacacgtctcacaatagaaactgcaactattgagtgcctccaaaatcaaataggtatttaagaaccgagcaatgctatgaaagtatggggctactgggaaatcggcataggccaatgttcctttatcttgaaaagtagctgatttgtccagatgtggtggctcatgcccgtaatcccagcacttcgggaggcagaggcgggtgggacacaaggtcaggagtccaagaccagccctaccaacatggtgaaaccctgtctctactaaaactacaaaaattagccgggtgtggtggtgcgcgcctgcaatcccagctactcaggaggctgagataggagaatcgcttgaacccgggagggagaggttgcagtgggccaagaatgcgccattgtacttactccagcttgggcacaagagcaaaactccgtttcac

SEQ ID NO: 666809 - DNA, 343 bp, Homo sapiens
  misc_feature (69)..(69): n is a, c, g, or t
tctagaggatctcaggcggctggttatggcaggggtttatattgataattgttgtgatgaaattgatgngccctaagatagaggagacacctgctaaggtgtaaggagaagatgggtaggtctacggaaggctccagggtgggaagtagttcccttgctaaagggaggggtagacttgttcaaacctggttcctggctccggggctccaactataggcaagatggcgagcagggaggtaggaagaagaggggagggtaaggaaggtccaagaaggctttattgtttggttttaattgcggggggaaaaccgcccaataattcggggggggcaacccaaattta

SEQ ID NO: 666810 - DNA, 250 bp, Homo sapiens
  misc_feature (38)..(38): n is a, c, g, or t
  misc_feature (45)..(45): n is a, c, g, or t
  misc_feature (93)..(93): n is a, c, g, or t
  misc_feature (107)..(107): n is a, c, g, or t
  misc_feature (123)..(123): n is a, c, g, or t
  misc_feature (178)..(178): n is a, c, g, or t
gatgtggcacccagggggtacacagaacacccctgtanatatcanggccctgtccctctaggctactacataccctgtccagtgctgtcccanaaggcgcagtctcnagtttggggttccacntcctcatgtatccataccagtgacctcctgcccaggacccatgcccatcccaaanccatgggagctgtgccctccactgtgtccccaaatgattttttttttaaaataaaggaaaacatctgtcttg

SEQ ID NO: 666811 - DNA, 310 bp, Homo sapiens
ggcatgcagtggtagtcccagctactcaggaggctgaggtgggaggatcactggaacccgggagcagagactgcagtgagctgagatcacactactgcattccagcctgagcaacagagcaagacacacacacacatcaatttattttcgtcgtataatgcttttttattagtaacgcatcagctaagcttccgcggcctgctccatcccctaatgactcccacgggctatcctaacggaacttccagaaccttcgtggtgtgttgacattgaccatgcagaccaattcttggacaacctggacattgat

SEQ ID NO: 666812 - DNA, 324 bp, Homo sapiens
  misc_feature (3)..(3): n is a, c, g, or t
  misc_feature (324)..(324): n is a, c, g, or t
tangacagcaagtgtcggatccgcagcgcagccgtgcgatgttgtactctacagccatgtattcggctgctggcaagacttggggatgcaccgcacagagccgcgggccctttgcagctgcatttcgccctacgtttcaacggaggggtaaaaacccgaagagagctacggcttttcacttttcgcccttccccctatctgctgaaccctatttagggagtccacgccgtaatggcgctgccccggggctccttgcagggcccttcagaacccgtgagctgaggggggtccgcacaaaaggcggggtcctcccctggcctgtcn

SEQ ID NO: 666813 - DNA, 137 bp, Homo sapiens
aagaccgatgggaccgacaggcgtggaagaacgccagcccccggacatccgcgcagcaatgaggacccatgcacacagggctctggaggtacccgtgagctgcctgggggctagcaggaggggggaccgactggggc

SEQ ID NO: 666814 - DNA, 126 bp, Homo sapiens
tcccctgcctctgagaatatcacacaatgctgcttccaggggcttagagacctgcaagaatatgtgctatgtgtgtactgtactctactgtatactgcttttagaagaacactggacggagggaca

SEQ ID NO: 666815 - DNA, 196 bp, Homo sapiens
  misc_feature (83)..(83): n is a, c, g, or t
  misc_feature (191)..(191): n is a, c, g, or t
tctactaaaaatacaaaaattagccaggcatggtggtccacgcctgtgatcccagcacttggggaggctgaggcggcagatgnctgaagccagaagtttgagacctcatctctcttacaaggccactaatcctataaatgagggcttgccctcatgacttaatcacatcctaaaggtcccaccccgtcggntggag

SEQ ID NO: 666816 - DNA, 1021 bp, Homo sapiens
  misc_feature (726)..(726): n is a, c, g, or t
gctgggggctgatccaccctagtactgaggaacgcacgaagaagtcctagcaatggtgctaagaaacgcaaccaggccagataccaagacagaggacgtatggaatgggcccagggtctcgagcggaccttatggtgtgacagtgcctctcggaactccgttgaccacccaaactcctgtgttctataacacgaccattaacttactactgcaaggcgtcctagtaggctctgtacagcgcacagaactcagctcgatctatccctgcagcgtggcctctctgtgtgtgacccgagtactcgtccatgtgcgcattaccgaatagcaggaatgctgcgccacgctcagatcgagacttagcacctgaaaggttgcctgccgcacatagcttcactgaccttgtgcgtcagtggcggtttaggagacctctcgctcttagtataggaccctctggtgttaccggggcaagcagcgaatccttgcaggtggcccagatggtatcaggctgcccgttcgtgctagacacgtcgtacgcaagtgccgaaaaaggagtaccatggacgtcgaggggcgatgattggagaccacgtcactacttgtacacactcaaagatttgcatcgtcgccaggcatcttttcgctacgggatttgtcagaacattcccgaaggattctatggtacgtccgttaaatgtttactcaatgttgggattgtcgaggcaaatnaacgacatgggcccatggcaagggatagccaatggatgactcgcctcccaggctgatctcccgaggccgaggcacttagccgatagacacccaggcctttcttagccaatccttactacttgtagatcctacccagaacaccttttaaacagcgtgccacgtggggtatgtgcacccagcaaggccccccaagctatggacctgggacttgagctccactcaaaggttttcagcaccagaacacctgcagtagacaacccatgataaggtaccatggactccaatgagtgcccag

SEQ ID NO: 666817 - DNA, 412 bp, Homo sapiens
ggggatttctgaagctgacagcattcgcgccgagaggtctcgctccgtggccttagctgtgctcatgctactatctctctatggcctggaggctatccaccgtactccaaagattcaggcttactcacgccatccaccacagaatggccagtcaaagaccctgaatggctatgtgtctgggcttcatacatccgacattgcagttgacttactgcacaatggcgagagaattgaaaaactggagcattcctggtctttcagacaaggactggtctatctatctcttgtactacactgaattcacccccactgagatgagtctgcctgccgtgtgaaccatgtgactttgtcacagcccaagatcgttaagagggatcgagacatgtaagcagcatgatgaaggcctggtgcc

SEQ ID NO: 666818 - DNA, 219 bp, Homo sapiens
cttcagcaattgcaactggggctctctgtcttatgttcttcacaccccctccatgaatcaggcgtctggaaacgaggagcctcctgcgcgcgcgcgcgcgcacacacacacacacacacatacacacacacacactcatgtccggtggggccagatgtctgggcgcgcgcagtctcttgattcttaaagagtctccatcctatcctctctaaagcgggg

SEQ ID NO: 666819 - DNA, 142 bp, Homo sapiens
gccaaatgggcgacgagacgccggaggggtcgtgttttcgctcaaggcgtcgcgctatgcgaccaactgccgcgatattggcctggcgccaaggattcgatccagcgcttcgtgaacagcgaaatagccgaactgggcaccc

SEQ ID NO: 666820 - DNA, 200 bp, Homo sapiens
tgccacatagcaggtcaccatctctacaaaagaaattttacaaattagccgggtgtggtggcgcatgcttttaatcccaggtactcaggaggctgaggcaagagaatcacttgaacccaggaggtggaggttgcagtgagccgagactgcaccattgcactccagcgcttgcaacaagagcgaaactccggctcaaaaaa

SEQ ID NO: 666821 - DNA, 820 bp, Homo sapiens
ggaggcggaggcgcagtctcagctcaccgcagcctcaccctcctgggatcaagtgatcctcccacttcagccccctgagtggctgggactgtaggtgtatgccaccactgcctggctgattttttttttttttttggaaggggatgacggtggggagttcagaggccggaccttgaccaactgggaagaacaccccggtcttcttacttaaaattacaaatttacgccggacgcggtggggcgccattgccttgtaacctcccagcttacctcccggaggcggagggggggacgaatttcgctttgaccccgggaggggggagggttgccggtttgagccgagaatagccacccagtggggactctcccaggccctgtggcgggattagacgtggaggcaccctccgcttaaaaacaaaaagcacaaccaaaaaacccacggacacaaacaaacacacagtgtgtgtgtggggcaggcctagggggccccaaaagaagaaacggttttttgatgacaaccaccaccttcggtgtgatgtgcggcgcgcggggagcacccccaccaatgttgtgaactgtagggagcaaccggggcgcaacaggggtggtcaccaaaagagagaaaccaccggggacagtaaggacaaacggtggcgggggggttctctccccacaattataaaaaaaaccgcccgggggggagccacacgagcgcgtttttaggaacaaacacccaaagaggggagtacagggacgcccaaccagggggagcacacaaccagggggggcacacagagggagaccccaagtataaatacgg

SEQ ID NO: 666822 - DNA, 1229 bp, Homo sapiens
  misc_feature (418)..(418): n is a, c, g, or t
  misc_feature (445)..(445): n is a, c, g, or t
agcgggcagtctagtactagagggcggccgaagaggcaagcgtcaataaagatgagagcagtcgagcagctatacacctagtagagcagcgtctagcgataggtccggagcgagagccactggccgagatctaaaggcggcagtaccctagcaggaaaatgaaagaatatagcagaacttccagcatgttccacgtagcttgctaggtaccagatatttgatgtattccatgagggattagtaggctggagatgtttgtgaggtgagttacatactgggtgtattcgccatttagtgaccctagacattatcagcaaaaggaggaataaggaagagacctactctcactaagccagagaataaaattaagcacaaaatgcgatgctggagccaatgcaaactagacaatatgccaaanatgagaataatgacgaaatgaagatanaaagcatttaaaccggaatggtaaactataaacaaagcgtttgctccgaaatgaacaaaacaattaaaaaacctgataaataaaatattggaagataacgatggaatataaaaaaaaattgaacgaatattctaagcagatagggtgaaaacccaaaagatgaatatatgcattgagaacataagggaaaatgaaatcattgagaactatagataaagccaaaatattgaaagcaaaaccggaaagagacaaggactatcctgaacccaattctaaagcgaaactgacgagaaaagacaattttaaccgaaaaacttacatataaattagaatttccacaatgaaaatcataatagatacagctatattctcccaagcatgccatttcaattcaaagaatggcagtcgactctaaatacacagccagcttataaattaaactaaccaaaggaaccagaaaaagatttgaagccgcgagaatttcaaataaaccgattttttataaccaaatcacagaaattgatttgacccttattaagcgggatgatacgcaggctattgccatgtaattaagcgaagacgcggggaaaaatcaaatccataattccagggccaccttgagaaaccctccaaatttaaaaaagccctcttgtagagcgacaaaggaaatgaggggcgaatttcaagccgcaacaaaaatcgtgacccagcgggccaaacaaatttgacagcctaattaacgaggaaaaagcatacccggggcctcccgcgcaaaaaaaacgct

SEQ ID NO: 666823 - DNA, 249 bp, Homo sapiens
caggccccccccccccccccggttggccttgccattgtgggtagacccccccccccacccaaccccctgttgggttggggcagcctttgtaacgggggggggtttcccgggttttccgggggaactggatttgggttgggggccttgtcccgggccgcccctggggggcaggggccccttcctttggggccccccgccttttggatcccccccctttgacgctggaataaacaggctgtttttcctcga

SEQ ID NO: 666824 - DNA, 1222 bp, Homo sapiens
  misc_feature (530)..(530): n is a, c, g, or t
  misc_feature (783)..(783): n is a, c, g, or t
ggaataatctggatgacagaagctaaggaatgatagtcacgacaggaaatccaagcgcctggatgaggaggaggaggagaatgaaggcggggtagtgggatgagggtcctgcgggctggcagatgccggtttggattagagagcagatacgccaacacacatgatttgtcaaggcgaattgagcatcactcgcatgctgctatgtctcactccaagaatagctgcaatgagtatccttagcagagcacctgagtgttgcaagagaggggcacactgactcggtgcatgccgcagtgaattgtagcctagctcgcaacgtgactgcgttcctgtgaattgccagtcagggaccacagcaaccatgggcagcagaggcgatccattgttctaaaggaacttcacagttgcacatatgcatcggctctgtctcatcgctatgcaacttacaatgcctccagatccctggtgccacaccctgtactgatggaacggccagggagatatgctgcggtggcacagctgacctgggnacatgactattcaggttgggatgcctgcattgggaagtattccctgctatttgccataacttcgcgcaaatcagtgttgtgggggtccggccaggaaggaaattaattccgtggcacacgcacgtaggttcgagcatacccattgccaatcaaagcggccttgcactcatgtgcaacctgtcggtggtacccgcttgtgccttagcattccttgagagctcttggtgggcaaatcgacactgggagtgaaagnagaattttacgcgagaagtgaatgtccacaatacctgaacccttctacttccacaatggtagttaccgttgagtaggcgaccttttcacaggtagtgatgccgcagggtgtgctgccaatccaatctgatgcgatgtgcggggggcgtatcctgtgaggaagaatgggcacctacccgtaggaagggtcttgccgctattttatcttgactgaagcaattcctgagagaatcttagtaggaaggttttgattacaaggggcccatcaggcgaacaagctgacccctggctgaggtgctcctcaaagtcctgagcaagaccagggcagaaaatgaggggcgacgactcggtgtgttgactggagaaactggggcagtacatctacgcccgaggacggacagaagggatcggacatgtgccatctatggcaatttacaaca

SEQ ID NO: 666825 - DNA, 148 bp, Homo sapiens
cttcagactcagataatgattgaaggttctccatagaggaatcacacagttgctctatgctttagccagataactgcctgctgcataaagaataccaggaaaacggctggacaccagaacttccttcagtacttgctactctggaaag

SEQ ID NO: 666826 - DNA, 164 bp, Homo sapiens
aaaacatcccttttttaataaaccaaactaaaatgttagaaaacaacttttcaaggatgcttgtcccactatctgactatacatacataaattcaatagaaatacttttgaacactcacataagggtttaagtaaataggtaaaatctatttccagtcatcaca

SEQ ID NO: 666827 - DNA, 1227 bp, Homo sapiens
  misc_feature (1014)..(1014): n is a, c, g, or t
ggcttgcagcgcagctcgaatcagcagcagcccaaggaggtctcccggccggttatttccccggcgtccatccctcttgtccccacgggtccggtgaagtcagcggagcttgattggagggccttgtggcttctgggggcactatgtggggaggacaggcatcgaggtccatgggcgggcgggggccccttgtgtggcccttgggacggtggaggggttgtcggacgcccggataggggtagcaccgggagaggatcatatacggggacgcctttcgtgcaaagaaccgctacacagtcggcacggcgtggtacacgcttttacttgaggaacccgtggcccctggggctgtatttggcgccaaaagaaaccttttcgtataaaaccttctccataaataagtgtccgggggcaccttcggggagggagtttccttcaaaaagggttacacaaactgttggccaggggctaatatagttaacttcgaaacgcaaggccccagattaacagcttttgtggggggggacacattatagtggggagggagccactccacatccgacacagagagaaattgggcattggaattttttcaaaagcccgacaaatgtgtggacttcaaaacacagaagcggattaaaggaggccaaaagacgggtgggaagcacaagagatgtgtccggggcatgtcgtgataggaagatttgggcagagatcacttgttggggccgaaacgtgttaccatagttcctgtttgtacccacattttgtggctctattacgaagttgtttgtagtaaagggatcaattaaacagactgggtgggtgttggcgcacaaatgacgataagcgagaggcatagtaagatataacagaggagagcccattttgttgtggttgggtacaacaaaaggcctccgcttgtgaaaaaatgatttatatattagacgccgccaaaaaagaaggtcgggctagtctaaaaagagcatgagattagcggaacaggtgtgggcnacgaaccacataatgtgttggtgcacacgcttaacttgcgagaggggcggaagcaacaaacttaaacttcgtgtggagaaagaggaggcaaccagcgagcagacaaatataagcggcggtgttataaaaaacgaacaagtgtggggaaacaagaatgttcgcccttgagaaaaggaagatgatatgtccgtggagagagaaagatgttgatag

SEQ ID NO: 666828 - DNA, 164 bp, Homo sapiens
  misc_feature (7)..(7): n is a, c, g, or t
cccttgnctaccatttcagccttttatgctgaatgttaacaagaagatacatcaatgccatatctggaccaaatcaaaatccttgggatgtcaattggggtgcacaacatagggcagggccgtgtctcatgtctagactatgatgaacattacattctcacatt

SEQ ID NO: 666829 - DNA, 143 bp, Homo sapiens
  misc_feature (41)..(41): n is a, c, g, or t
gcgcgtaccccatagaaaaagatacacaaccgcgatggatnaaccatgaagctgacttcgttgctgaaacccttggcggcgttgtggcagagctggagcgccaatataatgtagacttaaagctaaaagctaaccgaaataaa

SEQ ID NO: 666830 - DNA, 149 bp, Homo sapiens
gggtcatgattcatcccggaattgtggccatgctcatgtgcccagggtccacggcttgcacccaaggggattgtcttgactggtccatgacaattcccccagactggtctgccgtgccatgctcactgattggggccatgccgatggtg

SEQ ID NO: 666831 - DNA, 552 bp, Homo sapiens
ggatgcacgtccagcaaggatgtcaggaggaggaatatcacaggagttataggacattggagggaacagagactggcacaggacctcgttcatctgcatggcaagatgtgtagtgtaggcaggtcaaccattgcagctcttttcaaacaagaggcagagctacttctatcaagatcaaggcaagtggtcagttatggtggttaacccccggctatcagtccggatggttgccaagcgcctaccgggctgtaagggaatggaaagcaagagcgagtggagtaggggacgggaaggtcgacaagtaaagagcagctcctatacacgagcagaggcgttgtggcgattcattgggagtaaagcctggtattcgtagcacgtctatccgtgggctaccattatgattctacaatggggctcttgggtgctggcgaagcctgtatccgtatttctgagggatggtacgttgtcaatacgtatcgtccaaacccaatgcaggaaaaacgacgtgactcgtgtcagagacgaggtggaagggctcgttcagtgaaaaca

SEQ ID NO: 666832 - DNA, 167 bp, Homo sapiens
aagtaagtcgtggcctgtgtgctggttctgggagcagcgttctgcaggtgttgaggctgacctttagctcacaggtgagatgtcccatcatgatactttggatgctgcttcccaagtgaataaatgtcatcctctgtgaacacagcaacataaccgagcgtggcaat

SEQ ID NO: 666833 - DNA, 397 bp, Homo sapiens
gccacagtaggagtgagacagtaggtagcgggacaaggcagtggagtacctataacgtggccatactacacacgagcactacgccctactgacctggaggcgcactatatgtgccgctagtgaagcggctggcgggacggcgactggtatacacctacccgacacctcggcctagcggcctactatctccgtctgctcacccccgcagtgtacagtgctgtgaaggcggaactatcgcacagtacttccggaacctgtgctcagatgacaccccaataggtgcggtgggccgcagactccgaagctggggagtaagcaaagtgctaggagctggacacgtcacagtagctcatcccagtctcacccggctctacagccatacgtcggtaagacgtga

SEQ ID NO: 666834 - DNA, 400 bp, Homo sapiens
aaggttatcatacgctcaaacattcactttacaataggcaggtaagggagtaatgggtacaggttattgcatcgacgaatacagttttgtcgacaatgtgttcctgtatttatcaggatcctatactctaaatcctgaagaatcagtgtgcataatgcttctaacctcttcacctttgctccacggttgtcgataccagcatcattatcttaccttagcattaggctgagtatgctccttccgggttgcaaaatgcctaatgatcatgtagccccttattaggcgcctattcctcttctatagggagggaaggaagaatatcaagaaagcctcatgtctaagtgccctgtatccctggcgatctttatgtagcatcagagaatagacactgataaaaaca

SEQ ID NO: 666835 - DNA, 905 bp, Homo sapiens
  misc_feature (320)..(320): n is a, c, g, or t
atagttgcgtgtgtacggtcgcggagggctgtgcgctattatgttcatttattagctctggccggaatttaactatatgggtcccacgcgcgtatacttggcgcgcccatttttatccatatagagctcgctcggttcaaaattccgtttgccctccccggggaaccttgggtacaccccacgcgctttagaaaaattattgtggagcccgccaattgaattgttgcaattcccggtttacaccgtgttctctaccgggagtcccctggtcggccgattaataattcacacctgagcgtagaaaaacccccttattaatntgcgcaagcgacccccaaacctagatcggggaccctcctcgcatagtcgtaaactcagtcttaaaaggagggatgctgtgtagtctaagttcacccaccacacacggggttcccgcccccgaagaagaaaaactatggggtgcacccgaaatctccccacgcaaaataaggaccgtgtaagcaacaaatagtggggaaacactgtttagttgtccgtctccgaaatgcggggacccaagactagtagtagtatctgcgaaacacgaaaatctgccgtggttttgaaaatggtgaaaccctcccgtgtacctttccttaaatagttgctattattataacgtagtgccaaaagaaaaacctttagttgtatataacaggcactgcctttagacccacattaaatagttatttgtattattatacttcccgagcaaaacacttgtttagaccaccaatagcgcgcatttgaccaagatgttattaagacagtgatgttttttacaccacaagctactgtaccacgcccacgcattttcaaaaattttgcaccccacaatagcccgcaacaaaacaccacctttttga

SEQ ID NO: 666836 - DNA, 206 bp, Homo sapiens
ggatccttaattctgcacccacagcatactaattacggagcggactgggtgatgagagtcacctctcctggcttacctggtaacgaagctgccactccccatttcttgcttctgctgcaaaggaaagctggggtcctggggtgcttttcggctttgacctctggtgagacccctaaagctctcagtgaacgggctgtgggtggcca

SEQ ID NO: 666837 - DNA, 106 bp, Homo sapiens
ccccaaattttaaaaccaattggttaaaattttaataaaggccattttggaaggggtgaaaaggtaaaggttcaccagccacctttaaaaataattttgaaccttt

SEQ ID NO: 666838 - DNA, 173 bp, Homo sapiens
  misc_feature (14)..(14): n is a, c, g, or t
  misc_feature (62)..(62): n is a, c, g, or t
  misc_feature (143)..(143): n is a, c, g, or t
caaaaaccccatcntatgggcccaacatctgtgacgggcaactttgacaccgtggccatgcntccgaggggagatgtttgtcttcaaggagcgctggttctggcgggtgaggaataaccaagtgatggatggatacccaatgnctattggtcagttttgggggggtctgtctg

SEQ ID NO: 666839 - DNA, 197 bp, Homo sapiens
cgagacagaacacacccagcttagttcttttcttttcacataggcccaaaggttgcatgggtgtgagctttaagaactgattttccccctacccaggctgaactctggtgtgggaggagccttttctggggaaggaggtcactcactggaccttgagcaggccacactgctgctgcaggccaacaagcggtgagtgc

SEQ ID NO: 666840 - DNA, 147 bp, Homo sapiens
tacagcgatgtcggcagcgacatcacgtgcgcatcagcgactttctgcaggtgcgacaggtcacaactttaggcagcaccctacactgcctccccagcatgtctgcacagtatttcgttaatggggtgaataatcgtgcagaagatg

SEQ ID NO: 666841 - DNA, 841 bp, Homo sapiens
tttattgggtaaccggattaaaaaaaaattttaaattcctgtgtctctcttctgatggctgaacaaaactggggtgtcaaatggaaagcagcccccaaaaatctccctgtggcaaaacctgtgatctttcgcaaaaatgcaaaaacccctgagttatacaacttgcaatataattattttctacacagaagttgccaacgtggtgtgcccacgcggtccgcgaactagttctgtagaagactttacaagcaacaatgcaagcaagtatagaaaaagcgctttgaacagctccgtgggcacatacatgtgctaaattaagcccaaagagtggggagaaaggaaaaaggagagacaaatatcagtccatacggagtggtcactcaaccaatctccagacgtgaagtcttcatatttataatctcaaatccccttttctgatttgtgccacccagtgcctcttcaggcgggaaacaatctctgggttccctaaagcacttcctttctgacggccgggtgactccagtgaacctgcccttgggcttctataactgtggcgcatttgggcctcaccctgcacaaaggtgtgttaaaatcccgccttggggctactcccttaaagctggctccaataaattatttggactgcgcccaacaaacacaacacaacacacaaccaacacaacacagggggcgcggcgcgcccaaaaaaatcaccctccgaggggggccccccagaattgaacgggttacccccgtcttttgtgcgaaccaaggggggcctcatagggggcgcggtatataaacacgcaacgacaacggcggcgctaaacaacggctgacg

SEQ ID NO: 666842 - DNA, 344 bp, Homo sapiens
  misc_feature (37)..(37): n is a, c, g, or t
  misc_feature (48)..(48): n is a, c, g, or t
  misc_feature (96)..(96): n is a, c, g, or t
  misc_feature (162)..(162): n is a, c, g, or t
  misc_feature (204)..(204): n is a, c, g, or t
  misc_feature (210)..(210): n is a, c, g, or t
  misc_feature (259)..(259): n is a, c, g, or t
gaggtgctgtggcaagaagctggcgcagggcggcccncccggacctgnctcctcacacctgtggagcgcatggtggcagagaccttttccgcccanggtccccaaggcgagggccagaccacggagcccctgccaaatagtattgaagccagccttgaggtncgctcctcgcatgcggaggcagcccgccagctcctggctggnagccanccggcaccaactgatgaggaggacgagacccccagctgcttgtggctgnccctgaggtccctggaaggcccagcctgcctgaacctgaccccctggacttacgaggagtcttccacgcacccacctcctcaccc

SEQ ID NO: 666843 - DNA, 854 bp, Homo sapiens
ttacaaaccaggttagtaatagaacttgaaatgacaagtccttggaacctgcgggaaggtggttcttgtgtgaagcccaggcttccagacttagggccaaaaaaagggctagtgtgaggggacctaaaatcttgaactccttatatttcttgctgcccccacggttgtcctggggctgagcttcccgttttttttgcttctgtttggcagcgtgctcagccaccatgtcactgaagtcctccttctttatcttggagcctctgtctgtctccccgcactatgtctccctctatatcttctgggtcccatggcctataaggtatcccagctcccaactcttctaggcgccagcgccatttccacactcttgcagtctcaggagccgggcccttcccggtctctataaccgtggactttgtcataatatgtggtgttgtatcccctaatctatggcccctccaacaggtggctgtctctctttctcgtgggcaacccagttgaagagctgaggtgtctcactttccgtccatcgccttcctcaatcttcttcttcctcgagctcaattgaggtccaggggtctccatctccagcaggccacttgttgaaaagcctccaggagttgataaggcccactgtctgcaggggtaataagagcctgtctcatctggttggtctgtcatcacttttcttcccttcttcctctatcttctgaggattcttctctcagatggttcccaagttccccccaagggttccgatcaatctctttctttcctcagttcttgcgtctgaatttcgcccgcttttgttcccaaaaccgtcccccattaaagcggttcccccagttttattc

SEQ ID NO: 666844 - DNA, 616 bp, Homo sapiens
  misc_feature (311)..(311): n is a, c, g, or t
acctaggtgtcttgcgttcccatttcccaatggctcacatagcaaatgatggtacaggccatcaggcctcaagtctcctgttgctatgaaagggtggtccccctagaaatctataaacaatttaacgtttttctgtaagctttgatactacttttctcccacttttttcgtgctctctacacaccgacgtaggtccagcagactgcactgtcactttaacggaaacagatctctgctactgcgaactttaggcgagtctcacgatttaacactcctagcaactgcccaactgcacttgtgctgctgctganccctaagcaaacttactaaacagtctctaagccttaatatgcccatctgctgaatatctatactctacatcacagaactcgctctgacgtactctaacataaagataactgtaactgctgaaaagcaaccttggtatgctacagaacgcgaacaaccatcaaactctgaaagcttccattactcaaactatgctctctactcctgtctccaaacagcacacgtggtaccacactggcgcctcattaactggatcatacaccgttcaataaccctagattcttacttcaggtaccacaccctactc

SEQ ID NO: 666845 - DNA, 121 bp, Homo sapiens
ggggcgagtgcgtcatattgttgttcctaggacgattgtagtggtaaggctgtttattatgattctgtttgtgtattcggctataaagaataggggcgaacgggggttagtgcccgaagct

SEQ ID NO: 666846 - DNA, 445 bp, Homo sapiens
aaagccttgacgaagaaacagggggaggatggtgggcccgtgggcagcagaggagggggagcgtcgatgacaaggaacaataagcccagagacaccgagcacaggaagcgtgtgcaccagacgcgcgacgagagaggcatgatcaagcatgtgaccacagcaagggtgccacgggctccctaagcatgaacaaggaaagggccctcaagtcctaccacagggccaatatatgccagttcagtcataagagccaatagcctcacaagcctgggcagcgtgagtatgaaccatgccaattgctactaagctccaaaaagaagaatgaccagcttttcaaaggagtccgtagggtggccaaaggcaaccgccattgccattattaaggcaggtcaggcggggtgccaggcttgccaccaagtgggaataaaacgcaacttatttcaca

SEQ ID NO: 666847 - DNA, 100 bp, Homo sapiens
catatggtatcttcgggggaaaaaattagaattttagaaatcctatacaattttagacacagggtttgatgaccataaactaaatataacctcaagaagg

SEQ ID NO: 666848 - DNA, 188 bp, Homo sapiens
gatgtgaggatccaggagagagaggcccaaggccgagacactgaagtgatataaactggtataatatttctgggatgtaatcctatttgacccataaattctacctctggtaatatattttaaggaagtatatattttcttttttttttcccaggctattctcaaactccggggcctcggctctccag

SEQ ID NO: 666849 - DNA, 153 bp, Homo sapiens
ggaggacccctccagatcagcaatttcctactcctccaagtagtgagatgacaggcgtgtgcacacgccagctaatttggtattttagtagcgatggtgtttcactacattggccaggctggtctcgaactcctgacctcaggtgaccacccg

SEQ ID NO: 666850 - DNA, 107 bp, Homo sapiens
caccagatgctcccaccacaccagatgctcccatccaagtactaaccaggcccgaccctgcttagcttccgagatcagacgagatcgggcggtgggagcatctggtg

SEQ ID NO: 666851 - DNA, 128 bp, Homo sapiens
tcgatacgacttttttttttgttccttttttcctctgtgtgcagtttacaagacgagtttcctttctcacagtcagcgtaggtagcgatctgtgatggctccagcaccagcgtctggcagccctgcat

SEQ ID NO: 666852 - DNA, 256 bp, Homo sapiens
ctttactccgggtggtggaggctacagttgcagtgagctgagatcatgccactgaacctccagcctgggtgacagagcaagactctatcaaaaaaaaaacaaaaaaaaaaagcccccctcccgggcttgaaaaaaggggttttcctcggttcggctcttgtgggggggcacccctaggggggcaagagtgttggggaagaggcttacaccccaccttcccgtgacgtgcttctatgtaaggtttcggggagctcct

SEQ ID NO: 666853 - DNA, 484 bp, Homo sapiens
gatcctgccgcagtgcttggggctgtaaccttgaactttcccagcgcggtgacacattctccccgctctccctaacggaagaagaaagacccagcagccgacacaaagagcaaaagaaagacaaacaaatcaagagaacacgaagcaaaaaaccaccaaacagcaaaaacaacaccacaccaagacaaaccaaaaaacaagacaaccaccagcacccagacacacacaacacaaacaaaaaaaagagaaaacagagcgaaaaagacgaaacacaaacaacgacaaccgcccacactctaactctcacaaacatcagatagagcacagaaacatcaaccgactccaaagatggaacaaacccgacaaagctcgcacgaagagaaataccacatgacaatacacacgaagcgagacacagcgaaaaagccaacaacaaaaaagtcaaacacccaagatgactaaagagaaagatgaagacacagtc

SEQ ID NO: 666854 - DNA, 555 bp, Homo sapiens
tggccagtctctacctctcatgggctgctggtttaccaataatatccagttggccacccaagatctttggatcccaacaaagagttggatttttgtcagaaggacaaacaaacacaagatcggttttatgattaaaacatatatcagacattaaagcagatcaagagatctagccttagagggacgggaggatcagggggtaggcctactcactgccagggaggggaactataaagtatgctaagatacggtaaagatatcattccacagaccctggtctcaggtggattcaattgtataatttctttcttgctttctttcttaaagagatgatgtctctcggtggcctaggcgggagtgcagaggcaaatgcatggctcatggcagcctggtactcgggggctaaagctatcttctcccctcatcctccatagtagctgagactacgggtatgcaccaccaggccggggcatgtggatttgagaggtgacagtcagggagatgcacagttcagatctctggcaggggaacctggagcagaggtctagcagccca

SEQ ID NO: 666855 - DNA, 181 bp, Homo sapiens
ctgagctttatttaaagcaggggaacaggcgcagtggctcccagtactttgggaggtccaggcggtagcatcacttgagcccaggagttcgaggttgcagtgagccatggtagcgccactgcattctgtccagcctgggtgacagagcgagaccctgtgctcccccttctgtcgtcttctc

SEQ ID NO: 666856 - DNA, 688 bp, Homo sapiens
atttttaattttattaaaaatataatttaatgcaggtgttgaagcatctgtcttcatatgatggcattagaacacctggtataataaaattaaaatctatttttaacctaaaaaaaaaaaaaaaaaaaaaaaaacaaaaccaaaaaaaaaaaaaaaaaaaagacaataaaaaagaaaaaaaaaaagcgagagcggggcggcgcgccacgcaagcaggagactgcccacgcacgagggggggccagcaacaggagtaggcggccgaccccgatgtttagttggtacaaaagagggggccccaatatgagggaggcatatctaataaagaaccagacgaagaagggggggcgggataacaaccagccaccagcgacgacaagggggagaaaaacaatgcgtcaaagaatgggcgaaaaactcatctagggagaggcgaacagaaccacctccacccacagggggggaggggggggaggacaaaatgagtggggaaaaacagcaccctcaccaagcggaaggaaatcaagaaacatcccaacgagagacataacaacaaacacatgacacgagggcagctaacggggggacaaccacaccaagctatcactactcgcggagaaaaaaaagtgaacaaaaccgagaatatgaagcaagaaataatcacaccggcccgtctaataaatgggcg

SEQ ID NO: 666857 - DNA, 933 bp, Homo sapiens
agctctgctgtcaagtgctcatctgcagagtgctatatagccggcaaagtctttatatactgcaagcggccccgtgttcctcgttcggctctttccccttctgaatgcgccacggaagtgtggaatacattgccgtgcccacaatatttgggtgttaaagcgccaaatccctagggaattgcaaaggcccgctttgttaacggcgcattaagggtgacaaagaagatgtatcacatggttgacgaaggcgaatattttccagcgcgctccctttaggtgcaaccccgggcgctccttgctaaagggttgtcgcacaccaccggtccccctgtgggggcgtttgaaaaaccccccccccgggtcttcaaaagtttatttgggctcctacgccccgctcttcctttgggcccgcccctatctatttctgtgtcagggaaagattccaatgttcccaactattaaaaggaggacgcaaatggtcaatcctctcaagtagtacattgtgggaaacgtgttgcccccccgatagggtggcaccacgggttccccacagcgatataacattccaaacctattgctgcagcagtcgatacagattgaggcagcaagtgagtttatgcatggaggcagttactgagagagaataaagtgggtgcgtcagagaggacagtctgtttaagagcagagggaaactgtaagttaaataatgtgcgcccgcgctaggaagattctcttaacccgagagtacattcccgcccgggacagttgacgccgaactcatatccagagtgggtaaagaattctttccaccggtgtgtcgccccccgcgtcctcataaggagaccaaagtccgctccacaagaaacacagggaaacaaatgcttctcaaccccccaagggccattttttaaaaaacacataacccacaaaaca

SEQ ID NO: 666858 - DNA, 1502 bp, Homo sapiens
gactagttctagatcgcgggcggcctgcccttattctatatttattattttgacttaatctagctgagaatctatttctagtacgattaacaacttgaactaactacattaacggataggaactttatttttcatttttgtatcattttttctttgtatcattatttattattgttgggaaagtggagactctcacatcgtggacacccgaggtgtggaagtgtgcaggggggtgtgtgactcatggagcctcacgtgagaaccgtcgtgcacctacccgaggtgtctacaagcaatattctctcgctgtggccctcgagacacctcccacaagtatagacgtgggaacatacgaggcccaacagcgccgaccgagcgaccacaaaatatagaattgtggtgagtatttaaaggatcaaagaagtggggttttcaccaagtgtttggcgcccagagagatgtgtgatctctccaaatctctctttgtgagcacttgtgagagatctccacccacaacctctcaagaactctcacacagaaagggtgcagtgggaatctccccagagagacatgatgaggcacaaccacaacacccacagaggagaaaacgcgagagagttatacacaataaagttgatgtaggcgcacaagcgggcagaggggacctactcccaaaacacaccctgcgaaaccaacaaaaagggagagaactctgtggcgcccgggcacatgtgggcgccctcccccaacaaagggtgccgaggagaacataacaagacgcacataagaagagccaaacacaacgggcaatggggcaccgagggaaagagcagacaaatcaacatgagaaacagaaaaggacaaatactaaccccccgcagataacacagagacttcacgaagcggacatacaccgctacgaggggcgcgagatacacaagaaggggaagaaacccccaaaaaacaggacgacctatacaagcgggaggaaaacatatacaacgaggggggaacaacgaacgggacgaataccattaacacacaaacgcaacatctgggggcgaagcagacaagatatacacaagaaaaacacaacgaacagcaaacacgaaggagcccataagaacacaagcggagccaacggcaggcgcacgtaggttccaccacactatggacgacccaatgtctgagaactaatgtgaccacacacacgggagcaagcgaggaacagagcgagaaaacagtagtaggatcaaacagaagcgccatacaaacgttgtacaggtgaacacacacaaaacgcaaacaggagacaaaacatatacaacgacacaggaagtaaaacaacagaccataagcacttaacgcagacagtaaggtaacaccatgagagtaagagaaaagtcataaaaagcacagcaacatacagcacacgacaggacgacagcagcatgagcaaggcagtaacgacagaacaagtagggctactgtacgacagacaa

SEQ ID NO: 666859 - DNA, 163 bp, Homo sapiens
  misc_feature (154)..(154): n is a, c, g, or t
gagacatggtagactttgatcaaaagacttggccccggtggagttcggggcctttactttggggtatggtgaaatagaccctgagtgactttgtcttggcggtgtttcaggtttcacttgtggtatctgtgtgatggaggacccagtaatgacntgtatcttg

SEQ ID NO: 666860 - DNA, 471 bp, Homo sapiens
  misc_feature (22)..(22): n is a, c, g, or t
  misc_feature (62)..(62): n is a, c, g, or t
aagaggcacctgtggtagatgnatcattatctccagtttgcagatgagtagctggaggcttngatagctaagtaacttgtacgaggtacagaagtgctcagtggcacatctacctgagccccagccgtgtcttgaaggcccatgtgaaaaagcaggcagcattgagaaccggtgaggaactcatactcattatctaggctggggctctttacttatttggtcagtctgatgaatgctctgcatctccaggcttgaaagtacatctccacacagtatttgtgaatgtgtcaaagggttcagacccccaaaagcccatctaatccatatgtccactcaaacacttgtacacaactgttcattgcaccattatccataattgccaaaaggtggaaacagcccaaatgtccatcagctgaggaatgaataaacgaaatgtagtacatccatacaatggaatatgattcagcaata

SEQ ID NO: 666861 - DNA, 1099 bp, Homo sapiens
agcgggttgcattccggtaccggacgccgagatcggtttgtctccgtctctggagttgtaagtggcgatatggtgatcatgtccggtctgcgtggtaacacagggcggcaaatgtgcgagcaaatggcctaaagtcccgctccgtcccgtggtcgggcctgtcagtttccactgtgttgggaccagtagatgccaatcgagtacatgtatgactcaatagggtaactacgcttcgtagcgatgtgggtgcctggggctccgtgtggtactcttggctggcgtgtgtttggagtaccttatcggcggtgagatcctgtgagtctggtctggtgacatacggaccgtcagctgtgcacaacttagtaagaccaaggattaattcctcacgtaacacctgactagcatcgcgcatctcggcaaacagatcagtagtggagttaaacacatatagtctgtctgggacataaaggtgaccactacgtcatcaggggacggtcgatcgcatgttctccaaacattcacaggaccgtgtgcttgcttgacccaaagatagactggacgacgatcaggatatgacgaaagacgctcacatgtgatgccatgacgacctgtcgctactagggagctaggactctcctccaggtaaatagaggcctcgttctttcattgggtcagtcccggcgaatgcttatcgaagtgttgcttgggattgttcatcggaaggggccggattggagcagtactaaggctggggcacggtgggggcggagcaggaccggggtccacgggtcgggggaaatgccattagttaagacgcttgtcggtagacaaaagttcggccaacagaatagccacattcgagaaacttctctatcgagtaccgaccgtgggcacattctcccagaggtcccacatatagagcgggccgcttggtattccctttcgcgagtgggggtgggcgccaccggattaaccccgacacctctatgggattctccccctgttatacgtcaagggggcttaaactttcaccaacgccttgtggcgctcttgagccaccatgggggtccataggactgtgttatcacacgtggtggta

SEQ ID NO: 666862 - DNA, 115 bp, Homo sapiens
agttcctgccggttttatataaggcctttcaaattaaaaccccaaaagatgaaagggaatgttcttgtttgacaacaaatgtaaagggtgtccccgggatactctccaggggcca

SEQ ID NO: 666863 - DNA, 111 bp, Homo sapiens
gagatcccttgtggacgattcgattgagtgtgtcgaggaatgggtgtgcgtttatgtcatgttcaaagcgtgtcacttttcatttttacgttgttagatatggggagtagt

SEQ ID NO: 666864 - DNA, 481 bp, Homo sapiens
attatgaggccaaagcaagaggatcacttgaaactcaggtgttcaagatcagcctgggtaatatattgaggacccctctgcccccagtctattaaaaaaaaaaaaagtaagaattgtcacccatgcctgtggtactacctactcggcaggctgaggcaagagtatcccttgagcccacggagcaccaaggctgccagtgagcaatgatcaccactgaatactagcctgcagccaccagcgggaagaccctgtaactaaggagaaaaaaggtcatgtcattggcacacctggctaattcgcattcttataaagttgacatgcccttaatttgttcctctagccaaaatagctctggccacgaacttctagtaatcatgtagaatcgaagtggtaacgctggccatcccttgtcatgtacaaagatctcagaggaaagacctttcaaataaaccctgtccagtatgatgtcggacgtgggtag

SEQ ID NO: 666865 - DNA, 1182 bp, Homo sapiens
  misc_feature (668)..(668): n is a, c, g, or t
  misc_feature (835)..(835): n is a, c, g, or t
tatgtcgctagtgtgttaccgtggtatctgtcggatcattccctcttggtgggcgccctcaagtgtgcataagagacattttgtgtatgtctgttgtgtctccagcatttttggggaccctgcaccggttcgggtatttctaaagccgttttgcggccctgcgcattggaagcgtcagattttaacccgagcaacccggggatcttggtttggaaagaagggaccggactcttgtaaactttaagaggttttctatggtcctcgcacccggtacacccgggcccctctgggttttaatttcagcagatagtccagagcgataaagaatttcttttttaaattggaggtattactgcttttgggagagagttatttttataaataaagggcataattgtccataagaagtattgtatgaaataattggatgttaaataaatgcttagccctaaatggttagaataaaggtaaatttagaggaatgtcaccgtgtcaccagatagattgtattaagacagccccattaatggaaccccttagaaaacaactaagtttataacctgtattctgaaggttacccaattaagacctctttaaaatgttttctcttgtaacttggtggttttttgaagggcttggcctatgagaaatgaaagccctcggaattnttgggccccaaggtttgtaaaattaaggttggtctccctgtgagctcaacaatatattccgaggaaaaatgagaaccttaaaagagatctcttgtggtcttgttgaaagaaagagaaattattcctccccatggtctcacaatcctggtatggtgaaaattagagcntccacagagaaggccattgttttttccctttttttatttttgtgatataaaataatattttcttaaataatattgtttattgtgcttctcttaacgccacaaaagtgtcttttaataaacaccattagttatattctctctgccgtgccttatttccattagtgaagaccatagttcaacctaaaatggccatcctgctctgaatctagactttttagaaatggccataatagtttttgatgatatagtccacaccattccaaaattgtccttaattaaattgttgtttaaaagtaatgtccactctttataaacctataaaataaaccagtaattaacccctctta

SEQ ID NO: 666866 - DNA, 531 bp, Homo sapiens
  misc_feature (64)..(64): n is a, c, g, or t
  misc_feature (217)..(217): n is a, c, g, or t
  misc_feature (267)..(268): n is a, c, g, or t
  misc_feature (413)..(413): n is a, c, g, or t
tttggtaaagggcacactgccttaggaggcgcccgtggaggagcagagactgatcacgtgtccnatatgtttgcttagagaggactttccctctttgcttttgagctaagctgctgaggcaagccagcaagaggaagatgttcccttgtttgccgggagcaggaatatcaggattctgtgcagctgaggcggccgtgatcacggagcagggactganccatgcgtccatatgtttgcttaaagggaactttcccggccgggcgcganngctcacgcctgtaagcccagcactttgggaggccaaggtgggcggatcatgaggtcaggagttccaggcccgcctggccaacagtgaaacccgtctctaccaaaaatacaaaaattagccgggcatggtggcgagcacctgtagncctggctacttgggaggctgaggcaaaagaatcgcttgaacccgggaggcggaggttgcagtgagctgaaattgcaccactgtactccagcctgggccacagagtgagactctgtctc

SEQ ID NO: 666867 - DNA, 768 bp, Homo sapiens
  misc_feature (380)..(380): n is a, c, g, or t
  misc_feature (402)..(402): n is a, c, g, or t
  misc_feature (451)..(451): n is a, c, g, or t
  misc_feature (676)..(676): n is a, c, g, or t
tggtaaacggggtctggctggttggccgcacgcgggtctggcacttctgggcctcaagcgattctccaacctcagcctcctaaaaggccaggatttataggcttgagccaccaagccgtgacccttcttcttgtgtgcttataattttccgtggtttccctccacatgtgaagcgaggcctccaagtgagaggagggaacgtgggtcagtttaggtgcccgtccagcgttctctcaggtgtgctcaattctcactcaaccaacaccagcgaggggcccaattttaaaattatagagaggctcagtgtggtataagtgacaagaaagtataaaatagcacaaaggagaagggtcctcacgaggtggcgatgaaagtggatntctctacaacgaagggagtgtnggtctcgtggatattctctccacagtataagcccgagggagagcccccntgtgtggctcgtggcgccagcgtggtgttgccgtgtgcagcgacagaagtcgcgtggtcgcgaaacacttcgagtgtggcaatgtagaagaatgtgtgcccgaattgtgggcactccctgtggggttgggcctttatcagaaacgagtgtggtggagtctctcaggaagcgtggtctctatgagggccacacccaataccgagggtgtggcgtgggggagggggncaaaaactacctcttatttctaaaggggtaacattagaacacccttgtgggaagcgtggcaaaatcctcgtgggcaacataattcaattgac

SEQ ID NO: 666868 - DNA, 224 bp, Homo sapiens
acgtcagcacctcctgcagctggtgaaggtgcccatttccctcagcattgaccgtctggagtttgaccttctgtatcctgccatcgaaggtcacctaagcacagagaggttaaccaacttgcccagaatcacacggaaagcaagcccagggaagaagcaaaaagcagaagagcaccaagaggaaataggtcctctaggaagggtgccctcagtgtccatcttca

SEQ ID NO: 666869 - DNA, 172 bp, Homo sapiens
tctctagcaggatcccctgtcagaaaaaagacgccttcctcacatattacttactcattcctttttagcagtgctccctaatacaattacatcactgctcactgacaatgcaccaggtcgccctaatagctgtgattgagatgtacagtttattagtgttttttctgcagca

SEQ ID NO: 666870 - DNA, 884 bp, Homo sapiens
gtctaagttggcagagatgtctgcctctaatgagaggccattgagaaggacattccctcggagcttctcgaggacctggctgtgacagtcgctgaagatgtatgcctggaggcggcacatcttgcagatggccaggcctgtgaggctggcgccactgccaagctctaggacagtcctggcgggaggaaaggggaccatgtctgtgactgcaccagggtgagcctgcctcggtgtcctgccgtgcgccccgaggtcacctatgagagaaggctgccgggttctcgatggcccattctgccaggtagagggcagcatctcatgtgaccaggcctgtgatgtcgtgggagatgatggctgtgctctcggagagtgtgactgagcctcccgagggctgcaccaagagagggcgagagagtcagtccagcaatcagaaggcaagtggcttagaagacaagtagccatccaccacatggctgaataaaccatgacaggaccaatcgccactcagcaatgagaagcagctaactgttgacatgccaacagcttgcacaggacctcaagggtgtcacgtggcatgaaagacactcatctcaggccacacaggattccattcatcgaacattcctgagacaacggaattctggcgatggagcacaggatgcttcacagtctacggcaaaggacagaacgttggttgctcgagagcccgtcttaagtctcctatgagcttcaagccaacacaacagagggcaaactccaggctacctgatccctcagcaaagatgcagatggacacagcgttctggccccacgcatctgaagttcgtcttaagatgtaagccgtttcctaaaaatgcttccactgcagtggcacaggcaaaaaa

SEQ ID NO: 666871 - DNA, 507 bp, Homo sapiens
ggaggcagagtgagggagagacgctggcctccccttcttcccaccctgcactgtctcccatgggtcacactcagctgcagccagttgcctggggaggcccctgccatgccggggtttgcaaagcaggcccagggcctgggaaggacgggggctccagcacgcaggtggctatgctgtccggctactgggcggacactgcccataactgacctttttgatgagttctgagagaaagcaccgggcatacttgactgacggcgggtgcttcacacacacacaggatgcttcacagtctacggcaaaggacagaacgttggttgctcgagagcccgtcttaagtctcctatgagcttcaagccaacacaacagagggcaaactccaggctacctgatccctcagcaaagatgcagatggacacagcgttctggccccacgcatctgaagttcgtcttaagatgtaagccgtttcctaaaaatgcttccactgcagtggcacaggcaaaaaa

SEQ ID NO: 666872 - DNA, 1336 bp, Homo sapiens
ggagagaactagtctcgagtaattgggggtgattttgggaaagtcatgtcaggggtagtaatataattggtggggacgattagtttaagcatgggagtaggttaaggtaatgtacgtagtcataggccatatgtgttggaaattgaaacctacgtagggctacggcccaccgcggggcttcgcagggcggcaaacgacctacgtatgggcaactacggcccaaaactgggctacaaagggacgtgggtgtagacgggtacatcgaaacgtacgccaaatacatgacaccaagcgacagaaataaacccttcaacggcatagaataggagaggaactagcgggtgtagacaagacaactcacaagcaattcgcaacaacaggagcaaagggacaaaaatggcaagtaccaacaaatatcaccaagacaccagaaggggccaaacaatgcccaaaaaagaccacaaaaccatacgaggaggagagaaaaagaaaacaccatcacaagacgaccgcatataacaaaaagaggaagaagaaaaagagggagagcaggggaaacaaccagacaagacgcaccagagagaaaaggagagaaaagaaaacaaaaagagagaaacaccaaaaagagcacacatacggaaaaaaaaaaaggacagaaaccatggagcagaacacaaccgcgccaaagcagaaatatacacaacccgtaaaaacacaatcacaacaacaaacgggagcaacaggaacagagagcatagcgcacaagaaaaataagtagcccgaaagagaaccagcaaacagcacaacgactgcaccacaggaaaacaacacataaaacccatgagagacaagaaacctcgcaacagacacaggcccaagaagggcaaccaaaaccccaggcagcaaagacgaacaaacaaaaaggcaaacagagggacatacaccaaagagcaccaaacaggagcgagcaacccgaaaacacatggagcgaaaacacaactacccaagtatacaagcaaacaacgaaaaacacacagaaagaaaacaaaggacacacgacaacagatcacagcagacgggacagacagccgcacaacaagagcaacccaggaaacacaacaggaggacactgacgcacgaaacagaaagacagacaaccgacagaaaaaagaaacaagacagagtaagaagaacacaaacacagaagaacgtggggaaagccaaaaagaacaaggagaaccaacctcaagatggacagaccccaacaagcgagaggccaaccaaacaatagcacaaacatcgagcgaacgaaacaccacaccgctgacaccactcg

SEQ ID NO: 666873 - DNA, 1314 bp, Homo sapiens
  misc_feature (758)..(759): n is a, c, g, or t
  misc_feature (773)..(773): n is a, c, g, or t
gtctaagttggcagagatgtctgcctctaatgagaggccattgagaaggacattccctcggagcttctcgaggacctggctgtgacagtcgctgaagatgtatgcctggaggcggcacatcttgcagatggccaggcctgtgaggctggcgccactgccaagctctaggacagtcctggcgggaggaaaggggaccatgtctgtgactgcaccagggtgagcctgcctcggtgtcctgccgtgcgccccgaggtcacctatgagagaaggctgccgggttctcgatggcccattctgccaggtagagggcagcatctcatgtgaccaggcctgtgatgtcgtgggagatgatggctgtgctctcggagagtgtgactgagcctcccgagggctgcaccaagagagggcgagagagtcagtccagcaatcagaaggcaagtggcttagaagacaagtagccatccaccacatggctgaataaaccatgacaggaccaatcgccactcagcaatgagaagcagctaactgttgacatgccaacagcttgcacaggacctcaagggtgtcacgtggcatgaaagacactcatctcaggccacacaggattccattcatcgaacattcctgagacaacggaattctggcgatggagcacaggtcagtggtggccaggggccgggtgtggctatgaaggggtggctgccttgtgatgattcaatatgctatgtttttcctttgtggttttctgtatctatgtnntatcttattttttntgagctctgtcacccaggctgaattcagtggcacgatcttggctcactgcaagcctccgtctcctgggttcaagcgattctcctgcctcagctgcccaagtagctgcgattacaggcatgcgtggcatgtccggctaagttttggtattttctctgaagagacaaggagttagccgcacttgtttgggcccaaggcggggggctgtagtatcgcccgaagtcttcgggggccccgtataagagatcgccaaacctctggtgtgttccccagaagattctgcggtgtctcgatgcttccctgagttagctgggataaccggttggcccatttgggcaggaacgcggtgcgacctttgggagttgactcatgcagacgatgctagtggacgccagattgtgggcgcacggttggttcgcgaaaatctgtggatgtcagcgtggagctaaccgagattctggactcttcgggaagatactttcaccgaggatgcagtatgtgatggagatatcaacgggctcagtctctcggaataccagaatc

SEQ ID NO: 666874 - DNA, 881 bp, Homo sapiens
  misc_feature (758)..(759): n is a, c, g, or t
  misc_feature (773)..(773): n is a, c, g, or t
gtctaagttggcagagatgtctgcctctaatgagaggccattgagaaggacattccctcggagcttctcgaggacctggctgtgacagtcgctgaagatgtatgcctggaggcggcacatcttgcagatggccaggcctgtgaggctggcgccactgccaagctctaggacagtcctggcgggaggaaaggggaccatgtctgtgactgcaccagggtgagcctgcctcggtgtcctgccgtgcgccccgaggtcacctatgagagaaggctgccgggttctcgatggcccattctgccaggtagagggcagcatctcatgtgaccaggcctgtgatgtcgtgggagatgatggctgtgctctcggagagtgtgactgagcctcccgagggctgcaccaagagagggcgagagagtcagtccagcaatcagaaggcaagtggcttagaagacaagtagccatccaccacatggctgaataaaccatgacaggaccaatcgccactcagcaatgagaagcagctaactgttgacatgccaacagcttgcacaggacctcaagggtgtcacgtggcatgaaagacactcatctcaggccacacaggattccattcatcgaacattcctgagacaacggaattctggcgatggagcacaggtcagtggtggccaggggccgggtgtggctatgaaggggtggctgccttgtgatgattcaatatgctatgtttttcctttgtggttttctgtatctatgtnntatcttattttttntgagctctgttccccaagactgtgccatggtaatccagcctgggcaacacagtgagactcttgtctcaaaaaaataaataagtaaaaaataaaatccatcctgtatca

SEQ ID NO: 666875 - DNA, 1788 bp, Homo sapiens
  misc_feature (1232)..(1233): n is a, c, g, or t
  misc_feature (1247)..(1247): n is a, c, g, or t
gtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtatggtatggtatgatggtatggtatggtatggtatggtagagggcagcatctcatgtgaccaggcctgtgatgtcgtgggagatgatggctgtgctctcggagagtgtgactgagcctcccgagggctgcaccaagagagggcgagagagtcagtccagcaatcagaaggcaagtggcttagaagacaagtagccatccaccacatggctgaataaaccatgacaggaccaatcgccactcagcaatgagaagcagctaactgttgacatgccaacagcttgcacaggacctcaagggtgtcacgtggcatgaaagacactcatctcaggccacacaggattccattcatcgaacattcctgagacaacggaattctggcgatggagcacaggtcagtggtggccaggggccgggtgtggctatgaaggggtggctgccttgtgatgattcaatatgctatgtttttcctttgtggttttctgtatctatgtnntatcttattttttntgagctctgtcacccaggctgaattcagtggcacgatcttggctcactgcaagcctccgtctcctgggttcaagcgattctcctgcctcagctgcccaagtagctgcgattacaggcatgcgtggcatgtccggctaagttttggtattttctctgaagagacaaggagttagccgcacttgtttgggcccaaggcggggggctgtagtatcgcccgaagtcttcgggggccccgtataagagatcgccaaacctctggtgtgttccccagaagattctgcggtgtctcgatgcttccctgagttagctgggataaccggttggcccatttgggcaggaacgcggtgcgacctttgggagttgactcatgcagacgatgctagtggacgccagattgtgggcgcacggttggttcgcgaaaatctgtggatgtcagcgtggagctaaccgagattctggactcttcgggaagatactttcaccgaggatgcagtatgtgatggagatatcaacgggctcagtctctcggaataccagaatc

SEQ ID NO: 666876 - DNA, 172 bp, Homo sapiens
acatgatacaatcgagcttggtaccccccgactagcccgacagtcagctttggtgatgagaggcacgatgttgaccttctcatgcaatggccttcatgaaacccacatccactggccgcagcccatgccctgaagggggagatgaagtataggcagcagtgcactcgtgttg

SEQ ID NO: 666877 - DNA, 140 bp, Homo sapiens
gcaggctaataggttgaatgagtaggctgatggtttcgataataactagtatggggataaggggtgtaggtgtgctttttttcatttaatttatataatattattatatttaaatgaaatgattttataatatatatata

SEQ ID NO: 666878 - DNA, 1000 bp, Homo sapiens
gtctaagttggcagagatgtctgcctctaatgagaggccattgagaaggacattccctcggagcttctcgaggacctggctgtgacagtcgctgaagatgtatgcctggaggcggcacatcttgcagatggccaggcctgtgaggctggcgccactgccaagctctaggacagtcctggcgggaggaaaggggaccatgtctgtgactgcaccagggtgagcctgcctcggtgtcctgccgtgcgccccgaggtcacctatgagagaaggctgccgggttctcgatggcccattctgccaggtagagggcagcatctcatgtgaccaggcctgtgatgtcgtgggagatgatggctgtgctctcggagagtgtgactgagcctcccgagggctgcaccaagagagggcgagagagtcagtccagcaatcagaaggcaagtggcttagaagacaagtagccatccaccacatggctgaataaaccatgacaggaccaatcgccactcagcaatgagaagcagctaactgttgacatgccaacagcttgcacaggacctcaagggtgtcacgtggcatgaaagacactcatctcaggccacacaggattccattcatcgaacattcctgagacaacggaattctggcgatggagcacaggtataatacgtaagtttggaggtggatgtttcagccattaagttcaaaagtactgccacaagggccaggcatggtggctcacacctgtaatcccaaccctttgggaggtcaaagcaagcagatcacgagatcaggaaactgggaccatcctggccaacatggtgaaatcccatctgtactaaaagtacaaaaattggctgagtgtggtagtgtgtgcctgtggtcccagctacttgggaggctgaggcaggaggattgcttgagcccgggaggcggaggttgcagtgagtcgagattggccattgcagcgcagcctggttacaggagtgagtccgtctcccag

SEQ ID NO: 666879 - DNA, 979 bp, Homo sapiens
  misc_feature (674)..(674): n is a, c, g, or t
gcgctaattaccccgctgggacgtttctcagcgactcattatgataagcttttttttatgtgggttggttcgtctggcggcacctcttttgtgcttgtcaagaaaatgatagacagctgcgtctgttcagcaaaatggtgtttcccaaggagctggcgacggagggaattattttattatacttgcgcggcgaagaatagttccaattgaggtgatcaggattaagggggtgtgatagccaccagcgggtggtgcctccccccgtacataaattgattttctgttagcatcttgttgggtactcttacacacgcgtctggcccttcgtacgacacctcttcgttgtgacacgccggtttgtttgtctttaaaaaagcacgccgggtggttgtttggccccccccaaaaagaagtattattggtttttaattaaaacgaacgcgcctgttctctaggccattttgaaacccttgggaataggtggataactgtccttcagtaatagtgagggtacacccgcgtggttactctcttacatagtgtattctctatttaaggaaatatcccacggggtgtatccagcctctctattgtggcccacacgcaggtgtctaatttttccatcggatcgcagtgtgctattagggggcaccctctccactggagcctctccncgtgatgatacctgataatatctctgggggcacacatattgacagcctgccttatttctacgttttcctcgaggataatatccgggagcatataaatgtctaactttcgcccccttgtcgcctacgaccaataggtgttaataattgatatatcattttgttaacaaaatgtggggtgttctctccaacagttgtcgcaggctcccccggcgccactcctcaacacaatcctgggacacaaatgcggcgccccgtccccggccccgggttttcctttttaagtaaaatctcgccacatcataaca

SEQ ID NO: 666880 - DNA, 100 bp, Homo sapiens
tccttctggccacgccttgaaacaatccgggggagagggtgtaaatctcgcgccggaccacgggaatccgactgtttaattaaaacaaagcatcgcgaag

SEQ ID NO: 666881 - DNA, 340 bp, Homo sapiens
  misc_feature (307)..(307): n is a, c, g, or t
  misc_feature (317)..(317): n is a, c, g, or t
  misc_feature (335)..(335): n is a, c, g, or t
caacatcgaaagaaaacacttgtctgggtcagatctcatcaattagacaatttccaacagagaacacatctctagataactacatgtctgtcatataagggatatgtggacttccggctatgtgcttacagtaaattatctcaagaaaactaggcagcaggtagaaaaagagcaatgcaatcccacttttttaatgctcttgcctatagtctttgatgggactggaacttcatttggatgaccatttctattcttgcctggcatttgggggaatgtttaaatcctattctcatagggggtgtgtatnggggtaggcntggactaaggggtagggntaaag

SEQ ID NO: 666882 - DNA, 175 bp, Homo sapiens
gggccgtctttagctgtactaataatgacgtacttatagccaactactgccccctaatgtgactgaagggattcataatgatcacaattagcattacgagttaagtattttatgcggttgacgtctaagctcacacttgtaaaggtattatatctaattggccactgggctcacc

SEQ ID NO: 666883 - DNA, 237 bp, Homo sapiens
tcatggggaaggacagaagggctccctcagcctgtatataaggtgctaacccattcatgatctccacccccatgaactaaccacctcccacaggccccacatctttattatttttttttttgaaatggagtctcgctctgtcacccaggctggagtgcagtggcacgatctcggctcactgaaatctccacctactgggttcaagctattctcctgtctcatcctccatggtgctga

SEQ ID NO: 666884 - DNA, 1634 bp, Homo sapiens
atgatttagttattaatatctgttgttgggttgttttgacatatacgtttttggttaggtgctgtttgatttatatttctgtttttgataagataatttctctgtgtttatgagatagcatgggtgttattcttaatttgtgtttatttaactgttgtataattatcttccgttttattgattatatttgtatttgtatattaaattttttggtatctatctgatatattatattgtttatgttttatttatgtatattatttttggagaatgtataattagaagaatagggttttgaggtgattattatatagggttgttattttttattgttttatttgtgtgttaatatattttgtttgttattctcattgtttatatgtgtggttgatagtgttgatgagatttattgttaggggatgatgatcgctcagtagttcattgttttgtacttaatttttgtgtgggttgtacatgttccttgtttcatttttatttatgatttgtaattccatgtttttatatctgggtttaagcccattttgtatgggtgtcatcgtaattctctaatagggtattgtatatgtgtgtatgtctgctttatgttagtttgtattgtgtctcgcgttttgttgtataccccttaagttgaaacgtagttgtgtaaatttatttgtggttttattttttttggttatattttctataaattgctcctatcatatctccatttatgggttaatatggcaaattatggttgtaacttagccatgtttatcttctgttggtgtaccccgctttaatatttgtaagtggcgtaatacactgccagggttgttaggtgcgtggcaacactgttagtatatgctcgctacatctacgtacatttcggtcgcccttgcatacactaatgtgatattggctagttttgtcgcctttgagtgtctccaccaagccatttgctgagagacctgtaccctcctctgctttagagtgcagtgagtagtgcgtgagtgttttgttaggtgagtccatgtactttcgcttgcgtagcgccagattggagtcctgtgtggttattcatatacgtctatactacacaagtaggactcccatgatgagggccagactagttttaatcttttgtatgtcgttcacttcgctctacttggattattcgtataggatatcatcgtgttgtcgtgattatatggtacttgacaagcactacgctattagtgtaacgaggaatagttagtgtgtgactacagtacttcttctctatctatgttaggtttcttctagaaggtgcgtactggcactctcagctctctgtatatctgctctcttatccgttgcatactgtgctggtgacacaccactgccctattttctgtctttttattacatccataggtcgctctacggtgtgactgtctacaactgttatgttttcctagctaccactagaagtacgatatttgattattatatttgtatttcaccacctacaatgtaatgttgattcctcaagtatgaaatgtaggcactacattgaaatatgtatttcgctataaattgtgtctatagttgtacagcattttagcatggtatacttcccggagctatatgat

SEQ ID NO: 666885 - DNA, 350 bp, Homo sapiens
  misc_feature (43)..(43): n is a, c, g, or t
taattagaggatccgggaaggcttcttactcttgaggcaggtnagccctatggtacgtcgttcccctaggggctagtgtgggaccgcacagtctaagctaatttccagttagctatttaagaagagagcaggggtatgagccagagtggcggggtgagtagttgggcgggaaggatggttaggaacaggtaactaaaggtgacttaggtcaaagcaggtgaccaggggttggtgaggtcaaagcacatgaccaggatgagtcaggatggagcaggtgaccaggggaacagatgtgacctacggattaaacgtgatggaacgggttgttcactgaaaccatgaggaagtta

SEQ ID NO: 666886 - DNA, 590 bp, Homo sapiens
  misc_feature (5)..(5): n is a, c, g, or t
gaaancgccgtacgtgttgttctatcagcgtcgggatgacgaatgctccagcacatcttcgctcggcagtttccccggttctgatggaggggtgaagctgagcagctcacaccagggcatgggggatgaggaggcttacaacatggacaccaactgatgtggcctctgtgaccctgccaccctcccaacaccagcatcctcccccaggagaatatctgtggcactcttgaagactgctcatatcaatctcaaaccagatgaggacattacctccttttatgagaagaggaaggaaagagaaaccctgctttctgagaagggctctatgttaagaggctggattattttttcttttaaacgggtggtgagagaaaaacctgtggagctcaattgtgggctggggtttggtgcacagtggcatgtgtctcatggattccaaagagtggagaggaagaccctgcaatgagcatggtgcagccatgaagacccacctgcagggctgctccgaactgggttttggattctggtgcccacactgctcaccccagtagtctggccacagtaaaccaagcctccagcaaaaaaaaaaa

SEQ ID NO: 666887 - DNA, 343 bp, Homo sapiens
taccgtactcttagaagctgtatcagacccatgatttgcaccaggctttctcccattctatagactgcttttcactttcttttttttttttggagagggggtttggctctggtggcccaagcgggggggcaagggggggatctgggttaacaaaaacctcggcctccaagattaaggcgattctccggcctaaacctccaaggtggcggggataacgggggggggccaccacccccagctaatttggtttttttggcagagacggggtttctccatgttggccaggcgggttcaaaactccggacctaaggggacccacccacctggccctccaaaggggcgg

SEQ ID NO: 666888 - DNA, 176 bp, Homo sapiens
  misc_feature (140)..(140): n is a, c, g, or t
tgaccgcacggagggccgggctggttgacttctggattctggccgcacagagctgggcgctgagggactggcactgactgcttttagctcaaacgtggcttttagacagatttgttcatagcacccttctcaagctgccnctctccgcagctggctaggcacttccatgcttcctc

SEQ ID NO: 666889 - DNA, 1212 bp, Homo sapiens
  misc_feature (134)..(134): n is a, c, g, or t
  misc_feature (425)..(425): n is a, c, g, or t
gttgatcctgatcattgcatacaatactagagaatatcatggttatgccttgtagactccttccacatgttcatatcttcttataggtaaatagattgaaagtccttttgtctatctacgaatggaagtatatngtgacgtaatgagagcgaaaaataacgctgagtggaaccgcaagttaatttgtagtactccaagggcatagaattgcatctcatatccacgtgatcagttgtcgtgatagactatttgtgtaggcttctcctgcaatttagtgttgtaatgccttgtgtaagaagtacgttagagagagtatgcataattctatctccctagtaactgatactccaacttgttgttgcatatatcatagattttaaattcccggaatgggacaattaactcactacgcatgtacacctatngaaagattgatgcttgaagctactagttttcatgatttgctacaccactgatggaagtagtatacctgtgtaagtaaattgtgttcctataaaagtctgtgtattatatggaattcaagtctataatccatctatggtgaagttcgcatgttggacgtgtagccgagttatacatagtggaatatggctttatactcctattttcctaaataaccctctgttttacggacaattgtcggttaacgcgagattaaccccaagggatgtaaatttaattgggagtatactgatgtccatgtgctggtaaagcgtttcactggacactgcgcagctgccctcgaaacgggagataattcatctttaatgagtataggttactcggtagcatgcgaacaactttgttggaccaataggactgtgtgtagactctatcacgtattacgaataatttcactatgccttcaattttttcatccgtaagttgcctttcatcccggtatccacgcgccgtaagtaatttctaatttaccgatataacacccttttccataggtcatttccaatggttactctcccatgcgccggttcgttatggatcatccttttctaacctacccacttatgtaactggtcctgcacaatggctgtgctcccccggttcaaaagtgccttggacgaaaactacatggacatggtcactgcttttaatcaaacggctgaaccgaggtcctggaccatgtatcgccaaagatggcatgaagtacgcatttggaacaagcaggagaac

SEQ ID NO: 666890 - DNA, 928 bp, Homo sapiens
ccacgcgtcggtcgtgcgccgctgtaggaggagccgctgccgccgtcgccgtcgccgccaccgccgccaccgctaccgaggccgagcggagccgttagcgccgcgccgccgccgcctcccgcccgccccggatagcccgggcctcgcccgtcgcatccatatttttgaaaatctgtctatggttatgagttacctggcaatgaacggctgacctcgcgagaacgaatttgatcgtcaactacctccctcagaagcatgacccaggatgagttaccaagcctgttcagcagcattcggtgaacgttgaatctgcacaacttattcgggataaagtagcaggacacagttgggctatggctttgtgaactacgtgaccgccgaaggatgcagagagagcgatcaacacgctgaacggcttgaagatccagtcaaaaaccattaaggtgtcgtatgctcgcccgagactcagaggtgatcaaagacgccaacttgtacatcagcgggctcccgcggaccatgacccagaaggacgtagaagacatgtgctcacgcgttgggcggatcatacaactcgcggcgtcctcgttggatcacgactacaggtagtccagagggaagcgtagaaatacgggtgtgacaaaaccggtacggaaggcagaagaggcacctaccaggttccaatggttaataaaacacccagggttattcttgaaccccacaacagttttacgatagtaagcaacccaaacagtacaaaaaagggactcatcacgcacatgtacaactgcgaaacaccacgggttgaggccgttcaaaacaggtcgaatttggttcgccactgatcaccacaagcgaccggtgagctccacaaccagctcatcgcctgcatacactccgagaatatgatacacactcgaagcgccactaa

SEQ ID NO: 666891 - DNA, 266 bp, Homo sapiens
gaacctaatatctgaacatcagagaagctatctagcctagagatctagaagagtgccaagaatgagatgcacaagtatagattgtatttgagagatcactgagagaattgcatgtaacatatgcagtgatctctaccttatcattgtaggggtaggattaggaatttgagaaaacaactaaaaggtttggaattaattctccttgggatgggatagggagccacttgcaaatgagtaaaatgaatgctatacagcggtaaaagctt

SEQ ID NO: 666892 - DNA, 446 bp, Homo sapiens
tttaatagcttaaaatatgaattaacacccatgttgcatgcattccacatcatacactcggttctatatgctttgcaaatgcgtatcatgcgttcaatgcaatgacggcgacgctatcgtagtttagatcttatagatagcaggcttagatccgatcacttgtgtgcaggcttcatgaccctacggctcaggacctcatccgagcttagcctagccaacgtgcaacgctagtatatcctacatctcagcatctggaggttaatggtcctcggcgcacggcaagctccagtggccgtcggaggtaaggacgcgggcggaggggggtataaaatgtgctagctctgggcgctcagagcgggtgtaagagacactaaacattaaacagttaagtccggtgcacggcggttcgggtctcgagcgcgcctcttgtcccttctgacccatca

SEQ ID NO: 666893 - DNA, 128 bp, Homo sapiens
gggggggatgtcaacatgttactctaaaatatagctaaaaaaagattttgacataagaagagccttgcattttaaaacaaaaagagagagagatgtaatttaaaaagtttattataaattaaattcag

SEQ ID NO: 666894 - DNA, 343 bp, Homo sapiens
  misc_feature (27)..(27): n is a, c, g, or t
  misc_feature (36)..(36): n is a, c, g, or t
  misc_feature (39)..(39): n is a, c, g, or t
  misc_feature (64)..(64): n is a, c, g, or t
  misc_feature (75)..(75): n is a, c, g, or t
  misc_feature (77)..(77): n is a, c, g, or t
  misc_feature (139)..(139): n is a, c, g, or t
  misc_feature (143)..(143): n is a, c, g, or t
  misc_feature (247)..(247): n is a, c, g, or t
  misc_feature (326)..(326): n is a, c, g, or t
ctcctgggactcacctgtgtcctgtgnagcaggagntcnagcatcacctgggagcttgtgaganatgcagcctgngnctctccccagacccgctgcctgggaatctgcattggaacaagatcccctagtgactcctatncgtncttaagttggagaggcactgaattcttgttaatgcctcagctaaataaaggcttgaggagtgagaacttgaaggaggcagcatgaagctgcggaaagtggtgtnggcatctgatagaactgaaatcacatcttgccttttcccctcatcccctgcaagtacttgctgtgtgatcaattactcnacctctctgaacttcat

SEQ ID NO: 666895 - DNA, 1255 bp, Homo sapiens
gggggagagaaaccatatgaatgtaaagattgtgggaaatccttcactgtttcttcaagcctgactgagcacgcgagaatccataccggagagaaaccctacgaatgtaagcagtgtggcaaagccttcacagggcgctcaggcctcactaaacacatgcggacacacaccggggagaagccctatgaatgtaaggactgtgggaaagcctacaatagggtttatctactgaatgagcatgtgaaaactcacacagaggagaagccctttatatgtacggtatgcaggaaatccttcagaaattcctcgtgcctgaataaacacattcagattcacactggaataaaaccttatgaatgtaaggactgtgggaaaacattcactgtttcttcgagcctaaccgagcacatacgaactcacactggagagaaaccttatgaatgtaaagtatgcggaaaggccttcaccacatcctcacaccttatcgtgcacataagaacccacaccggtgagaaaccctacatatgtaaggagtgtgggaaagcctttgcttcctcctcacaccttatcgaacacagaaggactcacacaggagagaaaccttacatatgtaacgagtgtgggaaagccttccgtgcctcctctcacctgcataaacatggaagaattcacactgggcagaaaccctataaatgtaaggaatgtgggaaagcatacaataggttttatctactaaaagaacatttaaaaacttacactgaagagcaggtttttgtatgtaaggactgtggaaaatcttttaagaattcctcatgccttaaccatcacactcaaattcacactgatgagaaacctttctaatgtaaagaatgtggggaagctgtcagctacactcattcacgttgaagacatgaaagacctctcgttctccagatgtccatgacttgaggaatgtggctaggcaatcagcatctcatcacaacccggcaggcaggaactcaccctggagccctatgcagcagacacagagaaagccctcagtgttctctaaggtcttgctgaatatggatggtatccagtagagagaactctattgatgtgtgatatgcgagcagcattgttgctgttctgctcagtactttgatgatcccttgtgatctcacaatgaagaaaaaccttaggagggtgagaattgttgggaagtcattttttacattacatctttcctcaccctttagtaaacgtggtgattgac

SEQ ID NO: 666896 - DNA, 756 bp, Homo sapiens
gggggagagaaaccatatgaatgtaaagattgtgggaaatccttcactgtttcttcaagcctgactgagcacgcgagaatccataccggagagaaaccctacgaatgtaagcagtgtggcaaagccttcacagggcgctcaggcctcactaaacacatgcggacacacaccggggagaagccctatgaatgtaaggactgtgggaaagcctacaatagggtttatctactgaatgagcatgtgaaaactcacacagaggagaagccctttatatgtacggtatgcaggaaatccttcagaaattcctcgtgcctgaataaacacattcagattcacactggaataaaaccttatgaatgtaaggactgtgggaaaacattcactgtttcttcgagcctaaccgagcacatacgaactcacactggagagaaaccttatgaatgtaaagtatgcggaaaggccttcaccacatcctcacaccttatcgtgcacataagaacccacaccggtgagaaaccctacatatgtaaggagtgtgggaaagcctttgcttcctcctcacaccttatcgaacacagaaggactcacacaggagagaaaccttacatatgtaacgagtgtgggaaagccttccgtgcctcctctcacctgcataaacatggaagaattcacactgggcagaaaccctataaatgtaaggaatgtgggaaagcatacaataggttttatctactaaaagaacatttaaaaacttac

SEQ ID NO: 666897 - DNA, 669 bp, Homo sapiens
tttgcgtctaatcattatgaaagggacttttttattccatgccagaaaaccttgttcacaattggagagcagttttccgtgttgggtcagtgtggaaaagccttcagctctactccaaatgttgtttcccagcaagcatgcactcgggacagatctcttgactacagcagactgaagagcaggtttttgtatgtaaggactgtggaaaatcttttaagaattcctcatgccttaaccatcacactcaaattcacactgatgagaaacctttctaatgtaaagaatgtggggaagctgtcagctacactcattcacgttgaagacatgaaagacctctcgttctccagatgtccatgacttgaggaatgtggctaggcaatcagcatctcatcacaacccggcaggcaggaactcaccctggagccctatgcagcagacacagagaaagccctcagtgttctctaaggtcttgctgaatatggatggtatccagtagagagaactctattgatgtgtgatatgcgagcagcattgttgctgttctgctcagtactttgatgatcccttgtgatctcacaatgaagaaaaaccttaggagggtgagaattgttgggaagtcattttttacattacatctttcctcaccctttagtaaacgtggtgattgac

SEQ ID NO: 666898 - DNA, 148 bp, Homo sapiens
  misc_feature (20)..(20): n is a, c, g, or t
  misc_feature (37)..(37): n is a, c, g, or t
  misc_feature (73)..(73): n is a, c, g, or t
  misc_feature (133)..(133): n is a, c, g, or t
aaaagacaaataattgtagnagggaaggcaaagcagnattcttgggtgggtgacattgggtgatactgttagnagggacccctacacatcttttgtgaaggttgctaccctctgaaatgattgcccgataatnctttgttacgatgcc

SEQ ID NO: 666899 - DNA, 252 bp, Homo sapiens
cgtataatctcctcccccaacattttttaaaggaaaatggattatgcccaaagattaaatgccacttaagtgtcaaaaaaaaaaaaaaaaaacccgatttactggggtaaaatcaaaagaaaggatatccaaaacagggggagaagagatctgcaattcgataacctcaagctcgggataattctgtgtatttcctaaaaaaaaattaataagatttacataaccataaagaaaccaattactatttgtaaa

SEQ ID NO: 666900 - DNA, 102 bp, Homo sapiens
ggtgtggggcgctgcacaggtagggctgcatgtgcctatgcttgtgccagtggcacagtgagctagagcttgtgattgcaacctgatggatcctggtgctgc

SEQ ID NO: 666901 - DNA, 332 bp, Homo sapiens
catgtgtgccatgtgcagagagagttaattctacttttgagagttggaggaatcccaggtgcagaaaggcagacatcacatgttctcactatatttgcgggatctcgtattagtccattttcatactgctatgaagaaatacccgagactgggtaatttataaagaaaaagaggtttaagggactgacagtttcacatggctgtggaggcctcacagtcacgatggaagatgaaggaggagcaaagacatgtcttacatggcagcaggcaagagagtgcatgcagaggaaccaccctttataaaaccatcaaatctcgtgagacttattcac

SEQ ID NO: 666902 - DNA, 280 bp, Homo sapiens
  misc_feature (168)..(168): n is a, c, g, or t
tgctgtatattacgctgttatgatgatagcagccatgatgccttgggaaaaagcctgtctttaggctcagaaaagtcagggagacacatgtagccagcagaaagctaacacagattgggcagatttgcccgaatggaagtctaacacttaaataagcattctcttggnccacgtgagaaactaccgttgtcgtgggtattaccctacaattaccatttgtattacatattaaattaaactcagcattaaatatgcttgtataattacgctgttactagat

SEQ ID NO: 666903 - DNA, 374 bp, Homo sapiens
taagaaaggagcgctccaggtagctcgtcccatgcttcgcggctctgctgcaatacaggcttcaggccacggccatgggaggcatagtccagaccctcctctcccccttctcgggctcctgaggcccggaggctggaggagggaggctcagggacccggaaaagactggatgccatggctgagggaactttggttctgtggacaggcggtggaatacgtgtccctccaaagttcacgtgttggaaatttaatcgcaatgcaacagtgacaagaggtgagacttttaagaggttattaggccatgaagactctgccctcatgaatggattaataccattatctggagagtgatttcattgtcaccagtagtgggt

SEQ ID NO: 666904 - DNA, 279 bp, Homo sapiens
agcgggcggtcgcgggcctctcccggagaagatggcggatcgcgcggagatgttttctctctccaccttccacacaactatacgagcagggctgaggcctccccaggacataagcctggaagaatttgacgaccgaacgatactgatctgacgatcacagactgactgtggcctgggcctcagctacgactacagagccactgatgagaaggacaagacactcactgggggcgctcggagccagaccggagaccgccaactgagaccagcccaggatga

SEQ ID NO: 666905 - DNA, 724 bp, Homo sapiens
atagcagagatcttagagatctcaggagctgggctccaatttgccagccatttccttctctctctgagtctccattcactaacatgtgggattgatggagactgataaggcccttagccaggccacctagttcttctagatatttagctgatgcctcaaatgaaaaccctttgtgctctctttctccttggaaccttagcaaattgcatgcaatcagtgattagtttgtcggttgccacgttctgtaacctcatgcacagagcacctgaaggcaattgccagagcacttgtcgtgcctctttcgccagtgtaatcatctatgcaaggatccaatatgatacttgtgtttcactgtgttcctgtgcgaaggctcagatttctgcataggtctattacgttcacacggaattaaaaaggctaaagtgacttgtttgtaggaaaggggaatttcataaggcagaacagaatgctatctaataaattggccttgtatttttactacatacgagtgctaaatattagtacagaagagtgtcgttggctctgcaagattaagtatcaggctaattcctatgttttggattcttggattttgtaaataatctgcatttacatttgaatattcaagcgatttatatttacctggttgaggggttccaaatggtggataaatcccaaaatcctaaatttttccaatgagaatttgcttaaggggtgtcacggt

SEQ ID NO: 666906 - DNA, 521 bp, Homo sapiens
  misc_feature (42)..(42): n is a, c, g, or t
  misc_feature (106)..(106): n is a, c, g, or t
  misc_feature (154)..(154): n is a, c, g, or t
ccaaattcatgcacccggtcactaaggcatctgcagtcatcnactaaccactgatctccacctggagaaggctgtatggagactacaccactgcacccacctagtnccagaacaactgcactctgcccaaccgatgccctccagcctgtcgtcnaggtgaaagtttttccctatgaaagtcattctctgaagtttggaagaggagactgtacccagaagatgcgcaagcattaatgtgggaataccagaaacatgaaaatgcaagggaacatgatgccaccaagggaacatgagaatttcccagtatctgacccccaaatttacagaaatttatgaagttattgaaaaggaatttaaattaatgatcttaagaaaaccaagagagacaaaatagtatacaaatagaaaattcaatgaaatcagcaaagtaattcatgatctcaatgacaaattcaacaaagaaatatatatcataaaaaagaatcagaaatcttgaagccaaagatttcaatcaattaagc

SEQ ID NO: 666907 - DNA, 420 bp, Homo sapiens
ggagcttatgtctctggaaaagggggcgggcacagcatatcccacctgtaatcctagcattttgggaggctgaggcaggtggatcacctgaggtcaggagttcgagaccaccctggccaacatggtaaacccatctctacaaaaattagctggacatggtagtgagtgcctgtaattccagctactctgaaggctgaggtgagagaatcccttgggcccaggaggtcgaggctgcagtgagcgatagtcatgccactgcactccagccttggtgatagagcaagaccctgtctcaaaaaaaaaaaaaaaaaaaaattttaattcagagtttttattccccttgttaaaaacctttaagacccccaattgggccttccaatatgattcgcaaacacccttttcgggggacacggaggccca

SEQ ID NO: 666908 - DNA, 253 bp, Homo sapiens
ttcggccaaagggtcgcaggggtaagcaacaactgctcaaaatttttttttcttttgagacagttttgctcttgtcacctaggctggagtgcagtggcgtgatctcggctcactgcaacctccacctcctgggttcaagcgattctcctgcctcagcctcccaagtagctgggattacaggcatctgccaccacacacagctaatttttgtagttttagtagagatgcggtttcaccatgggtaccgagctcg

SEQ ID NO: 666909 - DNA, 173 bp, Homo sapiens
tacaaaagtttttttttaaatgtacaaaaggttcaagacaaccttttatttcagtttttcgtgggaaaaaatttttttgcagggaattaaggggtttaaattccgtttaaataaagggttaccatttttttaggcccaaggaacagtttttttttttccaaattttttaattt

SEQ ID NO: 666910 - DNA, 327 bp, Homo sapiens
  misc_feature (119)..(119): n is a, c, g, or t
  misc_feature (170)..(170): n is a, c, g, or t
  misc_feature (231)..(231): n is a, c, g, or t
  misc_feature (265)..(265): n is a, c, g, or t
gtcattttctacacattgctggcctggttctccttggagctgtggtcactggagctgtggtcgctgccgtaatgtggaggaggaagagctcagatagaaaaggagggagttacactcanggctgcaagccagtgacatgtgcccgaggtctctgagtgtgtctctcacangcttgtaaaggtgtgagacagcgtgccttggtgtgggcactgagaggcaacgagttgttcncgtgcccttccctttggtgacttgaagaaccctngactttgtttcgtgcaaagggcaccgtgcattgttgtctgtgttcggtgtagcaaattgaaa

SEQ ID NO: 666911 - DNA, 185 bp, Homo sapiens
atcaacgcacaactaggtggttgaatcaattaaaaggtgtgtggttggatcaatcaatcagtgggcatgcatagatggacctacagtggttagtggcatggaccaggcaggcatggcatggcatgtgcagcagcccccagcaaggaccatacaggcaacagcatggggtggcatagcattgcatg

SEQ ID NO: 666912 - DNA, 910 bp, Homo sapiens
gcggctctcgcttcccggggttcttcgagccgggccccttccgcgtgggtgagtgaatgtgagagtcagggctcgcgcgcggcgccgccggctcgctgtgcggcgctctgttaaggcggtgggttggcgggcgcgctgcgggtcagaacgcatagggactgggcattgagcggctctgtgcgcgctagagccgtcgccggaagtcggagccgggagcctgagccgcgcgcgtgtgtctccgctgcgtgccgccgatggcccccggggtggttctggggaccaatagattcctccggggtggcttcccaggaacggcgggggctcatcttgccgcctgccggtcagacggctttgacgggaagaatgttccgccggccggagccgccggcccgggtatggaggggattcgtggaggaagcccattggtccgggccgagcgtagcgtcgtcctggggagggggcagagaggacccaaggagagggggttccatgggggcacgacaccggagaagcgtcacaaaaaaatgttgggcatccggggttacagcttccacaagagggggagtgggcgacttcaaaagcgggattgaattggacttatggggacaaggcgagttaacgttgttggagtctaccaacaggtggaagggcgcccatgtgacatgtgcaattattaggtgcggcacaattggttcataggatgtccccttaggagtttaaccccgccagtgttgtaaccactacaaagtggggccccccacttttcacacaagtgtggtggggcgagattatgcacttcacccagattaaatatacctgttggatggggggccgattgaacagccggcttaggcaatgtggggcgccccacataacacgcggggggaggttagagttttaggaaccacaa

SEQ ID NO: 666913 - DNA, 561 bp, Homo sapiens
gaggagaacgacggaggagcaagggcccaatcgcatggcaaaagcaaaaagaccgggaggtggaaaaccggaggaaaaggggaagggggaaggatggaaaagagagaagaaaagaaggaaaccaaggggggaaagaaaaaggagaaaggggaaaaaaagggggacaaagaggaaacggggaagagcaaaaagacaggaaaaaagaaagggaaagaaaagaagaaggaaaggaaaaagagaagaagagagaagaagggaaaaagggaggaaggagagaaaagggagaaagggagaaaagagagagggaaaggagtagagggagaagaggaagagagagaagagaaagagaaaagaagggaagggggcgaaggaacaaagagaggggaaggggaagaaaaggggaggcaaaagagggaaagcgagaaaagagaagaggaaggagaggaaggaaaagaaggggggaaggagagagagaggaagggaaagaggacaggagaggagggagagaagggcgaggagagagaaaggggtgaggggatgagaggggggggagatagaggg

SEQ ID NO: 666914 - DNA, 348 bp, Homo sapiens
cacataactattaatatgatagcaccagaaccatggtttccagactgcctcaaaagtctacctacctggacctggcgcggtggctgacgcctgtagtctcagcactttgggaggccaaggtgggcggatcgcgatgtcgggagttcgaggccattctggccggcatggtgaagccctgtctctgctgaggatgcaagaattggccgggggtggcggtgtgtgcctgtcgtcccggctacttgggatgctgcggcaggagaatcacttgaaccggggagttggaggttgaagtgagccgggatcacaccactgcactccaggctggtggcagagcgagactctgtctca

SEQ ID NO: 666915 - DNA, 177 bp, Homo sapiens
tatcatgacagaaccggattctagaatcattatttaaatgagacaatcattttaagttttaagataacagaagtgaccaatgtaatttcacaaacacctaaggattttctggttgatcaggttacttgtgcatttttactgatatgtcctggagtgaataggctgtgcttgttcttg

SEQ ID NO: 666916 - DNA, 337 bp, Homo sapiens
aaagttcaagatcagcctgggcaacttagcaagaacccatctctacaaaaagaaaaaaaaaatgcttaatgagctgggcatggtagcatgtacctgtagccctagctactcaggaggctgaggcaggaagattaccaaagcccagcagtttgaagctgcagtgagctattgatggcaccactatactccaacctggggcacacagcaagtgcaaaaccctgtcccgtgcaacaaggagcaaggagaaggagaaaggagaagaagaaatgagaagaaaggaggaggaggagcaagaggaagaagaaaaaaaaactatgccgggcgcagtggctcacaa

SEQ ID NO: 666917 - DNA, 655 bp, Homo sapiens
tgaaaaaaaagggaaaacaaaaaggaacccccagagggaaggggggtttccccaaaaaattgggttttttccaaaaaagcgcggtcccgggaaaccgggggaaatcaaccggggtcccgaaacgcggttggtgtgtgcccctcaatagttgggatgtttttggggagcgcccttgtgctgtgttgcgcccggtattttgttgcgccgtggcgcccgcaggggcgggcgctgggggggttggccgcgcacactattcgttttgccaaaatgtttgcggcgcgacccccccgggggaaaggggtcctctttctccggggcagctctgtgtggttgtgggcgccaaaaaccacgctatactggtgttctcgccccgaaaaaaggggttccgggtgcgcggctggcggagacaacaacaatttcttggggcggtgacaacaccaaatcggtgcgtagacaaaacacaacacaaaacgggggggcgggcgcgcgactaaaaaattaccccccggggagggcgccaaaatcatagactggaccaccaagtgttttttggcacaaccaaggagcggccccctaaaggagggaccgtcataaaaacgaccagcggacagcggggcaggcttaaaaaacaaacagagcgggaggggacaaactg

SEQ ID NO: 666918 - DNA, 215 bp, Homo sapiens
gatcagctcggcaccgattcctaattacgcaattacattttcatttggccaaagttaggaaggtcaatttaataagcggtttgatagacagggttcaaataatcttgccaaactagaataataggcctaaacatataaattataagcatttatttaatgtctgctctctgctagacatagaagtattgtacatgcactgtccccgtaattagggt

SEQ ID NO: 666919 - DNA, 126 bp, Homo sapiens
tcctaacggggatccaggtttcaatcagattgaagtcgaggctcatgacaacatcgtgatctctcctcatgggattgcgtcggtcctggggatgcttcagctgggggctggacgcaatcccatggt

SEQ ID NO: 666920 - DNA, 1732 bp, Homo sapiens
gcagtgagcaccctcatcggatgggcactgccccatgcttctgagcaaaaactgcaacacaaggaggattttgtcatgtggacctgagactggacgagaagtgcctcagatggagaccagggacgaggaactggaggagtggaggagccacagcatgaggacttcccaagactgtccagagccatcacacacacccatgagtgctatcagacgatactgacgactaacatgacggatgcatggcgcacacaatagacacgacattaggagaaaggtagagagcatagggacctgagaaagcaccacccatgagagaccagggaaacagcaacataccacgtcacgcaggacggcacaaaccttggtactcctcatccacatccacactaatggagtgagcccaacaatggcattggaccaagtggaccacgcatcagatataagaccgatgagcccactatccgtcgacacaacaaaagccatgacccatgaatggaccattgaaagtagacacaagcaacaacaaccaagacaagcaaacagaaacaacaaacaaacatttactagcaagcaacacaagatcgccagccagacacacagcagttgtatgcggaaccaatgcgtacgctatgcggccaatcgcaccggacaccctagaggcggacctagggaagagcagaggagcgacaagaaaaaagaacgacaagcggaattacaacggacctacaccacaagaaccaatctcattatcacgttacaacaccattaccatgactaacatatcattatacatacactctataatgaacacaaacaataaatcagcacacattacatatgaaacatatctataacaatatggacacaacaccatctgaaaatgaatatcaaaccacacatccaaccattactaccactactaaatagcatctattagaataattatacatcaacccatcaagaacatagtaacaatactaacaaactatttataaatcacagatattcacacccataaacacttgctcttagtcacccattagatatacaatctcacaaccaccactcactatagcacatacacacataaaaacagaaacacaacatgcaactaaatctctctctattatataatagctgaacataaagatcaaagacaacaagaagacaccacaccgacactgctacaagccacacctaaacgtgaagacgcacaacatacgaatccgtaagcaaacaaacatctcatattaaacaacaaacatatacacaaccccacactatatactcacactaccaacataccaccacagaaatttaatacacactagacaaggcgggagacgcagtgaaagcaccaaaaggaagtagaagcacaaccagcaacaaacacatacacctgatacacaccatatatctcactcacttcaccaagatacaatcaacatgcatcacagatatatgagaaacaccaacgcgtacaatacacatactacactaagagagagataacagccacaaccaacactcacacgtcgcaatatcaagttagcactcatcctcatgaatcgtcaccacccagaacaaagaaggcaacaaacagtagaagacacatgactaccgatagcatgaagatatacatcatagactaagcatacatcacacacaataaatatacaaaccaaatctaacacagatatcacacaaacaccaacccctatgataactccca

SEQ ID NO: 666921 - DNA, 385 bp, Homo sapiens
gatacatccatggggtaaaaagtgaagagctgaaacacacattgtgcttgctgcaccattcaatttctgctatgttaaaccgggtgattaggctgccagtgtggcaccatccagcacactgggaattgtgtgccactccatacagtgctgctggatctgttcatgctgctctcctgcagtggaatgccagttcccaaagaaccatgctccaaataaacaaaagagaactggagcacgtcaagaaaaacttcagcaaaggagagggtatctcaagtgagtctttcctcattagctggacttggctgcagaaactgtttggtttggagtagctgtagtggttgggagatggtccatctcttggtgcatcaaaaatgtatgccaggca

SEQ ID NO: 666922 - DNA, 221 bp, Homo sapiens
acctgctatttactccatggctagatatttgtatttttagatagagatggggtttcaccatgttggtcaggctggtcttgaactcctgacctcaagtgatccacccgccttggcctcccaaagtgctgggattatagacgtgagccaccgtgcctggcctatcatcttgtttttactttttatctgcattacatgtgtagcaaggctttgctctgggtttg

SEQ ID NO: 666923 - DNA, 246 bp, Homo sapiens
tgcactcttgtgatgttacagacatggtagcggctgggaaagatctccctacctattacattttctcttctccctcctacctaccttattctaaaatgtgcctccacagatgggcagggctcttgtagagagatccctggcccatgacaggagatgccaaatctaatttatctcactgagggcctattgagaaaaacgcttctgggccaggctcagtggctcatgcctatataatcccagtacttt

SEQ ID NO: 666924 - DNA, 427 bp, Homo sapiens
agtcttctagagcagggatcccatcccccaggtcatggactggtactggtccatggcctgttagaaaccaggccacacagcaggagatgagtggaaagcaagtgaaacttcatgggtatttacagcaattccccgtcgctcgcattaccacctgagctgtgtctcctgtgagatcagcagcagcattagattctcaaggagcacaaacccttttggaactgtgtgtgagggatctaagttgcgcatttcttatgagaatctaatacctgatgatctgttgttgtctcccaccacccccagatgggaccatctagttgcaggaaaacaagctcaggctcccactgattctacattatagtgagttgtgtaattatttcattatatataacaatgtaataataatagaaataaagtacataataaatgt

SEQ ID NO: 666925 - DNA, 335 bp, Homo sapiens
tagacagcccccccccaaaaaaaaacaaaaaccacccagaccaaccagttttaaaacccaggcatcctggcttcaaagctggggcatttttcaaattcctacgtttcaagaaaaatgaagccagaacctaccctgccatcgggcccttagcagttcctatgcctactctcgaagtagcactgaatcccgccccccattttcaatgtgtagcccaagggatttggtaccttgataggactaagaaagggaaaatggccataaataaaccaggtgattattaaataacagagaataggactattcatccaaacggcatttcctacagattaatccaa

SEQ ID NO: 666926 - DNA, 1259 bp, Homo sapiens
ggcgcggcgcgggacgaatggcggctgggttcaactaaagggtgcaaacgaaaacatctgtggtctccgtggttgttaaacgcttgcacgaaccgtggaacctctggcagtattacacggagactttctcgaccagaggaactgccgtcctgcactggacacgagaaccccttggtgcacttcagaaccaccacaactgtcacacatcggcttcaccttagctaccgcagcactggctttctgcctcttcgctcgaacgcttggcgcgcacctactacccgctacatctgctgcgagcttccaccggcccccaccttctgcggccaccatctcacccaagcactgccccctgcactcaccccgactcccgcttgctctccctacactgtgcgaccctaccacgtccgctgcgtgctgcactccgagaatctccggtcctggcaccttcctgcgagcaccggaggccccaagctgggtctcgccctgctctcgactctgccggagtgctcctctgcacaacatctccgcgcggactcaactctcacgcgatctcacgcgtctctttgcctcgccgctccctctccccacggagtcagcctcggctctcttgcgcgcgcttctactcccttgctgacgtctccactttttggcccttcagccccgctatcgcactgcgcccccacccgtctgcctgcggcggctgccgttgcccaccacttgtctgccctccgcgccctcgcccggcgctctgttacgctgcgaccgtcgtttcgccaacgttgtcgtctcgttggcgagcgtttccctcgacttgctcgcttggcggcgactcagcctcgacgtgcgctagccccgtgaccgctttcgcctctccgcgcgcgaacgcggaccgaccgcgttcctctcgccgcacgcgtaccttgacgcacacgtgtcgctcgcacggctgtgcgtctcttttcccctgtggcctgggcgctctcgtttcgaccccccttcttgtgcctgctaattctcgttatggacccggctgaacttggcgcagcacgggcaccgggcgcgtttgctagcgcgcgcaccgtggggtacccccgctgttcgggtacgtctagcgtacgcttgggggctttgcacgcgcgctgggctccatcgtcggcccggtgtgggccctgcgccgctctatgcgccaccggctggcgctggttacgcggctagcccctcgtcgtgcgcccctcagcctcccggggtctcggcctcgg

SEQ ID NO: 666927 - DNA, 1117 bp, Homo sapiens
ttgtgctggtgtctgggagcaagagaagggggtactatgggagggcagagtggggaggggagtccatgggcctggggccccaagccggggcgtctgagctcccgcaggctatgagccaatacctcagtggcaggggcctctggcttcaggccccgcctggctgacattcgtgagcccccctcggagggccccgccacagccaagcctgcccagtctttcctctgggcttgatccgcctagggtgattttcgtccaaggccatagggccaggagagaggccctggctaccctgtgctgtgggtgctcgcggcgaaacgcccttgcgaaccagcgtcagtaagctgcaaaattgctagtaccatggcgcggtagaggtctgctcgtagccagggtgaagtggagcgatagacgtgtagaggccggttgatggcctagggcttccaagccgtctggtgctgtctcgtggactcctgaaccgtgtgtgtgcgtgtgtgcccgttcgtgtgactttcttactcaccatagtggttgaacgaagagggaaaacggtggagaattcgaatagacgggggttcaatatccacatcgtcaggtaggtggacggggacgctgccgtgccaattgggttgtaatgaccaggttctgagttatccggatggccgtggttgcctaaactactcgcatcgccatgtagctcgtcgcacgacctaactggggcgatctgggctggttgccttggttgccattgggccaagcgcccaagtcctcatgcctgcaacaggggggcctgtgcacgccccatgggcccacagcctcgttgggaaggcctgtgtgggccctgggcacaagagcgaggagccaggggcttagctcactgaagtggccccagatggcttcattagccctggtccccaagtttttggaagtgcgaatgaatgggcctgtggtgaaacaaccccggtacaaaggccagggccaatgagcaatgaggtgagacagaggaaatagacgttccgggggacaatgttcaaacatcaaaggagtggaagaccgggacacaaacccaaagagcagggaaaaaacacaaaggaaagaaggacaaaaggagaggacacag

SEQ ID NO: 666928 - DNA, 231 bp, Homo sapiens
gcctgtgatatgatctcaagaaacggtctatgcctctcagatgaatgaaacatgagagggaacctcaaacttgcattaggaacacacgtggagtataccaaaccctccctctcaagcagtaagtcactcactcctctctcttccagatggcaaagcgaccacctgcaacaaaacccacgttatataaaacacgtgcagaagtgttaattgtacctccctttccaacaacag

SEQ ID NO: 666929 - DNA, 319 bp, Homo sapiens
cactgaagaagtagagacccaggtcgttccacaccaactccagaacttataacggaaaagcctccagatgacactacggccctgcccctctctttggcccaccactagaatcagcttttagatgaacagaagacagaagttctttcagatcacgcctgagatatggggttcagtccaaccaatgcatccaagacatggagtcgccagagtttgtcatcgttcgtgtagcccattgtggaatatctccaccactgcctctgaaaaatgtaccagttaccccaccctcgaacaggatctctctttataattggaccaggtg

SEQ ID NO: 666930 - DNA, 1244 bp, Homo sapiens
ggcctaattctcgacaatctgtaactatccgctcattctgccgtcgtgtttctctgccgggtccgcacatgtgaatgatagagatcgccgctctgatcattgacaatgggtccggcatgtgcaactgctggttttgcatgggcgatcagacgctctccgagccgtgtttccttccatcgtcgcatggcgtccccagacaaccaaagggcgtccatcggtagcgtgcagtagggcccacgaagtgactccctacgtaggacgcacgatggcctcagagactacgctgtcggtcctccttgaccgctgggattacgcgccgatatagagcgatggccatcggtccacgcaaagctgggacgacgatgcgagaagatctagggaccaaatgccttctcacgaacgcaggctgccgcgtcgtccccgtggagcgtagcacccaatgtgcttgctgcagctgcagcgcaccgcgctgaaagcccctaaaggcctacagctagagcatgaagcatcgccactccagcattgcattgtcctggaatacccgtgtcataggaacgccgcgcttatcgtcacagtgggcccgatccaaggctcgtggctgtaccctttcatctccctccttggtgggcgcaccaagtgcgcagtctggtccatggtacttcctgcgaggaccggcggatccagcgcgacacgtgctgccccatcgtagctcacggtgccttacgcttgcttctctgccgacggtcccagtgcctgcgtctctggaccctggatttgtgcccgctcatcttcgaccgggatctttgcatttcagagaaggaatctcgtacagcttgacgcagaccggcatacctagcgtttcgactcgagcccaactggtcccgatgccggggacattaccggttgcgacgcactattcgaagggacgcaaagcctggttgccgtaccgtcagcaccctgggacccttcgaagcgagggagtattgaggcgacccagcccggcagttccttccggtacatttcatctatggcacgaacgacggcttacgcggaggcctgcgcccggatgcgctcgcccgagttccgtctacgccactttggcagcgacttgacgccggggtaccccgaggtgttcccgggatgggccgccatgtgtcccacgcccgttcgcgttccgtgcgcgtttcggcaactccttgcggcggcgctcccaccatgcacgcgccatttccactttccacttc

SEQ ID NO: 666931 - DNA, 283 bp, Homo sapiens
ccaaacaaaagctttgaaagtggtgacagaaaaatttccctttgagctagacctctagatctgcctcgcacagaaatacattaagtgggctggtctcatgtagtccccccatcattgcaaattacaaacctaaaaatacagaacatcagcggagaagacaggagagcttctatattccccccatgtcgtcctctccagacactgcttccttcctgcactccagcctgggtgacagagcaagactccatctcaaataaataaataaaaataaaaattcccttta

SEQ ID NO: 666932 - DNA, 553 bp, Homo sapiens
  misc_feature (290)..(290): n is a, c, g, or t
  misc_feature (448)..(448): n is a, c, g, or t
  misc_feature (487)..(487): n is a, c, g, or t
  misc_feature (529)..(529): n is a, c, g, or t
tggagaccagattctaatacgtacaacacagatttatacatactttgtttataaaactcgaaatatggatatgaaacagtctcatcatggttttagctggagcttctgaatttgaccctcagtataataaagattccacaagcaggccaacagataatattttaataccacagctaatcagggaaattggcagcataaatttaaagaagaatgaacctccactcacctgtccatacagcctgaaggcagagttcttttactgtctcatcttgctagaatgaaaattcctngagacactggaagaagatcaacagttcatgctgaaaaaatgtcctgctctgcttcaagaaatggttaatgtaatctgccagctaataataatggcccggagccgtgaagaaagggagtttcgtgctcccactttgggcatccttagaaaactgtatgnagctttcccagatggctgttcaggggctccagcagtttnagtctccccctctgcagctccctcatattggagaggacatcntaggagagtttcggatccttaaaa

SEQ ID NO: 666933 - DNA, 999 bp, Homo sapiens
gagaaacaataggacggaaacgccgaggaaccctggctgaggcggcagagcatcctggccaggaacaagtccaaggagccaagacgagagggacacactggacaaagcaacagacatgaaagacgtacgtgagcctgctggactccttctgccatccacccatctccccgccatctgtgcccggaggatgagcccagccttcagtggccatggatgtgagagcccctgcgccaaaggcgtccttctggagcccttatgtccaccaggtcggggggcactcatgcgtgctccgattcaactgagacaaccctgtgcaagcccctgtgtcaccaagggaacatcagttctacgagaccctccctgcgtgagatgcgcaaattcactcaccagtacagaggtgtctcttgatacacgagtaagcccatagtcgccccatatggggggacggtgggggacagactttggcgaggattatacccaggaaatacttgcacgaactgctttttggtcctccaggaacaccagaaggcccgggtaactcaaggagcaaagaccaaaggacaccttgatgacgcatggccaatcccatgccgcgatagaaagcccatagatacactatgcccctggtggagcacaggggacagatgatgagacatgacttaacaccgactgcccgagctcccataagacaacccaagagcaagcggaggaccaacacaacaggaaaaatgtacaaaccacacatcctgaaccaccagcgatacagcactgacagacagggcgaaggacatgcagacagcatcagacagtagaatgcatgggagagcaacaaagacagagccaagcgaaaggacaaaggaggaacaagccaacacacgagaaaggaacagcgggacgcgccaagaccaaccgcgaagcgacaacaacaccccaggtagacgcaacaccaatccccaaacacactagctaacaccaacacatgcaggccaggcaaagagg

SEQ ID NO: 666934 - DNA, 112 bp, Homo sapiens
atggtgagctgagatctcgcactgtagtccagcctaggtgacagcaagaattcgtgtcaaaaaaataaaaaataaatgaagatcttattttttaataatttcagatttacag

SEQ ID NO: 666935 - DNA, 328 bp, Homo sapiens
tcagacgtatccctttcatagatggcacgcgaaagctcactggtgttagtccagagcgggaacgcaaagaacctggagtgtgatgtccaagggcaggaggaatggacagaagcatccagcatggggtaacgacgaacgccagaagactcagcaagctagcttacctactttcttctgcctgccttgttcttagccgcgctggcagccgggttggagggtgcccacccctcactgagggggtggatacttccatctcctagatccacctgactcaaagtttcagctctctctgaggagcacccatcacaaccagcaaacaaataccaga

SEQ ID NO: 666936 - DNA, 127 bp, Homo sapiens
caggattaacgtcagcagagctcattcacccagtctgtcagactaagtctatttgtctctgtatactactacaactatcacgtgtcgagcacatggcaggtgctcagtaaaacagttctaaatgggg

SEQ ID NO: 666937 - DNA, 1915 bp, Homo sapiens
gtaaacttttttcacttaaaaaagtccctccccccacctcacagcatatgaatgcgttctctactgagtaaatcaagcctgagctttctcatgtgggctcctctgtgctccatccacttctctcttggaagacagggtgtctttctgccttccaaggctgatgcctctcgtccccctcccaggggctgcaccctcagccacccccagctggtgttttcagtttgcttctctgataggtggcctcttttatcttctggtttgttgctgctgccttctgaatttacaggcagcctgtggatccttctgttggtatttttctctcctaggtgaactcttggaaggaggtggtcggcattcactgttacctcgggccctttccaccttggcactgctcatcatgctatgatttggctcctatcctgcccactctaataaacaatcacgagtttggcagttctccttattgccaaatttaatggtcatttacaactcgttttcctgaactcttcttctttttttgacaccatagacgtctctctctgtgtcactttctgatttttcttccattgattctctgacttggctcctgaactggttcctgatttctcctgcctgtcactttagttgttccctaagagttggttcttcacctcttaacttttccaggacttttgtttggaatttgacactgttgactatacacctctttcttgaaattgtctgtcattcatctccatggtgttattcctttctggttctccttgaaatgtgtcttgatttcagtggctcttgaagacttggtgggaactttctatttccttagctcccataatgctaatttttcctggtacttcttgtgaaccttttcttttttttagccttcagtagattctaaagagttgcactgagggcctttaatgtggaactggctcaggctggttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaaaatcagtcatggagaaaaacatattaaaataatttcatggcactgatgttaattctagtctattagttttataaaagttaggattcttatttaggaacaacaggaaatgactgttaaggagaaaatgaatttattgaatgggatgtcaagtagctcacaaaattgagaagttgccgtgggactagggtgccaagactgctgagattctggcagaggcactgccattggcacccctggcccagacagtgtctgctgtgctgtccctggaagctggagctccaacagggaatattggtgtagctgtgcataggccataagccacacttgagccagtgggcagggagaaggaatgtcattctcccttcaccactggggaaggaaaggggaaagggctcaagttatcataggggcttacatgctgagcagctataacctaggtgttcagaacacctggaagatgcatttatttaggggtcacaaatagtgaaattaatatttgaggaatatcagtcacgtgttgtgggcttttatccttaacgtttaatttttacaatcttgtgtaaaaatttatccatgataataacataacttctttaaggttggagtggctggcaagagcagagccttaatttgactttagctctggctggtctggaagcttttacttttttgttaatcccacttcctcactctgtcattcagcattatcatgatcgtgaacaaaattgtactgagaaagtttgtataagtgatatgaacggtattgtattgaacatccattaaagggttgctacacttt

SEQ ID NO: 666938 - DNA, 275 bp, Homo sapiens
tgtcttcacttcacccagtgtgcacttcgtaaggataatgatgatttcgagttagtttagtattcaacagcttcctctattcctttatatatctctgtatttaatagctgtggcatagagtttccaactaagtataagtatcatgttttctttgtgatgttttctgcaatatattgaaggatgacctgtgattgtccttataactttgttccaacagatttacatgatgttcataagctgaataaatttgctctaaagatatttccataagctca

SEQ ID NO: 666939 - DNA, 485 bp, Homo sapiens
cagctgataccagagtcttgcttcggccgcggtcagcggagccctgggctggggcaggagccgaaatggggtaggctgtgcagacaaacggaactcaaccattaagcaaaacatgggaactcagtttatatgagttacaacgaacacctcaggaggcaataacagatggtttaaaaattgtggtttcacctcgaagtttacacagtgaattaatgcgcccaatttgtttggatatgttgaagaacaccatgactacaaaggagtgtctacatcggtttttggcagactgcattaatacagcccttagaagtggcaacaaagaatgtcctacctgtctgaaaaaacttcttttccaaaagatcactaaggcccagacccaaactttggtgcacttataacatttatcccaacgcgtgatgcagtataaagctaatctcaccacaattgaggaaggactgtaaattcaaggccatgcctgccactgg

SEQ ID NO: 666940 - DNA, 221 bp, Homo sapiens
ttgagcccacagatgtacatcaccacactaaggctaatctattttactctttgtcgagatgcagtcttttcatgctatacatgttggctacaaactgatagaaccaagtaatcctccagcatcgaccttgcaatggaccagaacctcaggcacgagccaccgtgccttgccacaagcgatttttcttcaataaaaaagaaaaaagaaaacgtttgcggccg

SEQ ID NO: 666941 - DNA, 112 bp, Homo sapiens
actgtgcgcaggtcatctagaggatcccgtatccaggaatgtgaagatccaccttggccctgcttgcccggatgggggggcagccagctttcacggatctagaggtgatctt

SEQ ID NO: 666942 - DNA, 150 bp, Homo sapiens
tatactgtaccagtgtcaatgctgcagcctgccaggctgtgattttgtgaggcttgtccttatgtagaatgcaccgcagcccctggccactgcaaagagtgcacagtggactgtggttctccatatgcggcgcgccaagggtggctcgct

SEQ ID NO: 666943 - DNA, 278 bp, Homo sapiens
  misc_feature (235)..(235): n is a, c, g, or t
  misc_feature (275)..(275): n is a, c, g, or t
tggccatttcaaagaaatgatattagtcggacatgctcaagttatatctaagcttggaaacatcgatgtccgagtacctaatggatgaagcagcgatgttttccggtgcagtgctactcgggtcgcaaggatcggaggcgcaatagtcctcgacaagtcgccaaccctcccacttcggtcgatcagctgttagcttcgtaaataaagctatagctttgcgagcgtctttggggtngccagtcgcacgcagtaagttgacaagagcccattgaccnatc

SEQ ID NO: 666944 - DNA, 397 bp, Homo sapiens
ccgggattttttttttaaaaagtggggtggggcccttttttccggcccttaggaaaattggggtttttgggttttttggggaaattttcccccaattgggttggaaaccccgggctttttttttttaaagttggtctttccaaaaccttttttttttttttggatgggcccccttttggccattttcaaaacccaaacccccctttgggttggtggagttaaaaattggtaccccccccagtggatggattggttttcccttttaaaagtttttgggaaacccattttgaattgtttgaaaatttccagtttttttaacttggtttttaggttgtttttaaaactatttttttttttaaatttttaaaaaaaagggttttttttttccccttgccca

SEQ ID NO: 666945 - DNA, 772 bp, Homo sapiens
  misc_feature (5)..(5): n is a, c, g, or t
  misc_feature (74)..(74): n is a, c, g, or t
  misc_feature (100)..(100): n is a, c, g, or t
  misc_feature (151)..(152): n is a, c, g, or t
  misc_feature (155)..(156): n is a, c, g, or t
  misc_feature (158)..(158): n is a, c, g, or t
  misc_feature (169)..(169): n is a, c, g, or t
  misc_feature (173)..(173): n is a, c, g, or t
  misc_feature (193)..(193): n is a, c, g, or t
  misc_feature (198)..(198): n is a, c, g, or t
  misc_feature (200)..(200): n is a, c, g, or t
  misc_feature (207)..(207): n is a, c, g, or t
  misc_feature (212)..(212): n is a, c, g, or t
  misc_feature (221)..(221): n is a, c, g, or t
  misc_feature (236)..(236): n is a, c, g, or t
  misc_feature (264)..(264): n is a, c, g, or t
  misc_feature (275)..(275): n is a, c, g, or t
  misc_feature (289)..(289): n is a, c, g, or t
  misc_feature (292)..(292): n is a, c, g, or t
  misc_feature (304)..(304): n is a, c, g, or t
  misc_feature (310)..(310): n is a, c, g, or t
  misc_feature (312)..(312): n is a, c, g, or t
  misc_feature (321)..(321): n is a, c, g, or t
  misc_feature (346)..(346): n is a, c, g, or t
  misc_feature (368)..(368): n is a, c, g, or t
  misc_feature (377)..(377): n is a, c, g, or t
  misc_feature (385)..(385): n is a, c, g, or t
  misc_feature (405)..(405): n is a, c, g, or t
  misc_feature (425)..(425): n is a, c, g, or t
  misc_feature (428)..(428): n is a, c, g, or t
  misc_feature (438)..(438): n is a, c, g, or t
  misc_feature (457)..(457): n is a, c, g, or t
  misc_feature (500)..(500): n is a, c, g, or t
  misc_feature (519)..(519): n is a, c, g, or t
  misc_feature (605)..(605): n is a, c, g, or t
  misc_feature (616)..(616): n is a, c, g, or t
  misc_feature (621)..(621): n is a, c, g, or t
  misc_feature (646)..(646): n is a, c, g, or t
  misc_feature (657)..(657): n is a, c, g, or t
  misc_feature (668)..(668): n is a, c, g, or t
  misc_feature (742)..(742): n is a, c, g, or t
taaancaggttgtatttattaaaaacaaaatacaaaataacttggaattcagattattgtgatgtttatccccnaacaggtcagtcctaaagaaaaagcnaattgtttcaagggtggtaacggaagaattttaagtaaggattatattaannacnncnagtttgatgcnaacngagttttattcaatgttggnggccncnctatgtnccccnaagttttcnaccattaacaacccnaaccggttgtttccctcataccaacacntggtgtgtgcngtggttcccccccngtncttagaacagcnggtatncngtttcttcngcctttttttttttgaatttgatcnaccttttggtaggaatatttcngcgggggcntatgaccntgtggcattgaatagatatncataaagttgcttagccccnggncatatgcccnggagactttccacagaggncgatgccagcagttgccggcatagtccgtgcaccaggcttccnctgtacagtcgagttaggnccggccccgggaaaggagtggacagcagccggttgagaaacatccccatctggggacagggctgccactgacagaagatgtgagcngtgtctaagtncagtnttgtgcccagccgtgtctgcgcctncactctttggnactctgcatanaacatcttagcaccatcttcctgcagctcttccttaccagggctgttgattatggcaataaagggccccactancattgtgagcagtaaggattgtagatgatg

SEQ ID NO: 666946 - DNA, 120 bp, Homo sapiens
atggttgttgctgacaaggacctgttcaaaaatacacttcatatctcctgaatatttattgttgtggggctggggcagttgcaggcacaggcatgacaacccagctcatttcttccaacc

SEQ ID NO: 666947 - DNA, 182 bp, Homo sapiens
ttttgggccccccccccccccaatccccttttgggaaaagttaacggggttttgggggccttaaaaggccccaattttttttaagggtttttttttaaatcccccccaaaaaaagggttttaaatttaattccttttttttttgggggcctttgggaaaaaagccccccttttggggggtta

SEQ ID NO: 666948 - DNA, 328 bp, Homo sapiens
  misc_feature (173)..(174): n is a, c, g, or t
aaaaaaaaaaaaaaatcccccctttatcccccaaaaggccccctggcccccccgggggccttttttgggccggttttccggggggttttttccccccaaatttaaaccccctttgggccaacccggggggttaataaaaaaaggggtcccttgggggccccccccccttgggnnaaagggccggggggccccccctccctggggggggggcccggggccccgggcccccctttttaccctttgaccttgggggggggggggtttcccctttgtttaaaaaaaaaatttggttttttttttttaaaaaattttttttttcccctcccca

SEQ ID NO: 666949 - DNA, 220 bp, Homo sapiens
acaatgtacatatcccacccctacagttctccctgagagtgatcaaactctcatgagatctaaccaaggcagatgtgacagcaagggccacggaccccatgtccaggggtggcgtcttcatgagggaggggcccaaagcccttgtcggtgctggacctccccttagcctgtcttgaggggccagccctttagtgcattcaggctaaggcccctgtggcag

SEQ ID NO: 666950 - DNA, 921 bp, Homo sapiens
gcaggtttgtagaatatgtggtggaccggtctgtggagcatgacaaagcttcaaaggatgccaaatatgaactagtgaaagcacttgccaattccagagacaattgcagaaatctttgggaacccaaattattggaggcgtcagatacttacctgagtgaagggccatacgtatgtgaaacgctgtttccacgactagcagtagaaggagccgaatgatttcttctagagcgtccatgtagatggaccgagcgtttagaccgaagaacttctcctaaggcatttgacgtccagtctatatttcacataaagagacttcctttccccaagaattatcatggaatggtcagatgttacttgtgttaccaacagctgttatatttgctacattggaaagtgcaaagtggaactaggagttgggaatgcattaagagcagacaagcttggtcataatagatccagtgttatttcagattgcctttcactgccttaatcttgtgcaacagggtggaagtttggttgcttccctcaaaattttcatggacatgcaatcttatctaaaagcctgcttcagggctgggcgcggttggctaacagctataattcccatgcacttatgggaggccaagatgggcacaatcaccttgagtctaggagttcaagaccagcctggccaatatggcaaaaggcctgtctctagctataaaatatataatcagccaggcatggtggtgcaaacctataatctcagatactcaggaggctgaggcacgagaaatcgcttgagcctgggaggcaagaggttgcagttgagctgagatcttggcaatggaaacagagctgggaaaacacagcaagatctggctcaaaatcaattgataaattacaaacttgcaacaaattattctggatctctacataa

SEQ ID NO: 666951 - DNA, 429 bp, Homo sapiens
  misc_feature (289)..(289): n is a, c, g, or t
caggaaggggggctgcacagcaggaggtgagcttcttcatgagccagcatgacggcctgagctcctcctcctgtccaatcaggggcaacattagattctcacagaaacatgaaccctatggtgaatggtgcgtgcctgatgatctgaggtggaacagttaccttccaaaactgtccccatttcacccccggggggtggaaaagttgccttccacaaaatccatccctagtgccaaaagggtgggggaccatgggtatagaggtatcctcagtaggactcagcaagcggncaaccctatttatgtctattaggacaccccaagaagggctctcggcgggaagtaaaatgggtcatgccttagggatgcatttgctagggccaggtttcccaggggggtacagggcatgtcttttgtgaaaaggacctgga

SEQ ID NO: 666952 - DNA, 260 bp, Homo sapiens
gctaccgtgcctgctaattttgtattttcgtgagatggtgtttcactatgttggcaggctggtctcgaactccagacctataatcccagcactttgggagggtgaagtgagaagatccttgagcccagagttcgaaaccagcctgggcaacgtaaggagacccatgtctattagaaaacaaaaaagggaagggcctttttgacctcgctaaggggcgttggcccttccgcgggttccgggggttcagctctcaaggaagc

SEQ ID NO: 666953 - DNA, 1083 bp, Homo sapiens
ctagaactagtccttaaacagttatagtcaccatcacctgcttaagtaccttttgtgtgcctatttatgccatatatctggcatgtgatcttgcgaatcctactgtcgaatggcgagagtctatggcacaaataggccactcaaaaaggtacataaaacagagatcgtcaccaacacctgcctcagactggtctgggatatatgtgtgtaggggcaagtggtgggcagcaggaattgcacgaaaatattcacgatctgtccctagagcgtgaatggatactacaacattaccgtgagctgtcctgaggatacactggccatctcaagtgtcaaatatgtcaaagcctgcctgtccagtctgagatagtacatggtccctaggtgaccacttaagtcagcagactgtcattgccaagatatgcgttcaaaccataacttggaaaagctactgtgcatttcctctctgtcaccaggagatggatcgtacactgcgtcatatcttcccgcgtggctaccgcattcacagagtatgccagggatattgaacattgaccaacctactgtatgcactcattgtcatggctcagcatggcgcatacataaagcattgtaaccaacacgaacgtatctggtttaccccacaacgagtatccgctggtgatcgttaaaatacctatccaattgtacccatgctcacgaaaccagagaactgagcattcgccatgggactacatacacagtgctcccaatgccaactccacctggacgaccggcaatctaacgttagcgaggacacagcaccacgaccatggcgccgccacagtcaggtccaacaacaccatcgcagcgaagcaacgcaccccccgcaagaccgcacagccgtcaccgccgcgccgaccacccgctcgaacccgcgagagcacccgtgcagaaccggcaaacccgcgcacggaaacgccgagcaccacaacgaccacggctcacacagacacggacaaccaccaaccaacgacggtccaccgccaaccaaaagcacagccagcaccacacacacatcgacccagcacgaagcaactccccggt

SEQ ID NO: 666954 - DNA, 318 bp, Homo sapiens
ctaaaatcttcggctccacagtaccatcatttaatacagatgattgagtctaagtctgtattgctgtaggaccagatacgattgtgaatgagattgaatgtgattaccctatggtaagaggaaaatgaatctttttggtggtgagtggatgagagcaggcctttgatatatatgtcgtcattgtataaaaagaaaccccaaatgctgaatcctatcactgttgtcatgggggccaggcgttggatgtggatatcatttaaactccgtgaagattgtatctaattatactgagcagaatgcaattaaagtttgtgaaca

SEQ ID NO: 666955 - DNA, 291 bp, Homo sapiens
ctgctgttttgatctagaggctccccatcaggcgataactgggcagaggatttgttgcattgtgatgagtggcctatgagttgagatgagccactatatcagtagatttgatagcaggataatagttatatcgactggatacctaggcagtacatgacactcggaaaagaatagattactcctcgatgctcttcatcttcctcctgaatctctttacctggtgctggccctccaggctttcacaagtgctcgtgagtcatcactttacacgagtgtgccgttagcttgccc

SEQ ID NO: 666956 - DNA, 196 bp, Homo sapiens
agtaggaggatggtattaatgggtacaaaaaagcagcataagatgtagtataagatagcataacagagatgactatagtcactactaattgtacattttaaaacaaccaagatactttaagtgaaataagaaaaaaaaatcaagagtatacttggattgttagtaacacaaaggtataaatgacatgaagtgatga

SEQ ID NO: 666957 - DNA, 273 bp, Homo sapiens
cactaggggctcccaagatcttctttggcgtccagattgaatgaggtcacacgaactaactgcccacggttaatgcaaaggattttatggggtgggaaaaaactctcagcgcgaaggggagatgaaaaagggacaggccaggaaggtaatgttcccttggagtccagccgtcctggccagaatcctctccaaagcaacatcatcaaactgtccctccgaggttaagctgcttctttccgacatccaaccatagtctccgatgtccagctgctt

SEQ ID NO: 666958 - DNA, 248 bp, Homo sapiens
ccttttttttggggcgccccccccccttttttttccccccccaaaagaccccgggcccgttcccccccccggtttttttcctggcccccgggggggtttccttttttcccccggggccagtttttcccctttgccctttccaaaaagtttttttgttgcccccttcaagggggcccccccggggcccgccccccctttccccggggcccccccccccccgggcctccttttttttgggccttttttta

SEQ ID NO: 666959 - DNA, 1147 bp, Homo sapiens
  misc_feature (491)..(491): n is a, c, g, or t
  misc_feature (508)..(509): n is a, c, g, or t
  misc_feature (525)..(525): n is a, c, g, or t
  misc_feature (553)..(553): n is a, c, g, or t
  misc_feature (555)..(555): n is a, c, g, or t
ctgaggtcaggtccacctcatcagctatgaagtctatgaatcctgggagaatcaagaagtcgttgtaggtgagtccctggtcactggcgaagagctgctgcacggtgtggggaaaagaaagagagatcagattgttactgtgtctgtgtagaaagaagtagacataggagactccattttgttctgtactaagaaaaattcttctgcctcgagatgctgttaatctgtaaccttaccctcaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaaggngaagacctgaccgttcnncagcccgacacccatnaagggtctgtgcttgagaggattagtanangaggaaggaacgccttgttgcagtgagagaagaggaggcatctgctcctgcagtccttggcaatggaatgctcggtgtaaaccctgatgatggtcatctgtgagatagggaaaaccgcttaggccttgagtggacatgcggcagactactggttttaagcattggaagttatgggatgaaatttgagccaggcttaattctaaccttgtctgagcaaacaccttggtcacggtatatgtgactttttcactttattttgacctgcaaacccctttccggaaccctaaatggccattacctagggactaaaggccggggatcctctatgttagccgccctgggccctttttttctcaaaaaaaaaacacaaaaaaacattggccccttcccaagttttattttgagtttattggccccattgggtcttgccaatcccctaggggggttaaaaattgcgcgtttacaccggcggaaaacacgtgccactaagtggggaaacccttttccgggctacgacccccctctttcaaagcgcctcggggcgtagccctatttcagccttttttgagttttcatagcggcgggccctttt

SEQ ID NO: 666960 - DNA, 352 bp, Homo sapiens
ggggtgtagctcagtggtagattatgagaatgactgcgccgttgaatcctcattgtatgctgcataactctgaaactacgaacgcatcatagtcgcatcataatcctctctcaaggacttcaaaggtatactcccagctaatagcttagtctgatgactatctagcaagcctcgctaacctcgcacttaccaccgccaatattaacctactgggagaatctctctgtgcatagtaaccatgtctcctgatcaaatatcactctcctacttacaaggactcacaaatactagtcacaggcctatactccactctacatatttaccacaaaacaaatggggctcatcaacccaa

SEQ ID NO: 666961 - DNA, 807 bp, Homo sapiens
gtccatggttatagaggaaaagacaactgctagaaactgctagtatttcttgagagtcctgcagagcactagtaggccaagtgtggaacgattctttcatgccttgtgatgcttcggaaagagcgtatgaccatggtagagtcgcattttcattgacatgcaagtctcgacacacaaaagtatctggtcgcatgagacgttgtaccctaggaattacacctaccgatagctgtcttgggacccagatatctcacaggagtggggtaagttaacatgttgcaagtcatgtgcattggctcgtagttcacttcctggtagttacctgagcaacttggggcaatttgttatgagccatattagaacaccgattagatggacactacatgcaagtgtttgaaccctattgtaataggactacctggagtaatggcgacaactgggtaacgtcgaacaatgtttagagtaaattcattcctggttgacagtggcacccagtgcgcgtgtgtgcatgacggtaatgaggagaatgggttgattatgacgaagggagccatcagggaatgaaaagcgttctatgggattacagttgaaatccaagtcacgcatgtagggattctgtcagaccatcttacatgtggacaggctttacacgactccctgtaagggatatgggcttgtaggtggcccctgaaagctcctttcaggaaacaaggccagaagaagttttttcaagacgcttaccgaccccaggaaagaatacactgggttccattaccggatttcactttctgggaacgactgttgaat

SEQ ID NO: 666962 - DNA, 447 bp, Homo sapiens
agccagaatttcaaaagaagtgggtgggttagtttttggaaaaaccccattctaccctacgaggcagaagccccgccccaagggtagagccctctgataccccaagccccacccagaggggagggtcccctccaccccgaccaggttgctcctaaaccactcgggttcccccaagcccagaagctccaagctgacaccaccaaggtcaccccacttctcccaagttctctctttttagactatttaggcctaagggcagaaagaaccttaaatcccaagatgctagcttttgacctgcagagaggtgtggcagcccactgacattgattaagcgcctgctgtgtgcctggtactgtgccagcatcaggatgccacagagaacaagacaaaccagatcgctgtgctggggggagcttacagtccagttgaggagacgcagtaagatgc

SEQ ID NO: 666963 - DNA, 215 bp, Homo sapiens
gcggccgcctactactactactgctcgaattcaagcttctaacgatgtacggggacatgcacctggtgccgggccgggaggctgctcccgcgcttgtgccacgtgacctgggcatgttataaaagaggtttagtcaaaaagaccaaagcccatgccttacctacagcactatgtgcatttgctgtcacaataaagtatattttgtcttgcaaaaa

SEQ ID NO: 666964 - DNA, 223 bp, Homo sapiens
tggtactgctgagtgtgggagtcagctaatactttgacgcgatgggatagcgactgatatgtgtagctaggtgacatatgctcgtagtgtctacgtctattctactgtaatatatggtgtgctcacactgataaacctaggaagcaattgatatcatagctcagaccacacctatgtatccacatggttctttttttccggagtagtaagttacaatatggga

SEQ ID NO: 666965 - DNA, 314 bp, Homo sapiens
  misc_feature (9)..(9): n is a, c, g, or t
  misc_feature (62)..(62): n is a, c, g, or t
  misc_feature (91)..(91): n is a, c, g, or t
  misc_feature (98)..(98): n is a, c, g, or t
  misc_feature (100)..(100): n is a, c, g, or t
  misc_feature (131)..(131): n is a, c, g, or t
  misc_feature (133)..(133): n is a, c, g, or t
  misc_feature (141)..(141): n is a, c, g, or t
  misc_feature (158)..(158): n is a, c, g, or t
  misc_feature (187)..(187): n is a, c, g, or t
  misc_feature (196)..(196): n is a, c, g, or t
  misc_feature (224)..(224): n is a, c, g, or t
  misc_feature (252)..(252): n is a, c, g, or t
  misc_feature (295)..(295): n is a, c, g, or t
  misc_feature (309)..(309): n is a, c, g, or t
ctcgtgccntttatacttaaatatacatttcatggttgtatatttattctgcatccaagttncttttcatatcaaataacagcagcttggncatttgngntgcttgctcataactcggcagtaagcatttntnagcatgangttattctttggttganttttattcttgatatggggcttaggagtnagatttctngtctacagaaatgatcatgctcatgtanttttgacatttatcgtcatgatgctttncacaagggctgcaccaatttagatcatctttagcggtgaatgngtggattatttttnctaca

SEQ ID NO: 666966 - DNA, 278 bp, Homo sapiens
acagatgcaaagtgcactttgatggacgccgatgggtctgaagacgaggaaggatttggctacccagatacaatacttatccttccttctatagggaggtatgactgatagatggcgagaacgactaggctgaatttcttccaaagggaaacaagtggtcgggatcggggaggacttaatgcgtccgcctcaaaatagttcatttattcagcacttataatgggcactgtactacacatgtcacatgtacaaacactcatttatcataatgccatata

SEQ ID NO: 666967 - DNA, 753 bp, Homo sapiens
  misc_feature (539)..(539): n is a, c, g, or t
tgggtttttaaaattttttttaaaaaattgaaccccaggtggattaaaaccccaaaaatttctttgggcaaaattttattttgggccaaaaaaaaaagcccccaaaaaattaaaacgtcacgacccaaaccgcagtttgctctaaaaaaaacaaaaaacagacggggacgagctacctatagagccgagggcccatacaggagggcgggagggaggggacaacttgcaaagcggagtctcgaggccttcgactccgcgggcagtgataaaatctccagggggggggggggggagcgctaacatgtacccggaggcgggggggggtataacacccgaggggaggggcgtgacctcttataggggacagaatctacttctatattgtattattttttatatcttgttgtaccaacagatatcattaaaaagagtggttcaccagaaagcaacaactacataattggttgggtatatagaacgcaaagaaaacaaaaagagaatcgcacacagcggaaaggcgggcgcttgtggtcccaccncaggatatgcgcccgcatctggtaagagagcgtaaagtggaggtaccacaagggagggagtgcagcaaaccagcccccgctcccactgcggggcctgggagacaacagtcggtggggcaccacagtgcggcatgagagaggacaaatagtgatcgtgaagtcgagacggactcagagcatgtggtttgacgacaacaatgcggcgtcgtaatgg

SEQ ID NO: 666968 - DNA, 1409 bp, Homo sapiens
  misc_feature (517)..(517): n is a, c, g, or t
  misc_feature (543)..(543): n is a, c, g, or t
ctccctggagaagagctacgagctgcctgacggccatggtctatcacctattgtgcaatgagccggttccgctgccctgaggcactcttccagccttccttcctgggcatggagctcctgatggacatccacgacaactaccttcacactccatcactgaagtgtgacggtggacatccgcaaagacctgtacgccaacacagtgctgtctggcggcaccaccatgtaccctggcattgccgacaggcactgcaggaaggaggatcacctggccctggaccacccagtcacaatgaagtatcaagatcattgcttcctccttgagcgtcaagttactccgctggtggaatcgcgtcggctccaatcctggaccttcgcttgtccagcctgtccacgtcagattgttggatcagcaatgcaggtagctatgatcgagctccggactcccgtccattcggtccatccgcataatgtcttctagcgcggtactagtgacctttaggttgcgttagcaccnctttcattgatcataatgcgctagancttgctgcaggaccatcaaggactgagagttgtgctgtggtctcttctttgctttttgaggtggcgctcctagggtgtctttgctttggctctctgatgtgcggcggttagtgcactcagcggggttccataacattcaggcggacgagtgaccgggtcaacgagccatccttcgtgcgtgagggcagatgggaatcccccgtacagagtttccgcattgggtgggtgccccgagggactttgtgtagtgcccatctcgagatttgtggtgcccatccataatgagctacctttggcacagatatttgctctaccgcggttggtggttccgaggaaaagttgctttgtgcacttctcctttaaaaggccaccccccggatttctcttctttttaaggggaaagaatggggcccgagcctttctcccctaaaggtcccacacggggggcgcggggttcaactcgcccatgaggggttccccgcgggtaaaccattgttgtgtcttcgggccaaccacggttttttttaaacactcttaacgcgctataaccaaatcgttaaccaaattcagggggtgggacacttgagacaatgactagatcgccgtcgtttggtggggcccccccccttctccacctatttttttgtgccccccccccttgatccatgtttttgtacgccgttgatggcgcccccgcggaggaggtgttgatgcaccaggggtgtcactaggtcagcaggtgtgcacccgtgtaaatacagtggcgcctttgtgacagacagagcaccatgcaggtctctttcgtgcgtggcaagtgctgagataggcgctgcatcgatgtcagccaccctttgatgagagactgc

SEQ ID NO: 666969 - DNA, 579 bp, Homo sapiens
agaggatctattctgccacgatcggggggtggtgggatggggggagaagggtgtcaaacacttgcttctcaaggaagtaacatgtagactggaaacctgtaaggaagaacagaagttagcaaacacaatagtgactaaaaatcatagcactgatatccttgtctctggatgtgatggaaaaagctctcatggttgaactgtgaaatcacctacttttggtttcttttttaagagataggggtctcactctgtggcccaggctgaagtacagtggctcaattacagctcactgcagcctgcaagtcctggggctaaggctatcctcctgccttagcctcccaagtagctgggactacaggcgtgagcccctgtgcccagctcattaatgtatgggatatgtttcccctctgggcttattggacatcatattgggtgtctcatatggccttgtataatcattactggctcactagttcttctttaccttaaatgctagtatacctcgacggcttaatcctcctctttcctgtcccaatctaaatactatacctaaagagtcctccacttctatagttccaa

SEQ ID NO: 666970 - DNA, 2413 bp, Homo sapiens
ggcacgagggggccacacagcggacccctaagcggaccgctggcaccggtcgggtggcagcagagtgtcgctcgacatgggggaggccggggctggcgctggcgcctcgggagggccggaggcaagcccggaggcagaggtggtgaagctgctgcccttcctggcgccgggcgcgcgggcggacctgcaggcggcggcggtgcggcacgtgctggcgctgactggctgcggacccggccgcgcgctgttggcggggcaggcggcgctgctgcaggcgctgatggagctggcgccggcctctgccccggcccgggacgccgcccgcgcgctcgtgaacttggccgccgaccccggcctgcacgagacattgctggcggccgaccccgggctgccagcgcgcctgatgggccgcgcgttggacccgcagtggccctgggccgaggaggcggccgccgcgctagccaacctcagtcgcgagccggcgccgtgtgcagcgctcatggcggcgctggcggccgcggagccggcagactcgggcctggagcggctggtgcgcgcgctgtgcacgcccggctacaacgcccgcgcgcccctgcactacctagcgccgctgctctccaacctcagccaacgccctgcggcgcgggccttcctactggaccccgacaggtgcgtggtccagcggctgctgccccttacccagtaccccgactcctctgtacgcaggggcggggtggtggggacgctgcggaattgctgcttcgagcaccgacatcacgagtggttgcttggacctgaggtggacattctcccctttttgctcctgcccttggctgggcctgaggatttctccgaggaagagatggaacggctgcctgtcgacttgcagtacctgccaccagacaagcagcgagaacctgatgcagacatccgcaagatgcttgttgaagccatcatgctgctgacagccacagcaccaggtcggcagcaggtgcgggaccagggagcctacctgatccttcgagagctgcacagctgggagccggagcccgacgtgcggacggcttgtgagaagctcatccaggtgcttattggggacgagcctgaacgtggcatggaaaacctgctggaggtgcaggtgcctgaggatgtggagcagcagctgcagcagctggattgcagggagcaggagcagttggagcgggagctggccccagagccatgggtggagagggccacacccacctgaggcccctgcagccggacaccagctccagggtcccctttgccaggctttctcagaccaggccttcctgcagctgtctgcaggccccctgggtccccttgttcagagactgtgctcttctgagaagcagagctacgcttaggctccagtaaggattggaggcactttccagccctgtgcagtgttgctaccagcaagaatgaaggttgtgcagagcagtactgtgaggtaggcaccgtgactcggctgcctgtgcagaaggtggaggtggcaggcggatggccagggagccatgagaagactcttcctgggcacggcgtggggactggacagaaaaccactgcaagccccaaggagccagctgaagcctcccaatccccagggcactgcagagtctgggcagaggtgggcgcataggtacaagtgctgctttgtcagcctcactccctgcagctctcagctccctgttccctgagacctggcctcaaagggctgacccagccatacgtagatcctggggtctttctaggactgtgcctccctgcttgacctatgctccaggaccctgccctcaacccttgtcagctccctaagtcttcctgtttcccagtctcagattgagtgggtgctctcattggcctctctagctaggccgtctccctggtcagcttccttgagcctgggccactcctccctggccttcttacctctgccaagagcctccagatgtgcctgcagcctagtccctgcccaagcttctcccccagccaccctctgcccctgtggtagagcccactataggcccaggcgccttacgtgcttctcccctggacctatgtgcatccctcacctgccagttatgtggctgccaagccccacaggctgtcatggtggctcttgccacacttcccttcctgagctgacctgacctcactgccacctcttgcattgggatcctgagggctggcccctgctcactgatgggccctcccaggcccgtcaagccctggtgaaggagcttagcttgtcttcttggcaattcacaatgcctcactccacaccctaaaactggagcgtcccctatggtctcctgctgtggcttgggtgccgggcgtctcccgcctccaggatctcctctcacctgcccccattaaagctctgccactc

SEQ ID NO: 666971 - DNA, 2122 bp, Homo sapiens
ggcacgagggggccacacagcggacccctaagcggaccgctggcaccggtcgggtggcagcagagtgtcgctcgacatgggggaggccggggctggcgctggcgcctcgggagggccggaggcaagcccggaggcagaggtggtgaagctgctgcccttcctggcgcgcccctgcactacctagcgccgctgctctccaacctcagccaacgccctgcggcgcgggccttcctactggaccccgacaggtgcgtggtccagcggctgctgccccttacccagtaccccgactcctctgtacgcaggggcggggtggtggggacgctgcggaattgctgcttcgagcaccgacatcacgagtggttgcttggacctgaggtggacattctcccctttttgctcctgcccttggctgggcctgaggatttctccgaggaagagatggaacggctgcctgtcgacttgcagtacctgccaccagacaagcagcgagaacctgatgcagacatccgcaagatgcttgttgaagccatcatgctgctgacagccacagcaccaggtcggcagcaggtgcgggaccagggagcctacctgatccttcgagagctgcacagctgggagccggagcccgacgtgcggacggcttgtgagaagctcatccaggtgcttattggggacgagcctgaacgtggcatggaaaacctgctggaggtgcaggtgcctgaggatgtggagcagcagctgcagcagctggattgcagggagcaggagcagttggagcgggagctggccccagagccatgggtggagagggccacacccacctgaggcccctgcagccggacaccagctccagggtcccctttgccaggctttctcagaccaggccttcctgcagctgtctgcaggccccctgggtccccttgttcagagactgtgctcttctgagaagcagagctacgcttaggctccagtaaggattggaggcactttccagccctgtgcagtgttgctaccagcaagaatgaaggttgtgcagagcagtactgtgaggtaggcaccgtgactcggctgcctgtgcagaaggtggaggtggcaggcggatggccagggagccatgagaagactcttcctgggcacggcgtggggactggacagaaaaccactgcaagccccaaggagccagctgaagcctcccaatccccagggcactgcagagtctgggcagaggtgggcgcataggtacaagtgctgctttgtcagcctcactccctgcagctctcagctccctgttccctgagacctggcctcaaagggctgacccagccatacgtagatcctggggtctttctaggactgtgcctccctgcttgacctatgctccaggaccctgccctcaacccttgtcagctccctaagtcttcctgtttcccagtctcagattgagtgggtgctctcattggcctctctagctaggccgtctccctggtcagcttccttgagcctgggccactcctccctggccttcttacctctgccaagagcctccagatgtgcctgcagcctagtccctgcccaagcttctcccccagccaccctctgcccctgtggtagagcccactataggcccaggcgccttacgtgcttctcccctggacctatgtgcatccctcacctgccagttatgtggctgccaagccccacaggctgtcatggtggctcttgccacacttcccttcctgagctgacctgacctcactgccacctcttgcattgggatcctgagggctggcccctgctcactgatgggccctcccaggcccgtcaagccctggtgaaggagcttagcttgtcttcttggcaattcacaatgcctcactccacaccctaaaactggagcgtcccctatggtctcctgctgtggcttgggtgccgggcgtctcccgcctccaggatctcctctcacctgcccccattaaagctctgccactcatgcaggcatgtgtggaccatgttttcccctggccagagcccccacctgccactggaggccagttgccctcttagcactcagacatcagcactgtcttcacagaataaatgctttatctggccttgcccc

SEQ ID NO: 666972 - DNA, 329 bp, Homo sapiens
cgagtctcggtacccctctgaatgcactgggggaggtgcaggtgcctgaggatgtggagcagcagctgcagcagctggattgcagggagcaggagcagttggagcgggagctggccccagagccatgggtggagagggccacacccacctgaggcccctgcagccggacaccagctccagggtcccctttgccaggctttctcagaccaggccttcctgcagctgtctgcaggccccctgggtccccttgttcagagactgtgctcttctgagaagcagagctacgcttaggctctcacgtaatgacagagcagccaatatcaccacaa

SEQ ID NO: 666973 - DNA, 2738 bp, Homo sapiens
ggcacgagggggccacacagcggacccctaagcggaccgctggcaccggtcgggtggcagcagagtgtcgctcgacatgggggaggccggggctggcgctggcgcctcgggagggccggaggcaagcccggaggcagaggtggtgaagctgctgcccttcctggcgccgggcgcgcgggcggacctgcaggcggcggcggtgcggcacgtgctggcgctgactggctgcggacccggccgcgcgctgttggcggggcaggcggcgctgctgcaggcgctgatggagctggcgccggcctctgccccggcccgggacgccgcccgcgcgctcgtgaacttggccgccgaccccggcctgcacgagacattgctggcggccgaccccgggctgccagcgcgcctgatgggccgcgcgttggacccgcagtggccctgggccgaggaggcggccgccgcgctagccaacctcagtcgcgagccggcgccgtgtgcagcgctcatggcggcgctggcggccgcggagccggcagactcgggcctggagcggctggtgcgcgcgctgtgcacgcccggctacaacgcccgcgcgcccctgcactacctagcgccgctgctctccaacctcagccaacgccctgcggcgcgggccttcctactggaccccgacaggtgcgtggtccagcggctgctgccccttacccagtaccccgactcctctgtacgcaggggcggggtggtggggacgctgcggaattgctgcttcgagcaccgacatcacgagtggttgcttggacctgaggtggacattctcccctttttgctcctgcccttggctgggcctgaggatttctccgaggaagagatggaacgtgagtggctagtgtggagcctcagagttggccggagaggagggaggccagtggagggagagagaggtgtccaggccacaggctcctgaaactttgcagcagtgagttgctgagcacaggtgggacttacacaggcagagcctggctcagctgcccagcccagggacacagtggctcccacacactcacccctagggctgcctgtcgacttgcagtacctgccaccagacaagcagcgagaacctgatgcagacatccgcaagatgcttgttgaagccatcatgctgctgacagccacagcaccaggtcggcagcaggtgcgggaccagggagcctacctgatccttcgagagctgcacagctgggagccggagcccgacgtgcggacggcttgtgagaagctcatccaggtgcttattggggacgagcctgaacgtggcatggaaaacctgctggaggtgcaggtgcctgaggatgtggagcagcagctgcagcagctggattgcagggagcaggagcagttggagcgggagctggccccagagccatgggtggagagggccacacccacctgaggcccctgcagccggacaccagctccagggtcccctttgccaggctttctcagaccaggccttcctgcagctgtctgcaggccccctgggtccccttgttcagagactgtgctcttctgagaagcagagctacgcttaggctccagtaaggattggaggcactttccagccctgtgcagtgttgctaccagcaagaatgaaggttgtgcagagcagtactgtgaggtaggcaccgtgactcggctgcctgtgcagaaggtggaggtggcaggcggatggccagggagccatgagaagactcttcctgggcacggcgtggggactggacagaaaaccactgcaagccccaaggagccagctgaagcctcccaatccccagggcactgcagagtctgggcagaggtgggcgcataggtacaagtgctgctttgtcagcctcactccctgcagctctcagctccctgttccctgagacctggcctcaaagggctgacccagccatacgtagatcctggggtctttctaggactgtgcctccctgcttgacctatgctccaggaccctgccctcaacccttgtcagctccctaagtcttcctgtttcccagtctcagattgagtgggtgctctcattggcctctctagctaggccgtctccctggtcagcttccttgagcctgggccactcctccctggccttcttacctctgccaagagcctccagatgtgcctgcagcctagtccctgcccaagcttctcccccagccaccctctgcccctgtggtagagcccactataggcccaggcgccttacgtgcttctcccctggacctatgtgcatccctcacctgccagttatgtggctgccaagccccacaggctgtcatggtggctcttgccacacttcccttcctgagctgacctgacctcactgccacctcttgcattgggatcctgagggctggcccctgctcactgatgggccctcccaggcccgtcaagccctggtgaaggagcttagcttgtcttcttggcaattcacaatgcctcactccacaccctaaaactggagcgtcccctatggtctcctgctgtggcttgggtgccgggcgtctcccgcctccaggatctcctctcacctgcccccattaaagctctgccactcatgcaggcatgtgtggaccatgttttcccctggccagagcccccacctgccactggaggccagttgccctcttagcactcagacatcagcactgtcttcacagaataaatgctttatctggccttgcccc

SEQ ID NO: 666974 - DNA, 680 bp, Homo sapiens
agcgggggtggactccgtcttctcacagcgggcgcaggatgggtaggggcgggggggcggcagcgagggacgccgctccgcacaggtttcaagaggacgagtgcggggcgcccggcgaaggccgggaacaggtggaggcgggggcagggggcggggcggcgagctgcatcagtcatgctcttaaagggactgccagagagctgaagaaggaggcggcggggcgagccacccaggaaaatgggcttgacgaggcggcccgggagatgagatcaccggcaggaagtcatgtcattcaggacacgggctttctgtgaagatctcgcccctggatcgagcccttctccctgaggtgtccccccaggagatggtgcaggagattcacaggtgtcatggaccggaggacacgtgtcaccgcacctgttctcactgacctggattggaacgtgctggaccacttctcggagctgcgcaggtcgaggggctgcaggagggctctgtgctgcgtgtggtgcaagagccgtacacggtgcgtgaggcccgcatccacgtgcgccatgtcccgagacctgttcaagagctggaccatccgatgcctcaacggggtgatgcaactccttgtctcctgagtgtcttcacgacgggcctggagacacggggaagcggaacaaaggttgcacatg

SEQ ID NO: 666975 - DNA, 241 bp, Homo sapiens
  misc_feature (169)..(169): n is a, c, g, or t
  misc_feature (209)..(209): n is a, c, g, or t
  misc_feature (219)..(219): n is a, c, g, or t
gaggcgttggatagtgaagatatataaaaaacacagagaaattaaactagcgggaaagaacatcaatataagctgtccgtcactgcctatgactgtgggaagaaaagagccacagaagatgttctggtgaagatcagcattaagcccacctgcaccccatgggtggcanaggatggaacaacagtgattgagtatgagcctgggcaccnggcgcgtttnggccgtctgttccagaatatcc

SEQ ID NO: 666976 - DNA, 2637 bp, Homo sapiens
ggcacgagggggccacacagcggacccctaagcggaccgctggcaccggtcgggtggcagcagagtgtcgctcgacatgggggaggccggggctggcgctggcgcctcgggagggccggaggcaagcccggaggcagaggtggtgaagctgctgcccttcctggcgccgggcgcgcgggcggacctgcaggcggcggcggtgcggcacgtgctggcgctgactggctgcggacccggccgcgcgctgttggcggggcaggcggcgctgctgcaggcgctgatggagctggcgccggcctctgccccggcccgggacgccgcccgcgcgctcgtgaacttggccgccgaccccggcctgcacgagacattgctggcggccgaccccgggctgccagcgcgcctgatgggccgcgcgttggacccgcagtggccctgggccgaggaggcggccgccgcgctagccaacctcagtcgcgagccggcgccgtgtgcagcgctcatggcggcgctggcggccgcggagccggcagactcgggcctggagcggctggtgcgcgcgctgtgcacgcccggctacaacgcccgcgcgcccctgcactacctagcgccgctgctctccaacctcagccaacgccctgcggcgcgggccttcctactggaccccgacaggacatcacgagtggttgcttggacctgaggtggacattctcccctttttgctcctgcccttggctgggcctgaggatttctccgaggaagagatggaacgtgagtggctagtgtggagcctcagagttggccggagaggagggaggccagtggagggagagagaggtgtccaggccacaggctcctgaaactttgcagcagtgagttgctgagcacaggtgggacttacacaggcagagcctggctcagctgcccagcccagggacacagtggctcccacacactcacccctagggctgcctgtcgacttgcagtacctgccaccagacaagcagcgagaacctgatgcagacatccgcaagatgcttgttgaagccatcatgctgctgacagccacagcaccaggtcggcagcaggtgcgggaccagggagcctacctgatccttcgagagctgcacagctgggagccggagcccgacgtgcggacggcttgtgagaagctcatccaggtgcttattggggacgagcctgaacgtggcatggaaaacctgctggaggtgcaggtgcctgaggatgtggagcagcagctgcagcagctggattgcagggagcaggagcagttggagcgggagctggccccagagccatgggtggagagggccacacccacctgaggcccctgcagccggacaccagctccagggtcccctttgccaggctttctcagaccaggccttcctgcagctgtctgcaggccccctgggtccccttgttcagagactgtgctcttctgagaagcagagctacgcttaggctccagtaaggattggaggcactttccagccctgtgcagtgttgctaccagcaagaatgaaggttgtgcagagcagtactgtgaggtaggcaccgtgactcggctgcctgtgcagaaggtggaggtggcaggcggatggccagggagccatgagaagactcttcctgggcacggcgtggggactggacagaaaaccactgcaagccccaaggagccagctgaagcctcccaatccccagggcactgcagagtctgggcagaggtgggcgcataggtacaagtgctgctttgtcagcctcactccctgcagctctcagctccctgttccctgagacctggcctcaaagggctgacccagccatacgtagatcctggggtctttctaggactgtgcctccctgcttgacctatgctccaggaccctgccctcaacccttgtcagctccctaagtcttcctgtttcccagtctcagattgagtgggtgctctcattggcctctctagctaggccgtctccctggtcagcttccttgagcctgggccactcctccctggccttcttacctctgccaagagcctccagatgtgcctgcagcctagtccctgcccaagcttctcccccagccaccctctgcccctgtggtagagcccactataggcccaggcgccttacgtgcttctcccctggacctatgtgcatccctcacctgccagttatgtggctgccaagccccacaggctgtcatggtggctcttgccacacttcccttcctgagctgacctgacctcactgccacctcttgcattgggatcctgagggctggcccctgctcactgatgggccctcccaggcccgtcaagccctggtgaaggagcttagcttgtcttcttggcaattcacaatgcctcactccacaccctaaaactggagcgtcccctatggtctcctgctgtggcttgggtgccgggcgtctcccgcctccaggatctcctctcacctgcccccattaaagctctgccactcatgcaggcatgtgtggaccatgttttcccctggccagagcccccacctgccactggaggccagttgccctcttagcactcagacatcagcactgtcttcacagaataaatgctttatctggccttgcccc

SEQ ID NO: 666977 - DNA, 2824 bp, Homo sapiens
ggcacgagggggccacacagcggacccctaagcggaccgctggcaccggtcgggtggcagcagagtgtcgctcgacatgggggaggccggggctggcgctggcgcctcgggagggccggaggcaagcccggaggcagaggtggtgaagctgctgcccttcctggcgccgggcgcgcgggcggacctgcaggcggcggcggtgcggcacgtgctggcgctgactggctgcggacccggccgcgcgctgttggcggggcaggcggcgctgctgcaggcgctgatggagctggcgccggcctctgccccggcccgggacgccgcccgcgcgctcgtgaacttggccgccgaccccggcctgcacgagacattgctggcggccgaccccgggctgccagcgcgcctgatgggccgcgcgttggacccgcagtggccctgggccgaggaggcggccgccgcgctagccaacctcagtcgcgagccggcgccgtgtgcagcgctcatggcggcgctggcggccgcggagccggcagactcgggcctggagcggctggtgcgcgcgctgtgcacgcccggctacaacgcccgcgcgcccctgcactacctagcgccgctgctctccaacctcagccaacgccctgcggcgcgggccttcctactggaccccgacaggtgcgtggtccagcggctgctgccccttacccagtaccccgactcctctgtacgcaggggcggggtggtggggacgctgcggaattgctgcttcgagcaccgacatcacgagtggttgcttggacctgaggtggacattctcccctttttgctcctgcccttggctgggcctgaggatttctccgaggaagagatggaacgtgagtggctagtgtggagcctcagagttggccggagaggagggaggccagtggagggagagagaggtgtccaggccacaggctcctgaaactttgcagcagtgagttgctgagcacaggtgggacttacacaggcagagcctggctcagctgcccagcccagggacacagtggctcccacacactcacccctagggctgcctgtcgacttgcagtacctgccaccagacaagcagcgagaacctgatgcagacatccgcaagatgcttgttgaagccatcatgctggtgagcaggagccctgctgcaataagcaccaccccaacacacacacatgagcatgctgacatctgggtcctcttccacctcctcagctgacagccacagcaccaggtcggcagcaggtgcgggaccagggagcctacctgatccttcgagagctgcacagctgggagccggagcccgacgtgcggacggcttgtgagaagctcatccaggtgcttattggggacgagcctgaacgtggcatggaaaacctgctggaggtgcaggtgcctgaggatgtggagcagcagctgcagcagctggattgcagggagcaggagcagttggagcgggagctggccccagagccatgggtggagagggccacacccacctgaggcccctgcagccggacaccagctccagggtcccctttgccaggctttctcagaccaggccttcctgcagctgtctgcaggccccctgggtccccttgttcagagactgtgctcttctgagaagcagagctacgcttaggctccagtaaggattggaggcactttccagccctgtgcagtgttgctaccagcaagaatgaaggttgtgcagagcagtactgtgaggtaggcaccgtgactcggctgcctgtgcagaaggtggaggtggcaggcggatggccagggagccatgagaagactcttcctgggcacggcgtggggactggacagaaaaccactgcaagccccaaggagccagctgaagcctcccaatccccagggcactgcagagtctgggcagaggtgggcgcataggtacaagtgctgctttgtcagcctcactccctgcagctctcagctccctgttccctgagacctggcctcaaagggctgacccagccatacgtagatcctggggtctttctaggactgtgcctccctgcttgacctatgctccaggaccctgccctcaacccttgtcagctccctaagtcttcctgtttcccagtctcagattgagtgggtgctctcattggcctctctagctaggccgtctccctggtcagcttccttgagcctgggccactcctccctggccttcttacctctgccaagagcctccagatgtgcctgcagcctagtccctgcccaagcttctcccccagccaccctctgcccctgtggtagagcccactataggcccaggcgccttacgtgcttctcccctggacctatgtgcatccctcacctgccagttatgtggctgccaagccccacaggctgtcatggtggctcttgccacacttcccttcctgagctgacctgacctcactgccacctcttgcattgggatcctgagggctggcccctgctcactgatgggccctcccaggcccgtcaagccctggtgaaggagcttagcttgtcttcttggcaattcacaatgcctcactccacaccctaaaactggagcgtcccctatggtctcctgctgtggcttgggtgccgggcgtctcccgcctccaggatctcctctcacctgcccccattaaagctctgccactcatgcaggcatgtgtggaccatgttttcccctggccagagcccccacctgccactggaggccagttgccctcttagcactcagacatcagcactgtcttcacagaataaatgctttatctggccttgcccc

SEQ ID NO: 666978 - DNA, 1589 bp, Homo sapiens
ggcacgagggggccacacagcggacccctaagcggaccgctggcaccggtcgggtggcagcagagtgtcgctcgacatgggggaggccggggctggcgctggcgcctcgggagggccggaggcaagcccggaggcagaggtggtgaagctgctgcccttcctggcgccgggcgcgcgggcggacctgcaggcggcggcggtgcggcacgtgctggcgctgactggctgcggacccggccgcgcgctgttggcggggcaggcggcgctgctgcaggcgctgatggagctggcgccggcctctgccccggcccgggacgccgcccgcgcgctcgtgaacttggccgccgaccccggcctgcacgagacattgctggcggccgaccccgggctgccagcgcgcctgatgggccgcgcgttggacccgcagtggccctgggccgaggaggcggccgccgcgctagccaacctcagtcgcgagccggcgccgtgtgcagcgctcatggcggcgctggcggccgcggagccggcagactcgggcctggagcggctggtgcgcgcgctgtgcacgcccggctacaacgcccgcgcgcccctgcactacctagcgccgctgctctccaacctcagccaacgccctgcggcgcgggccttcctactggaccccgacaggtgcgtggtccagcggctgctgccccttacccagtaccccgactcctctgtacgcaggggcggggtggtggggacgctgcggaattgctgcttcgagcaccgacatcacgagtggttgcttggacctgaggtggacattctcccctttttgctcctgcccttggctgggcctgaggatttctccgaggaagagatggaacggctgcctgtcgacttgcagtacctgccaccagacaagcagcgagaacctgatgcagacatccgcaagatgcttgttgaagccatcatgctgctgacagccacagcaccaggtcggcagcaggtgcgggaccagggagcctacctgatccttcgagagctgcacagctgggagccggagcccgacgtgcggacggcttgtgagaagctcatccaggtgcttattggggacgagcctgaacgtggcatggaaaacctgctggaggtgcaggtgcctgaggatgtggagcagcagctgcagcagctggattgcagggagcaggagcagttggagcgggagctggccccagagccatgggtggagagggccacacccacctgaggcccctgggcccctgctcactgatgggccctcccaggcccgtcaagccctggtgaaggagcttagcttgtcttcttggcaattcacaatgcctcactccacaccctaaaactggagcgtcccctatggtctcctgctgtggcttgggtgccgggcgtctcccgcctccaggatctcctctcacctgcccccattaaagctctgccactcatgcaggcatgtgtggaccatgttttcccctggccagagcccccacctgccactggaggccagttgccctcttagcactcagacatcagcactgtcttcacagaataaatgctttatctggccttgcccc

SEQ ID NO: 666979 - DNA, 144 bp, Homo sapiens
cagtggaatggcaggcttacatcactagtttagcattagtttaggtggtgagtatgatctattaggagacagagaggcaagtaacaggtgtgcatcagggagggttgttttatttttccagaagtgagaaaagggagcatggga

SEQ ID NO: 666980 - DNA, 880 bp, Homo sapiens
ggcacgagggggccacacagcggacccctaagcggaccgctggcaccggtcgggtggcagcagagtgtcgctcgacatgggggaggccggggctggcgctggcgcctcgggagggccggaggcaagcccggaggcagaggtggtgaagctgctgcccttcctggcgccgggcgcgcgggcggacctgcaggcggcggcggtgcggcacgtgctggcgctgactggctgcggacccggccgcgcgctgttggcggggcaggcggcgctgctgcaggcgctgatggagctggcgccggcctctgccccggcccgggacgccgcccgcgcgctcgtgaacttggccgccgaccccggcctgcacgagacattgctggcggccgaccccgggctgccagcgcgcctgatgggccgcgcgttggacccgcagtggccctgggccgaggaggcggccgccgcgctagccaacctcagtcgcgagccggcgccgtgtgcagcgctcatggcggcgctggcggccgcggagccggcagactcgggcctggagcggctggtgcgcgcgctgtgcacgcccggctacaacgcccgcgcgcccctgcactacctagcgccgctgctctccaacctcagccaacgccctgcggcgcgggccttcctactggaccccgacaggtgaagcccagggcgcccgcgcgggcggggaggggacggaagttaggggggacggccctaagtgacacctcccaacaggtgcgtggtccagcggctgctgccccttacccagtaccccgactcctctgtacgcaggggcggggtggtggggacgctgcggaattgctgcttcgagcaccgtgagtggtgggtgtggcgggggtgcgttgcc

SEQ ID NO: 666981 - DNA, 734 bp, Homo sapiens
tgttcgttctctaggctctctagttcgccttcaccatgccggtaagctgcgaagtccgctcccggcccaagaagggctcgaataaagccgtgactaaggcgcggaagaaggacggaagaagcgcaagcggcagcctagctcggaagagctattgtccgatagtacggtgtacacaggtgctgcacggaggtccatcctcgacattcctgggatcatctcggtcataatgagctcaatggcaattcagtgaactcacttcgctcgacgagcattcttcgaatcggcagtcgccgggtgatgggcttcctctagcctggccggcagttaccgaacaatgcagctcgagcgatcgactctccgagggaggatccagcactggtcggtgcgccgtggtagttagcccgagggacgcttcggccgatacggcacggcgcgtgtccggacgggcaccaaggtccgtcacgcagagtacgatccaagtgcgtaaagtagagcgtatgctcaaggatggagacttttctcgtgtgtgttccctgagtgtgacccttagtaaagcgtacttatcaataggaatagcgcaatttggccttcggtttacccgcatttatctactggcggaaaatgaagaacgtgactgcaatgcgatacctagatggacttattagcagaaggcttaaggttggccttcatggattctcatgcggattccaaagagaattcatttcctgatgctc

SEQ ID NO: 666982 - DNA, 389 bp, Homo sapiens
gacggagttttgctcttgttgcccaggccggagtggagtggtgcggtctcggctcactgcagcctccgcctcccgggttggggcgattctcctgcctcggcctcccgggtggctgggattgcaggcatgagccaccacgcctggctagtttgtatttctggtggagatgaggtttctccgtgttggtcgggctggtctcgggctcccgacctcgggtgatccacccgcctcggcctcccggggtggtgggattgcaggcgtgagccaccgtgccgagccttccttgaagtttttgttggtttgattgtttgtttgtttgtttgtatgttttggggatggggtctcgctctgttgcccatgctggagtgcagtggcacggtcttggctcg

SEQ ID NO: 666983 - DNA, 771 bp, Homo sapiens
cctgtagctggcgctgagttggcgcccgtgagcggattgtaagctgctggttttgcggctgggaagagcggcgagagcggttcggccatccgttcgtcgggatccccgtcgaagggatgatcgtgcgtgccatgaagagtcgtcacccgggcatggggtgacagcgttccatgccttccctcgagactgaacggaatctgggatcgtcagcaactctgcggcagcgcagcgagactttggggtcatgccagagagaaaacgcaaaagtacctttgaaggactttattgggtgcgatccgaaatgacaagaaccttactggccgtctttgttactacggagaatcacaaaattcaaccatctcactttccgcaaccgtggcgcacagcaacgcacacagcaacaatttcactgaaccgcaacctggcacgtctccaatctatcaggcaaacgctatgcggaccagtcaacattcactcaggaccggattcatcggcgcacccatcgtggcgccttgcgctttcagccgacaggtagaacaggacccactgcatgggaggaaaggtggaattgttgggctcggacgcatgcattgatggactgacgacatgcatgattctcacccttgcaccccttggcacacgtccaacgcttggactccttgaaaagccgattccccagcatctccacgcacaaatcgatgcaattctccctggaagaacattccaagcgttcgttggaagcccctgattgacagtcggagatcccaaaaa

SEQ ID NO: 666984 - DNA, 248 bp, Homo sapiens
acggaagttcagggacaaaatcagttgaggctgttccccctgagcctaagcttcctttgctgtatgtcgggaatcaggtgggggccaagcgagatccccccagtgcaggccagtgtgcagggcccaggtgggcgccagggaggggaccccgcccagccccatgctttcgccaaaaacgggcagcccaatttggaaaaaaacatttccctctgttaataaaaagcaccggcctctggtcataagtgcca

SEQ ID NO: 666985 - DNA, 319 bp, Homo sapiens
gtcagaccacgagcatgttgagaaggggctgctcaacaccctagccttgttactgagaagagtgaaacatgttaactcttactggtttaactcatacactcaatgcctagataatatcaaacatgttaccctggacagcctgtcacttaacttttctgatctgggatcagaaatgctgaccagatgccactaagttgactaaatagaatttgtagttatttttcacatggtaaagcatcatcacttctaggcacaacaaggctgctcacataagcaggaacctatgtgaaagcacatagcttttttttttttgtcgacg

SEQ ID NO: 666986 - DNA, 178 bp, Homo sapiens
ttaaaccagtgtcagtgggtcatagggtccttttttaaaaaatttgagacagagtctcattgtgtcacccaggctggagtgcagtggcacaatcacggctcactgcagcctcgacctccctgggctcaggtgattctcccacctcagcctcctgaatagctgggaccacaggcatgcg

SEQ ID NO: 666987 - DNA, 397 bp, Homo sapiens
  misc_feature (83)..(83): n is a, c, g, or t
  misc_feature (365)..(365): n is a, c, g, or t
  misc_feature (384)..(384): n is a, c, g, or t
  misc_feature (394)..(394): n is a, c, g, or t
agacgagccatgatacctgttcttaaaaacactctcagagctgtcacatgtgctagatagttctccacagagaagaccttggnttcaggatgtcaggcaaacctcctgactcaagcactgaaataaacacaaatcaccattatgaagtcaaatctataaacaagcttggaaaccaatccaaaatccctcagatccacacctatacactcagtgactcatgtctatgagccatggtgaccatgcccagggttggggtcagaagaatcaggggaagtgcaatagcaacggggactcttccacagccttttttgagggttcttcaagtcctggctaactctggcattcattttatggatggctattgngggaattacaaagaggagntttcaaattnagc

SEQ ID NO: 666988 - DNA, 164 bp, Homo sapiens
ggtgcttcgatggatcccgtcggattgctggattcggacggcttgacgaccaggggcgtttggtttgggttctggccggggttttctttgatcattgttgtgattggaattgatggcgcctccgagagagcgtcgggtaccgcgctcgccttcgtcctcctggt

SEQ ID NO: 666989 - DNA, 222 bp, Homo sapiens
taaaggcactagtcactatagtggcatctccgggttctggtactggtatttaatacgcaagggtacatggctttaattatttaaatggtttggtggctattaattattttacagtttggtttaaccactttggctggctaaaattttggccatcccgttcccattttttcctttacaattttaaactatttctcttcattaaaacactatgtgattaatgtg

SEQ ID NO: 666990 - DNA, 131 bp, Homo sapiens
  misc_feature (48)..(48): n is a, c, g, or t
  misc_feature (90)..(90): n is a, c, g, or t
aggatgaggcccggaagaagaaggctttgtccaacatgatgcattttnggggttacatccagaagcaggcccagacagagcggaaaagtnggaagaggcagacttagcgggaaaaagaagaagaagattct

SEQ ID NO: 666991 - DNA, 106 bp, Homo sapiens
atgcatactggtgcacatgcagttgccgtgttctggaaggccctcatagcactgtcgccacctagcacttttggcaattgcagcggcctgttgcagtgtgcttccg

SEQ ID NO: 666992 - DNA, 265 bp, Homo sapiens
cccgggggtttttttttaagggggggcccccttgaaaattttgggggccaaaaaatgggggccccccgggggggggggggggtttttttaaaaaaccccccggggggccctttttttttttttcccccgcggggggccccccagggggggcccttttcccccccggggggggggtttttcccccccccttttttttttttttttttttttgggccccccccccccccgccggggggcccttaccctttggggtttccacccccca

SEQ ID NO: 666993 - DNA, 227 bp, Homo sapiens
tcacgatgatcatgaccgccaacaggtccccagatgcccacaaagacggtgtgcactatgcgaaggttcatcaggatccgtcccatcaccacggagccagcgggattcctcctcctctgactccccagcacaatcaggtagttgctgccctggctgtggatcttccggccactcagtaactcggcctcaaactggttgggcgtgataatgtctgcaaggaacccacg

SEQ ID NO: 666994 - DNA, 883 bp, Homo sapiens
ctctactcaggagtgcacgaagttcaaggtcagcagactgccgggaatgcatctgagtcggggcccgggtgcacctgtgtgccagaatgctgaacttcacagggtcgggggatactgactccatatacgctgcagacgacgccggccacatgctgctcatgatggggcatgtgcgtgctgacgacatcatggaccccgacaatgcctcgctgaaacccatgtggaagaccacaagttggtgtggccagaagcggctagtccccagaaaaatgtgactgcatttacctggcgagcaggccagtgcagcagctgtacacacgtgagcttccgtgcggtgccaagtgtgctaccccatcgaccgtgtactatctgatggacctctacctagctccatgacttgatgacctcaggaatgtcaagaatggctaggtggcgagctgttccgtggccctcaacgagatcaccgagatccggacgcgaattggcagacgtgggtccttcgaggacaagaccgtgcctgccgttcgtagaacagcgcacccatgaatatagcgtgcgatgactccatgccacagcaggggggcaatgagttgccagagcacccgatattggcttcagtgcacgtgcttgaagcttgacaacaactcacatagcacgtatcagacccgaggtcggaggagcagctgaattcgcggaacctggataagaccgaaggtagtctggacgccatgatgcaggtcgtcgctgaccgaacggaaatcgaatgggacaaacgcggtagcggtgttgccacggataaggaacaacgcggaaagaaatgggcactaccaaaaggcaggaccggagaacgaaacagagcaagaacgacaggaccaggcaatac

SEQ ID NO: 666995 - DNA, 262 bp, Homo sapiens
tatctcttatttcttttctttactttttttttggtttatgacgacagagacttgctctgtcacccagtctgggtatagcatgcctgttctcagtacagagcaacctctgcctcctgggttcgaacaattctcttgcctcaacttcctgagtacctgggattataggcatgcgccaccttgtccggctaatttggtatttttagtagagacggggactcaaactcccgacctcaactcatccgcccgcctcggcctccctaag

SEQ ID NO: 666996 - DNA, 489 bp, Homo sapiens
  misc_feature (81)..(83): n is a, c, g, or t
  misc_feature (88)..(88): n is a, c, g, or t
gcggccgccgcgcccactgccgccccgacccttctccccccgccgccgcccccacgcgggactcccccggggagggggaannncggcngcggggcgagtctgggacgcgccgccgccatgatcatccctgtacgctgcttcacttgtggcaagatcgtcggcaacaagtgggaggcttacctggggctgctgcaggccgagtacaccgagggggacgcgctggatgccctgggcctgaagcgctactgctgccgccggatgctgctggcccacgtggacctgatcgagaagctgctcaattatgcacccctggagaagtgaccacgctgaaacccacccacccgctgtgctgaccatgggccctgagcgtcctaccccgaattcacgaggctgaggcatccgggagctggcgtaatgcctggccgcagtgtgtgtgtatcccataccccactctggaaggaaccatccagtaaaggtctttcagaacca

SEQ ID NO: 666997 - DNA, 1084 bp, Homo sapiens
  misc_feature (194)..(194): n is a, c, g, or t
  misc_feature (388)..(388): n is a, c, g, or t
  misc_feature (430)..(430): n is a, c, g, or t
  misc_feature (464)..(464): n is a, c, g, or t
  misc_feature (583)..(583): n is a, c, g, or t
  misc_feature (607)..(607): n is a, c, g, or t
  misc_feature (623)..(623): n is a, c, g, or t
  misc_feature (629)..(629): n is a, c, g, or t
  misc_feature (635)..(635): n is a, c, g, or t
  misc_feature (647)..(647): n is a, c, g, or t
  misc_feature (659)..(659): n is a, c, g, or t
  misc_feature (690)..(690): n is a, c, g, or t
  misc_feature (701)..(701): n is a, c, g, or t
  misc_feature (708)..(709): n is a, c, g, or t
  misc_feature (711)..(711): n is a, c, g, or t
  misc_feature (713)..(713): n is a, c, g, or t
  misc_feature (726)..(726): n is a, c, g, or t
  misc_feature (728)..(728): n is a, c, g, or t
  misc_feature (734)..(734): n is a, c, g, or t
  misc_feature (737)..(737): n is a, c, g, or t
  misc_feature (742)..(742): n is a, c, g, or t
  misc_feature (750)..(750): n is a, c, g, or t
  misc_feature (773)..(773): n is a, c, g, or t
  misc_feature (782)..(782): n is a, c, g, or t
  misc_feature (785)..(786): n is a, c, g, or t
  misc_feature (793)..(793): n is a, c, g, or t
  misc_feature (811)..(811): n is a, c, g, or t
  misc_feature (939)..(939): n is a, c, g, or t
  misc_feature (945)..(945): n is a, c, g, or t
  misc_feature (956)..(956): n is a, c, g, or t
  misc_feature (964)..(964): n is a, c, g, or t
  misc_feature (986)..(986): n is a, c, g, or t
  misc_feature (994)..(994): n is a, c, g, or t
  misc_feature (1003)..(1003): n is a, c, g, or t
  misc_feature (1012)..(1012): n is a, c, g, or t
  misc_feature (1014)..(1014): n is a, c, g, or t
  misc_feature (1020)..(1021): n is a, c, g, or t
  misc_feature (1068)..(1068): n is a, c, g, or t
tgacttcagtctctttgatgtggtccttaagatgaggaagcagcggcctgcggccgtgcgggcagaggagcagtacaggttcctgtaccacacggtggctcagatgttctgctccacactccagaatgccagcccccactaccagaacatcaaagagaattgtgccccactctacgacgatgccctcttcctcncggactccccaggcacttctcggccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaanggaggcgccgctctacagcaaggtgacgctcgcgcgcccagngacccggggcgcacgcgggaggacgcgagggggnacgctgcctggccgcgttcctgctgaccaaagtcctgccggatctggcgcctacgaggacgtggcgggtggagctcagaccggtgggctaggtttcaacctgcgcattgggaggccgangggtccccgggacccgcctgctgngtggacccgggtgtangtctancgccanttcctgcctgtngcctcttgtganctcggactgctgatgccccggtgctgctgancgccgtgcgcngaatggnnanantgggcctgatcananttaaanttnctcanggtggganatgtgggggctttgcccaatgantgtagcatncanngcttgangctggaggaggtagctanggtatagtggctggtgaggctgcacagagcagattcaacaaagaagatcaggaaggggcatgacccctgagttatgaaggggagaagggacagatgagcttccggagagtgctctcctcaccacacancactantccatcctcancacctgancctccctcacttggacactcangggaacanacagagaantggatggananttcgcnnccaagcaaaataaaccaggcataaccacagccaagcagattaacccnggcagaccgataaaaa

SEQ ID NO: 666998 - DNA, 343 bp, Homo sapiens
atccttccttctttcacgagtaatttgaataaactgagttggtcctcttcacctgaaaaacaccaggggtgtttaatgaccatgacaaagcagcatgaattatggaaggagcaccccaagctgctcccatttccctatgtgaactcaaacaagaacctgcgctcctctgtggctttactttagctatatgcacacagaaagggctctatcacatccacttgtgggatattattcctatgaaaaactgagttacctgataccacaccatatacactttattaagttctggaaacaacctattaatagatcattctatccatctgagttcaattgtggggcacag

SEQ ID NO: 666999 - DNA, 910 bp, Homo sapiens
ctcatggaactcgcctgcagctgcttgggttagtggtggcttccttcgttattggagccaggtctatagcccagcaagcatgttccaagggatgcgtgctacgatatgtgtattgatctgtggtcagacactctacatcttggtgtgggtgtcttgcgcagtcgaacggaagaagttcgacgataatttgccataatgattcagaggagagatcgagaccatctccaacagactattgatcgaccgtttacgtgactacttggaacgggttagatccggttgactgcacgcaaatagacatcagagtttgcatatagaatgccctacactaacaacagtttatgagattgcccaaacgtgatctgatgtggaactgcagagtattgatgactgctagttgtccgagtctggactactgaacacgatggggcccatttagtggctggtgacatgagtgctcggcatggcccaagggtccaacgtaagaagtacagagggacgagaacagaaggctttctatctcagagcgagggtgtacttcctacttggttctggacatactgatgaccggaaattgcgagaacgcctaccttgggaaatgacgtgttaccgaaatgcgtgtggtcacaggtgccagcttacttttactgacctctcagcgtcaggctaccacagatgcttggtaacctagttgctgggtctcgacgtggatccttttaacgaaaactcacttcaagtggaggcccacaacatgggctggccttgggtatttgcgtgtgacggggcttcagaaccacaagagcgggtggacgccaggacacaggcaaagggtgcgccatccttggacccagggggacaggcttggcacccatgtctggaccgtgtgtcacatgctcactatttggaggga

SEQ ID NO: 667000 - DNA, 443 bp, Homo sapiens
  misc_feature (4)..(4): n is a, c, g, or t
  misc_feature (108)..(108): n is a, c, g, or t
  misc_feature (121)..(121): n is a, c, g, or t
  misc_feature (158)..(158): n is a, c, g, or t
  misc_feature (212)..(212): n is a, c, g, or t
  misc_feature (221)..(221): n is a, c, g, or t
  misc_feature (225)..(225): n is a, c, g, or t
  misc_feature (229)..(229): n is a, c, g, or t
  misc_feature (246)..(246): n is a, c, g, or t
  misc_feature (257)..(257): n is a, c, g, or t
  misc_feature (273)..(273): n is a, c, g, or t
  misc_feature (294)..(294): n is a, c, g, or t
  misc_feature (323)..(323): n is a, c, g, or t
  misc_feature (349)..(349): n is a, c, g, or t
  misc_feature (357)..(357): n is a, c, g, or t
  misc_feature (378)..(378): n is a, c, g, or t
  misc_feature (443)..(443): n is a, c, g, or t
agtnagggaatgagaagtagaggggagatggtggtggagatcgtttttatgtagttttcaaagttacttccgaaaaagaagatgaggtaatagttgaatatgccagcnacggacatgaggnacaggaagagtatgatgcgtttcccaaatatgtggcnaggggtgctctgcgttctctcttctaggtaaccgacaaagtacttttgccttanaaacaagtncatnagtncagcaaacgcagcaggnacttggctgcnaagtagccccgcagancagagcacagcaaggaaagtngggtacgcatcttcacagttctggttggnagtttagaaccgctcaaaggcaagtnttccggtnctctggaagctcctcccattntgggttctgctttcgtgctccactttatgggcaaagaatccattttggaccacgctgatgagggn

SEQ ID NO: 667001 - DNA, 1091 bp, Homo sapiens
  misc_feature (81)..(83): n is a, c, g, or t
  misc_feature (88)..(88): n is a, c, g, or t
gcggccgccgcgcccactgccgccccgacccttctccccccgccgccgcccccacgcgggactcccccggggagggggaannncggcngcggggcgagtctgggacgcgccgccgccatgatcatccctgtacgctgcttcacttgtggcaagatcgtcggcaacaagtgggaggcttacctggggctgctgcaggccgagtacaccgagggggacgcgctggatgccctgggcctgaagcgctactgctgccgccggatgctgctggcccacgtggacctgatcgagaagctgctcaattatgcacccctggagaagtgaccacgctgaaacccacccacccgctgtgctgaccatgggccctgagcgtcctaccccgaattcacgaggctgaggcatccgggagctggcgtaatgcctggccgcagtgtgtgtgtatcccataccccactctggaaggaaccatccagtaaaggtctttcagaaccactaaggtcccagccctcactaggatgtcaggagccaggtctaggcccagctttcacactgtggcagcccagtgaagcagactgggccatgaactctcctagccctggggccagcctgttccacaggcacccctgcaggaggcgctgccaggagagccttccatctcggggctctttgaggttccctccttctgggtgttcttcaggctgagcagagaggctcctgtaccctctctctcggaatctgaagagccagatttaggccgggcaaaggggctcacccctataatcccaggactttgggaggccaaggcaggaggatcacttgagtccagaaattcaagacccgcctgggcatcataatgagaccccatctctacaacaaaatttaataaattagctgggcacagtgttcacaccttgtagtcccggcatcagggtgagccgagatccgcactgggggtgcctggaaaaaaaaataaaaaaagaaaaaaaaacgggctctctcggggaaagaaaaagctcgtttttcccctttgaggggtcggcccgagcttgaaccacaagaccacagtcagactaaacacgccacaccaacaaaaa

SEQ ID NO: 667002 - DNA, 364 bp, Homo sapiens
  misc_feature (28)..(28): n is a, c, g, or t
  misc_feature (284)..(284): n is a, c, g, or t
  misc_feature (364)..(364): n is a, c, g, or t
tttgttttgttttgttttgagacggagnttgctctgtcacccaggctggagtgctatggctcgatcttggctcactgcaacctccacctcccaggttcaagcaattctcttgccccagcctcccgagtagctgggattacaggtgcatgccaccatggctggctaatttttgtatttttagtagagatggggtttcaccatattggtcaggctgatctggaactcctgacctcaggtgatccacctgcctcagcctcccaaagtgctgggattacaggcgtganaattcgttgcccagccttgttcttaattttgtatcatccagttcatcgcttaatattacacgcaccttcttcattaatcn

SEQ ID NO: 667003 - DNA, 418 bp, Homo sapiens
  misc_feature (156)..(156): n is a, c, g, or t
tcctatttatgggggttagtattgattgtaagcggtgtggtcgggtgtgttattattctgaattttgggggaggttatatgggtttaatagtttttttaatttaattaaggggggaatgatggttgtctattggttatactacatgcgatggctantttgaggagtatccttgaggcattgggggtcagggggtttgaggtcttgggtgagttgttttagttggggttagcggatggaggtaggatttggtgctggttgggttgaaagaagtatgaatgggggtggttggtttgtggtaaaactttaaataggtgtaaggaatgcttgaattaatttcactgacaggcagaagcgggtccaggggttgaaagcgcggttaccgttggtgggggtaccccggagcctccggaaattccg

SEQ ID NO: 667004 - DNA, 1189 bp, Homo sapiens
  misc_feature (81)..(83): n is a, c, g, or t
  misc_feature (88)..(88): n is a, c, g, or t
gcggccgccgcgcccactgccgccccgacccttctccccccgccgccgcccccacgcgggactcccccggggagggggaannncggcngcggggcgagtctgggacgcgccgccgccatgatcatccctgtacgctgcttcacttgtggcaagatcgtcggcaacaagtgggaggcttacctggggctgctgcaggccgagtacaccgagggggacgcgctggatgccctgggcctgaagcgctactgctgccgccggatgctgctggcccacgtggacctgatcgagaagctgctcaattatgcacccctggagaagtgaccacgctgaaacccacccacccgctgtgctgaccatgggccctgagcgtcctaccccgaattcacgaggctgaggcatccgggagctggcgtaatgcctggccgcagtgtgtgtgtatcccataccccactctggaaggaaccatccagtaaaggtctttcagaaccaaaaaaaaaaaaaaaaaaaaaaaaaaaaaaaaaaaaacaaaacaaaaaaaaaaccccgggggtttttttgggggggggggaaaaagggtttagaacggcgaccaggcgtgtcacatacttgttggtagtctgagcacccccagttttttttgtgtaacaggcggtggggaacatctcgggcgggcgcgcccccatatataggggggcgaggcgcggaattaaacttcccgcaaacaaccacggggtaccctcctttgttttaaatgtgtcttccgagccaacgacacagtactagcgaataacatacaggcagtagcaacagcgaataagtagcgatcaccaccacacagagacacgtccagtcacagcagcagccgcacgaacaaggtaaactataacgacctagatggcggacaaataaacggatcaagagcagatcttagatgaagagtagtccacgagatagcggaaggagagattcgaatagatagggggagcctaatagaatgaacagaaagcgacaaccggacgagaaagcgaagaagagaggggacagcgagagcggaggaagcagaagaagaacgaggatcaccgcgacggcacagggaacgaggcgaaacgaaacggacgcgagaaggaacaacgagcgcagcgcgggcacgacacatagtcagaccacgaaacgcaaggcgcgcgggata

SEQ ID NO: 667005 - DNA, 1041 bp, Homo sapiens
  misc_feature (81)..(83): n is a, c, g, or t
  misc_feature (88)..(88): n is a, c, g, or t
gcggccgccgcgcccactgccgccccgacccttctccccccgccgccgcccccacgcgggactcccccggggagggggaannncggcngcggggcgagtctgggacgcgccgccgccatgatcatccctgtacgctgcttcacttgtggcaagatcgtcggcaacaagtgggaggcttacctggggctgctgcaggccgagtacaccgagggggacgcgctggatgccctgggcctgaagcgctactgctgccgccggatgctgctggcccacgtggacctgatcgagaagctgctcaattatgcacccctggagaagtgaccacgctgaaacccacccacccgctgtgctgaccatgggccctgagcgtcctaccccgaattcacgaggctgaggcatccgggagctggcgtaatgcctggccgcagtgtgtgtgtatcccataccccactctggaaggaaccatccagtaaaggtctttcagaaccaaaaaaaaaaaaaaaaaaaaaaaaaaaaaaaaaaaaacaaaacaaaaaaaaaaaagaaacaaatgtgtggtggcggcgccccggcggcgcccccgagaaaaaccttctctaaaaaccacctccgggtggggcgcgcgggggcccccagtgggaaaaagaaaacgggggcacaaagggtgttcccaggaggagagaaccgcggggcaaaagagacaaagggggcggggagttctctcacaccacacaaataaaaagcgcccgcgggggggaaacacagaggggttttgcgaaacaaatccccaaggggggaggttctcaggggggggccacaaaaggggggggcggcataacacaagagggaggcgccacccaaggggagaacccccgcgatatactaaaacatatagccccccgggggacggggggggggggccaaaacagcgccactgacacggacgccaaccgaacagtcacatcaagagagcgactacgagaaaggaaagaacaaaacataaaacgacaaacaagcgaacacaaaagagggaagagagca

SEQ ID NO: 667006 - DNA, 193 bp, Homo sapiens
caagacccaaaagggtcaaactgtttccaagtaacttaactgcatgtggttattgaacctggctgtattttaaaattaattttattgtaggttatacaaaggtaggaagttcactagaaatggctatccttcgatttggctttaaaaaggatgagaaaaatcccacttgtgccatcatagaatatttgatgac

SEQ ID NO: 667007 - DNA, 156 bp, Homo sapiens
gggcaagtcgagctccagccggcgcttgagcatcttccacgccagctcaaacgtaaactcgaaacgttggatggtggcgtcgcgcaactcttcgtcatccggtgcggcagcggcgcgtgccaacgcacgctccagagctgccagggcgagttcaag

SEQ ID NO: 667008 - DNA, 123 bp, Homo sapiens
gaaagggaccccttgaacagggtgggccggggtggttaaaaaattggagccccatcccaatcccccggttttttagggggcccccctttttaattccccctttataaaatggtggccccccca

SEQ ID NO: 667009 - DNA, 439 bp, Homo sapiens
tttacaaatgtgttatttattttgcaagtggttagaaatgtttctgatatctttttgctgctggtatccaagttgcttccattgtgatcataggatacactttatgtaatttcaattattataaatgtggagcctttggatttattgcctaggatacagtctatattgatatatattccctgagtgcttgaaaagaatgtgtaatctgctgttgggggggcagtattctacaaatgttcatttgagtctgtggattgatggcgacgttgttccttctatatccttgctgaattattgttcagtgctgccaggcgctgagaaagggatgtcgaaaccttgaattataaatagaactcgcgtctatttccctgtgaacgtatacccattccgtcgatgtatgagtactccatccttcttgatggagaggccttctcttatt

SEQ ID NO: 667010 - DNA, 177 bp, Homo sapiens
ccttatcttcagaatcagaatcagctttgcgctagcctccctctgacttatctgtctcatgtgctgcttactgtgactgcagaaactcagcaatgaggtcggggcaatccaggctctcttctggctcccatgtgtcgccctcatctgagaatcccttccactttacgtaggactcca

SEQ ID NO: 667011 - DNA, 642 bp, Homo sapiens
  misc_feature (91)..(91): n is a, c, g, or t
  misc_feature (244)..(244): n is a, c, g, or t
gaacttgtgaaagaaaaattatatctgaatcaagattcatgttttatttttattttttttgatacagagtctcactctgtcactctggctnggagtgcagtgacatgatctcagctcactgcaacctccgcttcctgggttcaagcaattctcatgcctcagcctcctgagtagctgagaccacaggcacccggaacaaacccagctatttttttgtatttttagtagagacagagtctcaccnaattgcccaggctggtctccaactcctgagctcaggcagtctgcccaccttggcctcccaaagtgctgcagttacaggcgtgagcccatgcaacctggcctcatgttttttaaataatggccttttatatttacccttttgtgtcatcactttagaatgaaaattcccatttaaatctgaaaggttaccttaatagtcctctgtgtgttattaggacagtattattatagtacttatttattaatttacgatttaaagttatcttctcttttcttttacttctgctgcttaagggacaattaaaaagtgggaaaactatgaaacagtggaacatttttatcctacctgaaagtaaaccgagtaatggtgaagcataagacactggggtaataacaatc

SEQ ID NO: 667012 - DNA, 851 bp, Homo sapiens
ccagtggtggcaccgagactgacgaaaccccagaaggggatccacgaggggttgccccccccacccacccagacccagagatgggcgtgtcccaaagttcccagcgttaaggaaatcttgtgggagaaaggtgaattccagatgttgaatagattatcgcaataaggaaaagtaccccaagtaaggatgggtaagaaccctttggggaccccgaaatgttggcgcccagcgtcgtgacacccctccaccaactgcttaccaggatagggatccatggccccccctcaatgttgaggtgccaccctaaattgctttcccgcccccctggaagaaagaaagaaacgaagacctgtggttgttgcccctgagttttagccaacacgtggaactcactctccattaccccttttctggggttgaaactgctgtcttctagaagggccctctccaacattgtgcgttgtaatcacgtgcagctgctggaaggaaatcttggatatgcttatgtagccaaactttttaatctttatagttattttggaacctttgctttgggtttgtggcacccctcggccacccccctctggctgtgagccgcctctgccgtccgctgggctggccctttgttgatcttttatagtttccctccctcaccccgtccccctcttttctcggtaaggtgtttctaggaggtctttaggtgtacatcctccgcttattggctttaaaagtactttccctttaagtggtttctttggggcccattgggagaaagagaatccataaagccactgttttgatactggatattgaccagatgtctttttgaattaagaacccctcccccccca

SEQ ID NO: 667013 - DNA, 336 bp, Homo sapiens
gagaccagtgccgatgggggtcctccgtttgttgagcgccggtcctctgggcccagtgttctttctctatacttgggctctgtgtcttatttctttactcagactctaatcccagctgatgagaaatagccacaggtgtggaggggctggccccccttcagggttttatgccttgggattaggttgtaatttggaagggaagccttccaccctttggaacagagctgggtgttccaaagaccacaaggggtttaaggccctggaccccggaatgttccaagattctatataatgtcagactagcaagccctgcctcagatattccccaacatggaa

SEQ ID NO: 667014 - DNA, 559 bp, Homo sapiens
gactgtcgaccaggttgaagcgattctccggcctcagaactcccgagatagctgggactataggtacactaattttatgtattatttattattatatttatttatttatatcgagactgaatttcactactatattgcccaggctggagtgcagtggcacaaactcggctcaccgcaacctctgcctcccaagttcaagcgattctcctgcctcagactctggagtagctgggattacaggcatgcaccaccatgcctggctaattttgtatatttaatagagatgggaattcaccatgttggtcaggctggtctcgaactcccgacctcaggtgatccacctgccttggctcccaaagtgctgggattacaggcatgaaccaatgtggctggcatttaaatgtaatatattgtagagatggggtcacactgtggtagacaggattgtaccgatctcctgagctcgtgatcacccagccttggcctcctaaagtgctgggattacaggcgtcagccataataccttggcacagtccgaatataaatcagcatcattact

SEQ ID NO: 667015 - DNA, 458 bp, Homo sapiens
  misc_feature (13)..(13): n is a, c, g, or t
  misc_feature (82)..(82): n is a, c, g, or t
  misc_feature (109)..(110): n is a, c, g, or t
  misc_feature (151)..(151): n is a, c, g, or t
  misc_feature (169)..(170): n is a, c, g, or t
  misc_feature (218)..(218): n is a, c, g, or t
  misc_feature (237)..(237): n is a, c, g, or t
  misc_feature (242)..(242): n is a, c, g, or t
  misc_feature (319)..(319): n is a, c, g, or t
  misc_feature (321)..(321): n is a, c, g, or t
  misc_feature (323)..(323): n is a, c, g, or t
  misc_feature (440)..(440): n is a, c, g, or t
tgctactgcgggntcctgcccaccctctgctccaaccagccctgagcgatgagcgcacaggcgagcgcggggcccatcactnagggggccatgggggaaacagtctccnngaggtgctgcccctggggacccagaaaagtaggactttttntcctaggacccgcatcgnngcaggggacctcattcctagtgcccaccataggcaaccctttgcccantctgaaaagaggggcttgncgctngggtgggttttggggttggttttgctatcctggtttatttattttcagctcaagatttaattaggtttaaatttatncngntatgcctcaacttaccatggggttacttcctgataaacccatcataaatgaaaatatcctaagtcacaaattcatttaataccccaacagaccaattgtaaagttgaaacatggttnaagttgaaccactgttaa

SEQ ID NO: 667016 - DNA, 192 bp, Homo sapiens
agacacaggctcaagatggtcagggagggatcgttgacctcgtctgttatgtaaatgtgatgcgtagggattggagtggcgatgagtgactaggatgatgtgcgggcagcatagttcatgacggtttctattctcctgagctgtctgatcatgttctgtatctagttagtttctgttgttgcacgcccactc

SEQ ID NO: 667017 - DNA, 703 bp, Homo sapiens
acctccaccgtggacgctcacggaacagcctgtctggacatgatgtgctcgatacgtcttctccaatgttcacggctgtcccgaagaggtctcctgtgggcgaggttcctccttagcggggtggcaggatccatcagatcctggcgtggtgttggggaccaaggtcgttgtcatctgttgtaccgatccatgcgtggggaacccgggatcccgggtccgttacgtaggccctggagctcgggggggagcctgcgatgttccgggcccctgtgcacgtgccgcacgtctcctatgtcccctgtgcgggttgcgattgttgtaggcaccatgcaccatatgtggagtgctgcctcgggctagagcttggtaggtcccatgtgcgtggggccagccagggttgttcccgttgggtggcccctggtgggatctgggggctcccgttccgattgtccagtgggggggcccgattgggctgcctctcggcaggtattgggcggcgcccgtgggactcgttgccctgagctctctcacaagggttcgcctggtggtgcctcgtggcgctgcgtttcctctcccagggacccacttgtggacatggggggcccatgtgcggccggggaaaacccttgggagcagagggggccttccaggccttgggtggaccccctgggggggtttccctggttgcccggggagtaaagga

SEQ ID NO: 667018 - DNA, 117 bp, Homo sapiens
  misc_feature (73)..(74): n is a, c, g, or t
gatccgcccgcctcggcctcccaaagtgcttggattacaggcatgagccaccgcacccagcaagagttatttnnttaacttgaaattttctactagccctggtgaacttctgtgctt

SEQ ID NO: 667019 - DNA, 470 bp, Homo sapiens
  misc_feature (6)..(6): n is a, c, g, or t
  misc_feature (20)..(20): n is a, c, g, or t
ccttantacttggaacatanaattttggggggttgaatggttggaggggccttttaattccaactcagtaacatccttaaataaggaattaatgcccccccccaacttgcccttacaagtccatatattaaaaacaatgttggccctggcacagtggcctcatgccctgtaatcctcaacactttgggaagcccaagggaggaggatcacttgagccccaggagttggagaaccagccctggataacaaagggagacccagtttcctacaaaatatttaaaaattagccaggcatgatggtgcatgcctgtggtcctagctattcaggaaactgaggtgggaggatcacttgagcctggaagttcaagacagcagtgagctatgctcacaccactgcactccatcctgggcaacagagctggactctgtctcaaaaaacataacactaaaacatcaaaattaaaaaaaaa

SEQ ID NO: 667020 - DNA, 185 bp, Homo sapiens
tgcatgtcatcgccaaacacaaaaaaacaaaaaacttcccagtgctgggcacaggtggctccacacctgtaaatccccagccactttgggcaggccaaggccaggtggcatccactgcaggtccaggcagttcccagcaccatgcctggtatacacatggtgacacacctgtcatcccactcaac

SEQ ID NO: 667021 - DNA, 465 bp, Homo sapiens
tgtgggcgcacttcccaaatcatcaggaggatcagcagctgactcataacaagatcacaagagctgggctcttgtagaaggatggtagacctgaccttcatccatctccagcacaatcggctgaaagaggatgctgtttcagcggctgtgaagggtcttaaatcacgcgaataccttgacttgagcttcaatcagatagccagacagccttctggtctcccggtgtctcttctaactactctacttagacaacaataagatcagcgacatcgctgatgagtattgcaaggcgttttaatgcatagcagatatcgtgcgtttatctcacaaggaactggccgactgtggaatacctggaaattctttcaatgtgtcatccctggttgagctggatctgtcctataacaagcttaaaaacataccaactgtcaatgaaaaccttgaaaactattacctggaggttat

SEQ ID NO: 667022 - DNA, 277 bp, Homo sapiens
gattacaggatcttatgcagggactggcatgtgcggaataggaggtgtcgggagcacgcctggcagcccatgctaggtgcaagaggcttgcagctcctgcttgagaaggcaaagggtcattgcttcatcggcaggtaggtagccaggaggtatcggcgctcagaataggggggtgggtgatggacgttgggcttgtcagcaggccggtggcagcgggggtggcagcggcactgggaaagccagcaaagctaaagctatgctggaggcgtggacggtc

SEQ ID NO: 667023 - DNA, 1054 bp, Homo sapiens
cgtctttaaaccctgcgtggcaatccctgacgcaccgccgtgatgcccaggaagacaggacgatcctggaagttcaactacttccttaagatcatccaactattggatgattatccgaaatgtttcattgtggcgagcagacaatgtgggctccatagcaggatgcatgtcagatcccgcgatgtcccttcggcgggaaggctgtggtgctgatgggcaacgaaccaccatgagtgccgcaaggcccatccgagggcaccgtggaaaacaatcgcctaaggcttcgtggagtaataagcgtgcgtgcctgagtatccggggtgaatgtgtgggctttgtgttcaccaaaggaggacctcacgtgatatcagggacatgttgcttggccaataaggtgccatgcatgctgcccgtgctggtgccattgccccatggtgaatgtcagcttgtgccagaccccagtaacacctgtgatcgttcgggcccagaggaagacactctctgttattaccacgggctatttagcgtatgcaagccatcttaagaattctcccagggggcaccattgaaatacctgagtgatgtgcagcctgatcaatgacttggaagacaaatgtaggggagccagcgaagccacgactgctgaacatgctcaatatctgcccccttctcctttgggctgctcatccagcacggtgttcgaccaatggcagcatctacaacctgaaagtggcttgatatcactgatggatgtctctgcgttctcgcttcctggaggtgttcggaaagtagccggtgtctggctgcagaatggtacccacttgtgtgcattctgtacgcctattctatcatcgagtgggttcaccgagtctgggcttgtctgggggacggttagccttcccactggtgaaagggacgcctctgggggtcactgccttggggtgtgcccttgttggccccccgtgtctgtgttgtggccccagtggcgccgctgtgcgtgtttggttttgttcccaccccgttttggaacgcgttttaaaacccctggcggggg

SEQ ID NO: 667024 - DNA, 190 bp, Homo sapiens
cacgagcgccccaaggggcacgacagccccaagcgggagtacaaccttgcgatcttggttcactgcaatctgtgcgttccgtttcatacatacatagcagcttgagcctcgcgcgcagctgtcactacaggagcatgccaccatgcctggctacttcatgtagctcttagcagagatggggtgtcaccat

SEQ ID NO: 667025 - DNA, 605 bp, Homo sapiens
ctaaatatcatggagtcaaaatcttcggaaaagaatttcgttaatacgttcagggggcgcacccataagaaagtgggttaaaaagctgcccttggtcttcttagtgctccaacagaaagtggcctccctttgatccggctctcattgccctgttccccatccaatagttcggaggggtggtcaggaaaaaccccggatgtccttccagttaggtcattattaaaatgattcccctgtccctgtgcgcatggaacgcgggaaggtcgcctctgcccgagaactcgtccttgtagtccagcagcgcttccttcaccgccttgtagccgtgcatcaccaccatgcgctgcgagcccacgtacagcgtgaacaccggcccgaagcgctgggcaaccgggtaaggacttggaatatcttcaattccaactgaaaaggttcccgatgatgggaagcggaaaagggcctgggggcagattccaagctgctgtgcacctgcctccacatggacaccagcagaagaaagccggcccccaccagcagggccccggtgactccgaggccaacatggggccgctggggcctgctgccagctgggcgaatcctcaagc

SEQ ID NO: 667026 - DNA, 432 bp, Homo sapiens
gtcggcccgattaactgcacaagagcaaactctgtctcgttcaaccaatcaatcaatcaatcaataataaaaaaattagctgggtatggtggtgggcgcctgcagtcccagttacttaggaggctgaggcacaagaatcacttgaaactgggaggcggaggttgcagtgagccgagatcgcaccactgcactccagcctggatgacagagtgggactccatcttgaaattattaatggttacaccagtacaacaggcgtacatcggaggtgtcccaggcaaacctggatgtcgggtccctttgttatacatgaagtgttggatttctcacttaggtggagaatagtgaaggtgctcctgttgagcctgggtatcactgctgctgttggggattggcgaagtgcgggtctgttaggatgctggaggaaaggaa

SEQ ID NO: 667027 - DNA, 111 bp, Homo sapiens
cctaattttgtaaacatgggggggaaaccaaagtttttccgatttccttttttggggtttacccgtttcctttttccctttttaaaaaaaaatgtctttatggtttcttta

SEQ ID NO: 667028 - DNA, 133 bp, Homo sapiens
  misc_feature (39)..(39): n is a, c, g, or t
  misc_feature (44)..(44): n is a, c, g, or t
  misc_feature (85)..(85): n is a, c, g, or t
  misc_feature (99)..(99): n is a, c, g, or t
taggtggattaactaaacacagctacgcaaaatcttagnatacnccactattacacacatagtattaataatagtagtctacgtntaccctaatattanattcttattatattatttatctaatactatgtat

SEQ ID NO: 667029 - DNA, 956 bp, Homo sapiens
ggggaggtgtttataatggcagtaatcagtcgacccacgcgccttcggctgatagctccggcttgcatcacccggacgggggatgagctccggtattgcatcacccggaccgggggatagctccggtaatgcatcacccggaccgtgggccgggcgcgcacgagactcgcagcggaagtggagtgcggctccgctgcgcgatccagctgctaggacccagggcagggctggagctgggctgggatcccgagctcggcatgcagcgcagctgggccggcaccacctgctggtgccctggaggctctgagccccggcggcgccctgggcaccacgcggaacgacaggggcgagatgcgagccacccctctggctgctccttgcgggataccctgtccaggaaagacagcggttggagatggatgacaaccttagataccgagcgatacccgatacaagaaaacgagactacgaagatgggccccagaaccaggacatgaacaccacctgcctgtaggacacagtgaaagccccagacctaaagtgctaccaggatcggttgcaagatggctgttggcacactgacctcacaagatcagggggcccctaatgatacctccacatggaagccacagaggagggacgaggcgtaggacgtaacgagggccccatgcaacaatgacccataacagaggcagcatgaagagtcaatgagcccactggcaaatggggataggtacacacacctagagccaaaaaggaaagggacccctaggagacctagagtagcatagagaagaccaataactagcacgctaggagttaggcacacgcccgaagcaaaagcaactgatagggacaccaggagcagccagctgaaaatggtaccatgggatatgagaacacacaagctaccaatctacccagccaaagagatcagtacaggaacccaatagagg

SEQ ID NO: 667030 - DNA, 245 bp, Homo sapiens
aattggggtccccccggggtttttggggggggttccccaaaaaatggggttggtttggcccccggggtttttttttttaaccccctgggttttaaaaattgggggttcttttttgggggggggggccccttttgttcccctttggggagggggggcggggccccccggggtgggggttttttttttttttttgcccccctgggggggggaaggggggggtttttaaaatttttttttggccccca

SEQ ID NO: 667031 - DNA, 433 bp, Homo sapiens
  misc_feature (49)..(49): n is a, c, g, or t
gggtgtgcttggcatcctttcttcatatgtccacatatggccgaccagnatcgaatgaatgggaggcattttcctaggtgcattgtcttttctctactgaaccttgtgctcctgatggcttttctcctccctctttatagttagttccttgtgaccttttcctcaagaagttaataatggtggtagtggtttcacagtaccagtgctgacatttcacatctgggctctttttatgtctttagtctcattaatcctcactgcatcttatctgggcaggtggattattctcgctcggtgtagatttggaaacctaagcttcagagaagtagaatactttcctgtgacactaagagtttagcagagacaaaactgtaggtcagttctgcttctcctgaatttgtagttattatactgctcccatgaagcggctgtg

SEQ ID NO: 667032 - DNA, 175 bp, Homo sapiens
gagttatgagctgcgatcgcgccagagcattccagcctgggcaacacgagtgaaactctgtctcagaaaaaacacaaaaaacagcaaacaaccaaaaaatactagtgcaaccggggcccatttccttctctgcagaaatggtccattggcttaccacaaacctttccatagggca

SEQ ID NO: 667033 - DNA, 103 bp, Homo sapiens
ctttctctctccccggacagcatgagcttcaccacatcgactccaccttcatccacgcaacataccggatcccatgggactctgatccaggcgcccagcatac

SEQ ID NO: 667034 - DNA, 574 bp, Homo sapiens
gattacgctcctagacgtgctttccgaagttcgtccatctcaatttttctgggccgtggctaatgcctcataggtaggagtcctcagatcagccatggggatcagacatatcccggggtctcggctgtaatctttggtctttagcgaagggggggttggtatgtgctgaagaatatgggagcatgaagtgcctatccagcggaccctgaggagcagcaggtcacacatgttccctccagtcaggggccaggtaccaggccggacaccggaatctcttcatgggactatttcagaacaatagggactcagacagaagagacagggacggtgctttcgaggagccgtgccaccacgtggacctttctgtggctgcaggtcaaatcccatggaacaagcaaaggaccctgggtgtccccatcaccctccagccccgtgtgccagacgcacctttgggtagttggtgccaagctcgtcaatggcacagaactggatcagcttctcgtagatgctgaaagaacagtgccggcgctgagcaggcacaagtccacgtcccccgtctaggagcgtaatcggg

SEQ ID NO: 667035 - DNA, 149 bp, Homo sapiens
aaaagtgcagcaacgaacgacagccagctggggaacagaatgctcaagggagagactgtggttcttgccagcgacagcaagagaaagaggcttcagcctccccagaccctgccaagacagagcttcatcgtgtagggcctgcgacaaaa

SEQ ID NO: 667036 - DNA, 331 bp, Homo sapiens
atcatacttgaatcaggatgatatgtctttcttgtattcctggtcttgatgaccttgatgtgactatgaattacagatctcactccccggtatcccacttttcggtgccaattcaaagcaggtgagtatcacgtttatctcctatcctcacagtctgatatgtggtcagtccgtccatagcacccaacaacttccatcttccctgtattatcttgtatatcataataagtgaattcaccccttacatttttcttatgtacctcaaacaccccattcacaaaacttcctttagtttgtgagcaacagctggatttgcactattcttacgcgg

SEQ ID NO: 667037 - DNA, 655 bp, Homo sapiens
  misc_feature (20)..(20): n is a, c, g, or t
  misc_feature (23)..(23): n is a, c, g, or t
  misc_feature (29)..(29): n is a, c, g, or t
  misc_feature (37)..(37): n is a, c, g, or t
  misc_feature (46)..(47): n is a, c, g, or t
  misc_feature (50)..(50): n is a, c, g, or t
  misc_feature (55)..(55): n is a, c, g, or t
  misc_feature (66)..(66): n is a, c, g, or t
  misc_feature (71)..(71): n is a, c, g, or t
  misc_feature (89)..(90): n is a, c, g, or t
  misc_feature (111)..(111): n is a, c, g, or t
  misc_feature (120)..(121): n is a, c, g, or t
  misc_feature (124)..(124): n is a, c, g, or t
  misc_feature (141)..(141): n is a, c, g, or t
  misc_feature (143)..(144): n is a, c, g, or t
  misc_feature (167)..(167): n is a, c, g, or t
  misc_feature (191)..(191): n is a, c, g, or t
  misc_feature (241)..(241): n is a, c, g, or t
  misc_feature (246)..(246): n is a, c, g, or t
  misc_feature (251)..(251): n is a, c, g, or t
  misc_feature (265)..(266): n is a, c, g, or t
  misc_feature (313)..(313): n is a, c, g, or t
  misc_feature (377)..(377): n is a, c, g, or t
ccttgaggtttccgcaagancantttcanttagtctncagcaaganntancatanggccctgcccnatccngaatgctcagttaacttnnacttttcataaaagtaagttntctcaaggnnganaagtcaactggtgtganannaaacagagatcccgtcagttatnctcttttcagttcaaactgtgctngtgagtgcagttctaatctcagttaggggagatgccattcactctctgcnagagnagtantgaaaactggtggnntgtcagctttatttagctcacctagtgttttcaagaaaattgagccnccgtctaagaaatcaagaggtttcacattaaaattagaatttctggcctctctcgattggtcanaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttacgcctgcaattttacctagctaccactaggtggatagtaaatttatacttatgtttcc

SEQ ID NO: 667038 - DNA, 427 bp, Homo sapiens
  misc_feature (31)..(31): n is a, c, g, or t
  misc_feature (36)..(36): n is a, c, g, or t
  misc_feature (75)..(75): n is a, c, g, or t
  misc_feature (96)..(96): n is a, c, g, or t
  misc_feature (144)..(144): n is a, c, g, or t
  misc_feature (199)..(199): n is a, c, g, or t
  misc_feature (217)..(217): n is a, c, g, or t
  misc_feature (250)..(250): n is a, c, g, or t
  misc_feature (414)..(416): n is a, c, g, or t
agttttgaaagttaggaaagtgtaaagaacncccantgttattgtttttccaagattgttttgtctgttttgggncattataatttaggatcactntgttattatcctgcaaagaagcccaggggagattttgatagtgattgnccttaagtctgtaaatcaattagggaatattgccatctgaacaatgttaagtctntcaatcaatgaacattgnatttatttccatttatttaggttgtctttagtntcttttgacaacattttgtacttttccatatacaagtctggcatttgttttgttaaatttattcccaagattgtttttctttttgataccattgtaaatggaatcattttcttaagttcatttcagattgttaatttctactataaagaaatacaattgattannnatattgatatt

SEQ ID NO: 667039 - DNA, 710 bp, Homo sapiens
taacccatggtactccagcctggacaacagactgagaccctgccttaaaaaaaatgggtttttaagtaaacaggcacacatatgtgaaagctaaggaatgcccaagttgttgatgctatgataatgattgaacgagacagggtcttgctctgttgctcaggctgtagtgcatcggtgcagtatccgatcactgaaacctctattggctgaagcgattcttcctgcctaggcctgctcagtaggtgggattacaggtacgcacgactagactcaggtaatttttgtattgctggcagagacgaggctttgtcatgtaggtcagggtcaggctggtcttataactactgactgacgggagccgactaccttgactctgaaaaagctgggttacaggcaaaagaatcctttccaagctaggaattttcaaattctggtattggttataagatgaaagtatcggccgcctttgaaagaatggcgttcataccaggctgatgaaattggaaagccccatttctttttataaataaacgttaatatttttggtgtggcccttcttgttttaccatatcgttggtcccagcacttccggtgttaatgatggaaatatacctaaatcgggtgggggtggttgaattttgtactcccttttaatataaggggggctcgttgaggggatccccattattatgggtgggccttcgtgttcc

SEQ ID NO: 667040 - DNA, 390 bp, Homo sapiens
tagagccattttgcttttctctaggctatcgaatgacctgggtctcccagtgctgccctcttcgaggagccgtcactgtgcgctactccttcaccttcatgttctccctttcctgcttccgctcctattgtatgcgtcatcccgatgtgctgtgcatgaggacatatatgtggcccctaacgctgtgcagtagatcggagctattctcgattcaggagcaggctcctctctctagctatcaagctgcaggttccgcctatcctttagaggtctgtctgtcggcatgttctgttgagcctgtgccgtcgatttaccatcgttcgatgtctagggctacccagtagtggggtatctaatcccagtttgggtcttagctattgtgtgttcaga

SEQ ID NO: 667041 - DNA, 120 bp, Homo sapiens
atgaagtatcctgggacttggccctgtcaggtaagttggggctgacagtggagatcctcacaggagagtaaccgatgctttgtggacacagattgctgcgtcgagctaagatgttaaaca

SEQ ID NO: 667042 - DNA, 324 bp, Homo sapiens
gtcagactttgtgttcatttcatttcagggtcttggctgcctgtgggcttccccaggtggcctggaggtgggcaaagggaagtaacagacacacgatgttgtcaaggatggttttgggcctagaggctcagtggtgggagagatccttcagaccaccaaccagacgtggtttccttagctttactagaaaagattctgggctgtttatgaaatatagacatcctcacatagccagtcatcacattcctcttaccttcagtcagttcttccaataggcttggtcaacttggggccggcctcagtctcggagggcaccactcagct

SEQ ID NO: 667043 - DNA, 696 bp, Homo sapiens
  misc_feature (523)..(523): n is a, c, g, or t
tgggtcctgcgtcttgcgcttgaaagatcgggtgcatctcaaagagttatttttggaaatgaacccactcgggcttgccacccgatgtcgggcgcatgccgcgcttacataccttgctgctcaatgaaacaagcctggtggagtggcctagcagtgtgttccgtgtgcccaggccggaagacttcattctggatatgcggcagaacccgatagcgtggattcccgagttcgcgccgggctcggataaggcattgattgtggcgaaaaccttcctcacccgtgaaacgctgacgcctgaactgcttgctcaattcaagcggtacatcgaggctgccggccgggatccggatcgccaattgccgaaaaggggcgcgcgcgacagcgagcagtggaaaaccggttattcggcgcaggaatggccctccaggcaagtgttatgggacatgcttgaaggttcgtttggctctgagggctttttcaatgttcttcgtgccgtcagaaactccggggactcgacactcangggcggcgtatggttgccggaactgaccgccaaggtctggcgcatactcgaggcgatgggcgaagacgccgaattgcgcgagcagttgttcctgatggcccgggaccctgcagcctgcgtggacgccggacgccagatgtcaatgcgatgcgggaccactcggggatctctag

SEQ ID NO: 667044 - DNA, 844 bp, Homo sapiens
cctttgtgttaacccgcccgtgaggaagattgctctcccttgggccacgggttatcccctaacaagccccgccctgctcaacctgtgctgattttctcaaaaaaggatgaggggcaacaacaaagaggcccgtttctccacccaacacttgtggttgggaaagaaagcaagataagttggctcgcatgtgtagatgtacggcccgcaaggtactttccctcggcacacccattggagacgaggttgttcaagcacatagagcatgttcacaacaggcgcccattgggttagttccaattcctgggggtaaaggggcctcctaaacccactgttaataaagatgtccctggatgacgcccctctctgatgtggctgtgggcacaaatacgctcagaggaggccactggtattagccccggcctccatatccagggcgtgggatgggagacagacagcgtacataaagaggggggtcctgcttccccctcactagatagtcgcctctgtctggcccacagcgccatctttttccgtataaaagaaaatcggcttgccactcattcgcagcacttgcaccccacgtttatacatcctatccaaggaaccaggtaggaccgtcctatataaatgtcgcgcggcggggccattatatacaggccgggggtacagacaggaaccgataattagttcactctatcccgcacggagcctcacagagatagaaatgttgaacatcgctggccttgggcactttggaaatagaagtccgagcttgcccactgtctacggaacacccacgctttcgaaaaaagaggcagaaaacaagcttcaaaaagcgacaaca

SEQ ID NO: 667045 - DNA, 348 bp, Homo sapiens
  misc_feature (28)..(28): n is a, c, g, or t
  misc_feature (50)..(50): n is a, c, g, or t
  misc_feature (142)..(142): n is a, c, g, or t
  misc_feature (160)..(160): n is a, c, g, or t
  misc_feature (230)..(230): n is a, c, g, or t
  misc_feature (253)..(253): n is a, c, g, or t
  misc_feature (332)..(332): n is a, c, g, or t
cagagacacaattaggctccctaatatnactgattttatacccccaaatnatagacctctccttttggtggcagagtctgatccagcacatttactatgcgggtaggcagagaaggcccactcagaacaggctctctaaatnagcagaagtgtatttaantgcactactggatcccaggccatagactcttcatcggcactgttcaacaagaaggaaagtgtacattttnttgttgtgaggcggggcattggngaagacactattaaaaggcttaagctattgttctcagctgggaggcagtgctgcttccctaggacgtaggggcattttngaaaggtgttgggggt

SEQ ID NO: 667046 - DNA, 275 bp, Homo sapiens
gtgacaaacaaaaggaggggtgcactagaatttcaataggcttcctaatttccataggaaaagcaaagcaacccaatgccttcctgagccttcagtgcattaagagagttctttagctgcaaccagccaccaagccttcttgggctaggcaattacttcccactggaacagcagcagcctttttcccctctttgtgtttcatgaagacacggctgtcctctagggagccaggaaatagatacatgggcaactttcaaaggaatctctaccctgtg

SEQ ID NO: 667047 - DNA, 676 bp, Homo sapiens
  misc_feature (32)..(32): n is a, c, g, or t
ttttttttttaaaaggagaggggggggggggngggggccccccccccggggtatgtattttcttccccccccaaaatggggggggggggggcccccccccccccccttttttttttttttttttttttttccaccccccccggggggagagggggaaaaaaaaaaaaaaaaacccccccacaaaaaaaaaaaaaaaagggggggggggggggggggaaaaaaaaaaaaaaggtttgtgtggggaaaaaaaaaaaaaaatttgtggggggggggcgaaaaaaaaaaaaaaggggggggctcccccaaactttttggggggggggggggggggggggggggggaaaaaaaaaatttttccccccccccccccccccgaataaagggaaaaggggcccttttttttttggtggtgtgggggggggaaaaaacacccccccaaatttttttaaaaagggggcgcaaaaaattggggggggggggtttttttaaaaaaaaagggggggccccgggttttaaaactcctcttaggagaaaaaaagggttttttttaaaaagggggctttttaggggtttaaacggggttaaacctttttggggcccaagcccctccaaattggggggtaagggctagcctgaatgggtaaaaggctcaaaaaaatcttgcgagaaaaaaact

SEQ ID NO: 667048 - DNA, 1216 bp, Homo sapiens
  misc_feature (344)..(344): n is a, c, g, or t
gtttcgtgttgtttggtggttcgcgttgcccgtttctggagttgtgaggttttgtatcggccttatgtcttagggggtccccaccgtgtttcgtgtgaagcctttcgcggtccgatggtccccgtttccgccctttttttgagcccgtgccttttcgccctgggggtgacccccgtgtcccccgagtactgcccctgagagggcactttctcttgggtctactctttgccaggaactaatgtgttaatgcctggcgcgaaaatcatataggtctcttggtgaacactagccgttattatacccccgccattggatatagggccacacccccccgttgttcccangatacccctggccacgtattttggcccccctggccatttctggaatggctttttaaatcagctcttccaagtccaaccgaaatacgcttgggaattttgagctggtagcagccttggattctattaaaggcttttagaatgatgcacagtctttcccactcacgctgaaatcttgggaaataatcgtctccccacttgaggagttgttcccctgaggaccataattcctcccagggaataggtgtttgagatcccaagatgtgcgcccatagagacctgtcacaataaaggtgatccttttgtttggggatattattcttggaagggaatatatctcatagcctttgtgaatagcgtatatctttagaatatagcgcatcccctgtgccacaaaatatgtccaaattgtgctcatataatagcctctacaagttatataaaatattataaatatttggaatatttaaataatattaatagctctacacattctctagtgacaccatatgtgaaaatatttcttttatattattcgccaataaccgtgatacccataaaacttttacaaatattttctcagaaaccatcgatagtgaatactgacttttagagagaccacctatattcttttttttcaagatgtttcccaataccctttaacttattactacttttcttttttatttacccgtgctggatagtatcccctggccaccaatactgactatagtccattagttttccattgattcttatgcgtagtctttttttatgctgaaaacattctcctaaaaccaagagtgtgtgtatttactaattttctgtattgacagaagcccccatggaaactccaataaatatttgttgaaaga

SEQ ID NO: 667049 - DNA, 922 bp, Homo sapiens
ggcggccggtcgcctcctgggaaggagaggaagcgggagaggaccccagttgcctgtcacccaatatctccaggccgcgcagtcccgaagagtgtaaagatagttctgccgtgcgccaaatgctcggccgtgcacccgctctctgatccgagccggatccaagagtggcatacaggacccaattctgcttcaggtgtatctcgaccaagaggctagtagggacgtgaagaggggctcaaccggttattataatgggggccccagaaatgggtgtgtctccagctaaatttcaaagaggggcaggtttccagacccaggtgcaattccaggcacagacgatcattgtgattcggtgtgtgcaaaaatttttattgtgcgtgcacgtgttgtgtgaacaagtaagggaaggtggcctggtaccggggggcgggtaatgggacaacaggttctttgtgggcaacgccttaaatacatggggttaattgccaagaaaaccctttcgttgaaaagccaggaaggttgttctcaatatgctatccgtgggattgggcctgttgtatggaaggcgaatggggtcctctatggatgagatggtggtttctggattgtggtgtggccatgtaaccaaaattagttgtgggacattgtggggcttcaatattaacttacggaatggacaatccgggtggtagtcttagtggggactccgaaaaaatggaggtttggcggtcatgggcaatggtacggtattttcaaagtccattttccttaaggtggaagctttcacacaaaaataacggtgaccaacttgtgtgggggcggaaaaaagagaggccaaggagtttaaccattgtgggggcgggcattataactggaatggttcaagaacgggaaaagggggttcacaaagaggggccggtga

SEQ ID NO: 667050 - DNA, 416 bp, Homo sapiens
  misc_feature (298)..(298): n is a, c, g, or t
aggtgatgaaaatattctaagttgactgcagtgatggttgtacagctctatgactatactaaaagtcattaaattgttcactttaaatgggtgaattgtgtataaattatgtctccataaagctgtttatttttttaaaagacacactaaagaagaaactttcctgcagctccagctgaccttgcaggctggccttttccgatctgacctgtgctccctaagctccctgcgaaggagataaattgagctcctggtctgcaacagctattggttattggaatgtctgcttttgttttgnacgagattgtgacccaccttcttatacagattgaatagtatatatttggggatccgggccaaaccccgttctggatgactaaatcccttactagacctacgaagttttctgtcagaag

SEQ ID NO: 667051 - DNA, 748 bp, Homo sapiens
  misc_feature (102)..(102): n is a, c, g, or t
agcggtggggattttaaaaaattcttcaaaataccagttttttcccaacaagtacaattgttcttgtgccttctgtggctttcgatttcatctttatgactntatttccaattactacagctgcaataaacactaaattttttttctggctggttgacataacggtggtagccttgctaatttggggctttttaaaacaaagcgggaaaataccgtttttgaggacaaaaattttaaaaccagttggttcccgaaattaattttttcctaaatggttggaacagcattcgagtttggaaaattctggaagaagccattttttggtacctgtggagcaaaccttgtgttttctaagcctaatgaaaggtagtttagaagcattattcaataccatgtgctatatatgtgtccgcagatgtgtgaccttaaattcacatccacgcatgtacacacatgtaaaattatacatatatatatatgcgtgtaaagtgaaaagttacctttccctatctagatttaagaacctattttacacatttgttatgttttggcgataagaaggctatatgtgcaacaaaacatttaaatctaacggcatctttggcgtgttaatgaaggacgttcacattaagggtaaaacacatggaatatgttggtaggaattttttaaggaaaccgtcacccacatattccagaaatttgctctgcgcctccgagttttattaattggaagtgtttaatgttcccg

SEQ ID NO: 667052 - DNA, 856 bp, Homo sapiens
ggacatctcggtggtgggcactgggcagaccagattcgttcgtactcgtgcgcctcggtcgctttcctccgcatccgtgtctgacaaatgcgatatggctgagatggagaaagttcgagtaagtcgagaactgagagaagacagatacgcaggagaaaaatccagtgtcttccaaagaaacgatgtgaagaggagaagcaagctaggggaatcgtaatgagggggtgagcacgctaatagtgcactgtgacattcacacaagcgaattggctccttagtttgtagttatatattaggtgtgttaacttttgcaagatgcaatggaggtggatgcagtttaaatgattgtgctggccctttcagatcaaatgaactagctgactagacgaggggccgtgcttggcctttgcccatctgtcgtatctatcgtggctggagggaaggatgagaaatttgcagtgtttggtgaaggatgaagtggggtggaagaagtggggtgggtacgatgtgaaatctagaggtataactcagctggaccaatggtgtctgcaggtctgtaatgcagtttgaatcagagtgccatgctgtttctggtaccattgtgtttgaattgtgtggagtggcgacatttggttgtgtattgcaggtaaccatgtttaggaactttgaaatgatggtacagataatacaatatgacaagatgtcggggggaaaggaccttgaagagttgtaaaaacagggggggggggggcgaggggttggaaaatggagaggggttcaaagaacgggaggaaaagtggttgtcaaaaaacgggggaggggctgaaataggtgggctgggtaaggacaggtacca

SEQ ID NO: 667053 - DNA, 884 bp, Homo sapiens
  misc_feature (31)..(31): n is a, c, g, or t
  misc_feature (66)..(66): n is a, c, g, or t
  misc_feature (116)..(116): n is a, c, g, or t
  misc_feature (144)..(144): n is a, c, g, or t
  misc_feature (151)..(151): n is a, c, g, or t
  misc_feature (154)..(154): n is a, c, g, or t
  misc_feature (173)..(173): n is a, c, g, or t
  misc_feature (189)..(189): n is a, c, g, or t
  misc_feature (196)..(196): n is a, c, g, or t
  misc_feature (204)..(204): n is a, c, g, or t
  misc_feature (206)..(206): n is a, c, g, or t
  misc_feature (208)..(208): n is a, c, g, or t
  misc_feature (217)..(217): n is a, c, g, or t
  misc_feature (221)..(221): n is a, c, g, or t
  misc_feature (231)..(231): n is a, c, g, or t
  misc_feature (238)..(239): n is a, c, g, or t
  misc_feature (241)..(241): n is a, c, g, or t
  misc_feature (243)..(243): n is a, c, g, or t
  misc_feature (258)..(258): n is a, c, g, or t
  misc_feature (260)..(260): n is a, c, g, or t
  misc_feature (266)..(266): n is a, c, g, or t
  misc_feature (833)..(834): n is a, c, g, or t
  misc_feature (837)..(838): n is a, c, g, or t
  misc_feature (842)..(843): n is a, c, g, or t
  misc_feature (852)..(852): n is a, c, g, or t
aataacaagccttgtattcattgaagataanacagactatgtttaagatgttatgtgtcacctacncacccagccctgtttgcctgtgtggatggcatggggagattggatttgtngaatctcaataatgacacagaggtaccnactgccngcntttcatgtggagggtaatnctgctcttaatacgtntgagatngacccatncntncatatatantagntgtgggtgantctgaannananatttttatatacaantntggganagacacgattgctagttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatnntcnntcgnnatcctttgntgtctttataattcatgtggtagttacctata

SEQ ID NO: 667054 - DNA, 973 bp, Homo sapiens
  misc_feature (31)..(31): n is a, c, g, or t
  misc_feature (66)..(66): n is a, c, g, or t
  misc_feature (116)..(116): n is a, c, g, or t
  misc_feature (144)..(144): n is a, c, g, or t
  misc_feature (151)..(151): n is a, c, g, or t
  misc_feature (154)..(154): n is a, c, g, or t
  misc_feature (173)..(173): n is a, c, g, or t
  misc_feature (189)..(189): n is a, c, g, or t
  misc_feature (196)..(196): n is a, c, g, or t
  misc_feature (204)..(204): n is a, c, g, or t
  misc_feature (206)..(206): n is a, c, g, or t
  misc_feature (208)..(208): n is a, c, g, or t
  misc_feature (217)..(217): n is a, c, g, or t
  misc_feature (221)..(221): n is a, c, g, or t
  misc_feature (231)..(231): n is a, c, g, or t
  misc_feature (238)..(239): n is a, c, g, or t
  misc_feature (241)..(241): n is a, c, g, or t
  misc_feature (243)..(243): n is a, c, g, or t
  misc_feature (258)..(258): n is a, c, g, or t
  misc_feature (260)..(260): n is a, c, g, or t
  misc_feature (266)..(266): n is a, c, g, or t
  misc_feature (922)..(923): n is a, c, g, or t
  misc_feature (926)..(927): n is a, c, g, or t
  misc_feature (931)..(932): n is a, c, g, or t
  misc_feature (941)..(941): n is a, c, g, or t
aataacaagccttgtattcattgaagataanacagactatgtttaagatgttatgtgtcacctacncacccagccctgtttgcctgtgtggatggcatggggagattggatttgtngaatctcaataatgacacagaggtaccnactgccngcntttcatgtggagggtaatnctgctcttaatacgtntgagatngacccatncntncatatatantagntgtgggtgantctgaannananatttttatatacaantntggganagacacgattgctagttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaggaaatttcatggattaaaccatgggtttaatgcagcaaggaaacttacaatgtccctttatatataacatgcatcttgttttatataaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatnntcnntcgnnatcctttgntgtctttataattcatgtggtagttacctata

SEQ ID NO: 667055 - DNA, 1216 bp, Homo sapiens
  misc_feature (1216)..(1216): n is a, c, g, or t
ggccataatgatgaagacgacatagggacagaggcaatggaggctgccgagtatatgtcctctaggccttctaggcaaaactatgcgtagtagttccttcttgtgatcacagttatatggcgatatctatacaggaaaggtagatattgtaccgagcattcacggcgactgtgtgcgtactggttacaaacaagcgtacatgctcccaacaaggtggttatcgcatgtgtcgaagactggaacgattctacatatgttgcccaggcatgctgtccggcatctcgtatgtacatactaaacttacatgttagatggtgcaaagattctatgcccaaggagacacttaacatggtgcgtcatggatgcacatctcagcgctctaagagcccggggaagaagctatccttgcaatacgtcgctagaaagggatcaccatgacttcatggaatcaacggaacagcaagcccacacagaagaaacggtgaccttaggggtatctgagcgtaaaagaaggcgcgcaatggacctggtcataccacgccaggagaaaaggcagcactttgtggttgcacgaaactccaaatggtggtcacagcggatgcccctgtagacctggcatgggaaaaccataaagtatgcgcccgtaattggagactttacgatgggggcgattaaaataaagggtcgtcttagaacaaactagcaaaactcttacatatgtggaacccccttccatggggggctcgttatccatatccgatcagatgactccaccagagataacatcaaaatatctatccagaagaggtgaaccatctcgctcacatgtctaccgaggagtgttgacgagcggctagaccacgacatggggagtgcggtcttcaccacggtgcgaaaactgggggggcccctaccagagtgggcacaaacaccaataacagacggcgcgtaggagaaacaccaccgccggtaggtacaccacgacaaaacggtactcaatttaccacgttgggggcgatcaacccaaaaaaagaagggtgtggggagcacaccaacaaaccggctgtgcgagccgccggtgggggcaacccccccgctaaaaaatagagccgagaggagggaaccacaggaccaaatcaacgacaatggagggccagaacaaagcggggcccacgaggggggattaaaacaccccgggaaggaataaaaggaaacn

SEQ ID NO: 667056 - DNA, 292 bp, Homo sapiens
  misc_feature (36)..(36): n is a, c, g, or t
  misc_feature (40)..(40): n is a, c, g, or t
  misc_feature (42)..(42): n is a, c, g, or t
  misc_feature (44)..(44): n is a, c, g, or t
  misc_feature (47)..(47): n is a, c, g, or t
  misc_feature (49)..(49): n is a, c, g, or t
  misc_feature (56)..(56): n is a, c, g, or t
  misc_feature (83)..(83): n is a, c, g, or t
  misc_feature (89)..(89): n is a, c, g, or t
  misc_feature (91)..(91): n is a, c, g, or t
  misc_feature (119)..(120): n is a, c, g, or t
  misc_feature (123)..(123): n is a, c, g, or t
  misc_feature (125)..(125): n is a, c, g, or t
  misc_feature (171)..(171): n is a, c, g, or t
  misc_feature (219)..(219): n is a, c, g, or t
  misc_feature (275)..(275): n is a, c, g, or t
cgacgcgtaggtccagaccttctttagtcacggtgnacgnantngtngnaggtcanaatgggtgtgggcactcggcgtgtgcntgcacncnccgaaaacccatactgcacacgccgaannacnanactgcacacgccgagtgtccataccccttggtgacacaggtctgtntggacgaagttgttgcgcaacaacttcgtccacgtgacctgagaccanagtatggtgattcggcgtgtgcagcaacaacttcgtccatccggacttgaagtgtntggtcattcggcgtgtg

SEQ ID NO: 667057 - DNA, 224 bp, Homo sapiens
ccgataaaatgtggtctatcaacaattgaatattattcagctataaagataaaggaggccgagcgtggtggctcacgcctgtaatcccagcactttgggaaggtgaggcgggtggatcacctgaggtcaggagttcaagaccaacctggccacctcgtctctattaaaaatacaaaaattgccaggcacggtggctcacgcctgtaatcccagcactttgggag

SEQ ID NO: 667058 - DNA, 104 bp, Homo sapiens
aaccccacacccccagctcacacagcaaaaacaattggacaggcccagtagggtgaacgcaaacagtgtcccttcagggctgctgacggagcctccctcagtaa

SEQ ID NO: 667059 - DNA, 512 bp, Homo sapiens
  misc_feature (10)..(10): n is a, c, g, or t
  misc_feature (14)..(14): n is a, c, g, or t
  misc_feature (31)..(32): n is a, c, g, or t
  misc_feature (38)..(38): n is a, c, g, or t
catcgaagcnccgnttgcgccctttgcactnnctatcnggaatggcctctcgccattttcgtcgaaccctgcaaattggcccataatggccgggaccactttttatgtggtggtcattgtgcataccaaactacggtgggactcttgcgcatatgttgggttatacttcgtatccatgtctgataaacccgatatggctgatatcgagtaaatactcttagtctaatctgaagaagactgagacgcaagagactaatccactggctttcaaagaaacgattgatcaagatatgccagacagcgaatcgttatgaggtgagctccgtcaattagcactgaacattacccaaagtttgactaattacttacttcctttagctgattaactttgtaagactgcaaagatgaaggatcaagattaaatgattgtgcagccctttttatatcaatgaacttctgacgactgctgaagctgacaatgtccatctgtctatctaatatgtctggcacgt

SEQ ID NO: 667060 - DNA, 210 bp, Homo sapiens
gtgcagcagactgtctgtactggcgagcgcctgctgggcaggaatgcacgcggctcactatctgcgacatggcagaacgtctttcagtgtcagctgcctccaagctgctgtccaacatgatgtgccaataccggggcatgggcctctctattggcagtatgatctgttggctgggactagaccgggctcctggactctactacgtgaact

SEQ ID NO: 667061 - DNA, 971 bp, Homo sapiens
atttgtcctgtaaccttgtggagagaaatcccggcacaggatgaaacgctgctgtgacttattcgaactcctacgatgggtccacaatttatgcgtaactagcgccaagggatttgaacttgggttcgctcccactcgcactgcttggcgatcctctaagagctattgcacgagcctgaaaaaaagtagtgcaattgagtgctcagacgtggtaagcgttgcatagcacgttcactagatgtaaggaagctggtgactgaattggcttatggtgtggctcatcgtgagtgtgattgaatgctggttataagtgatctggcaggagacttatagcgtcacagcgtgggcaattcacttgtgctattgagtggtatgaatgaatcgagagtactattgacactaatcgtgattaataagtattcgactatatattaattatgagtagtcagtatggcaggcatagtagtagcattcaagaagcttgcgtaaatctgagattaataataatggatttggtatcaataactgcaagaatgtagattcgtgccatccaggaattactaccaatgcagaaggtttcaccatagtaaaatctttctttggcatttagtcaatagcctagggagataagcactatttagaaaccaagacccctcacaattgctacgctctaagtatcaagaccgcgaccagattcggggcaacagggactcactaagtgggtagcgcccgcactcatttgcaatcccctagagaaccacttggaaattacttccttccggtgcacatttaaccaggtttctaccaacatatgaggccaagcgcatatacgcgcaaagtaataacttctttcgttacaatacggagcgattacttatctccccctcggacacccagggcccaacgggcgataaccggaacgacggcgcgaaacacaaccgctaatataaccattggcccacagaacgtag

SEQ ID NO: 667062 - DNA, 462 bp, Homo sapiens
ggggaagggatggggtttaactgagcagcccagattgcactgcaagtactgtgctgaagtgacactcccgacattgactaccaaagagctgtgacgacaagtactgtcaccgcgctggcctgattggaatgataacgcgtcacacacgcatattacccggaagaacatggacaaatgctaggctctatggacatttaaacatgacttggctctgatcgacacactgctgggacccctgttgacttccacatggacacagtggcgggtgcatcctagggtctaaaggatacgtatgcagactctgcccctgagggtgatcatggtcacacacatttatactgaaaggccagcctatgctgctgaggacactatgccacagaggaggaccatatgctgacactgaggaccagagttgcccacaggcatggcgaatttggatgaacaatgcgtgatgccacacct

SEQ ID NO: 667063 - DNA, 162 bp, Homo sapiens
ctagattgatccccgttctccccgttgttcactttagtattaatgtgtacataaacaaaaatattatctaatattcaccctacactgaatcataatgccacagcttggctactcatacaaggactcagcaaacaatcagtaaagagcattctcgtgataaat

SEQ ID NO: 667064 - DNA, 1434 bp, Homo sapiens
  misc_feature (258)..(258): n is a, c, g, or t
  misc_feature (265)..(265): n is a, c, g, or t
  misc_feature (402)..(402): n is a, c, g, or t
  misc_feature (503)..(503): n is a, c, g, or t
  misc_feature (505)..(505): n is a, c, g, or t
  misc_feature (530)..(530): n is a, c, g, or t
  misc_feature (687)..(687): n is a, c, g, or t
  misc_feature (1221)..(1221): n is a, c, g, or t
agagaagaactaactgagttaaattgcacagagaagcagattactagtatattgccacttaaaccgtatggtggccaagtcggtagtacgataattgcattacactcataggagtgcgtggcatactgagatctcaaattattagtctttcagtagttctatccgatttttatcataatgagcacatcagtgggtatagtaatcacgtattctaacaagggcgattggacttacatagaactagctactttattatgncgactanttgacaaacgagaaggcgttcttaactgagtgtacgcccccatgcacaagtcttaattgaagaatggtaagactcataattccatggggattacctagttcaatgagatacttcaagaagaatgcgttatatagaanatatatatctaagagttagtagttaggtttgtagtcacctaaatgatatatcagttactatatatcacataatagagccatggaccatagacagtatagantntcttacacaaatacacagcgcaacnttgatggaatttaatacgataaacactcgagagacactctggtatattgaagtagatattgacactcggggcatatatgctggatataaagtctagcccatcgagacaaggacgaggaggcaccatggggctaccagcgattgggtctacaatctgnctcggtggatcaaatgctccccaggaatacttctttgtggaaccgctggaatgtgatatcgaagtgaagtcaaccgcagtgctctacaggtagcaatcgcaagaaactctattcacttaggactatgacaaacggcgctgggaaaaaaccacgcgaggggtcgtgatagtacaatggataacaaagaccaaactttaggacttggggtatcattagggtcgagcaagccgatgcacgtagataggatactcactagggcgaatcgtgctaggaggaccgtgagcttaggaggaggccaagggcaaaggaaataccccgggggatggtaaaacgcacagaagggaccctcgcgggaggggtgcatagtggctttggccatggtcggaccaaaagggcacaaaattctattggccccaccggttggtatcttctcacgtgcgtagggaacggaacgaagaagacggggaggggagtaaaccccgttgcttccccccaagatttatcccccaaaccttattaccccaacaaagtctngtgggccagaggggaaaagaggagcttaccgctacattaaaacaggcgggagaaaaaaatagaagccggtcactactgtgtggcaagaagaacccgtctgtgtgcttatatgttctggggtgagacagtctttctcgcgcacaccattatgtctgcctcaagagggaacgacaggcagtcggtcgtcgtactccccagcgcaagaatacacag

SEQ ID NO: 667065 - DNA, 169 bp, Homo sapiens
gtcccgatgctggattgggaccgtgttcattggttctatcactagaatcatctttcaaagattgggccttggggtgtaaaacctgctcttccttgctgctgaccttatcattgcccctctccctgtgtagagagtctccgttgagactgggaccgccctcgaattcgta

SEQ ID NO: 667066 - DNA, 939 bp, Homo sapiens
aggtcggcgctggggagtggagccgacgccatgtctgcgcatctggaatggatggtcgtgcggaactgctccagatccctgatcaagaggaatacgcatgagctacagcactgagcccaatacccttgaagggcctggtagattccttccgctacaagcggacgtgattacagccggcaacgacgtgtgggctgtggatgccggtatgccgagcggctaataggtgtcgtggtggtcattaacgtcgggggatcgcggcccagcggtaatgcctggcaccctcgctatgtgctggaccaccatacgaacaagtaatgtcgtcgcgcgcacgcgtcagcagcatgcagacacatgatccgcaaagaacaaagtatcgacccgacctgcgcactggtgagctggggtgttggggatcacggtgttggggagagtggaccagtgctgtggggacatgggcctcccatctactggttgcttctatgggctgggacgagggatggatgtcttggctttgcagtctagctccccatcacccagtcgttgggctagggggcggctggtgtgatgtgtataggtgctgagccttgctctgttcccccgtccgcaggtagccatccgagggcctagcgcatcctgggcagtcagacgcctgtgatggtgaggaagaatgctggaccctggcgccgacctatgagctcctgagcccacctgggccaagagggataaaagtgcagctggcttagtcagccaggagcaaacccaggcaaaacaggtggcgctggccaagatttgcggcaagcatggagaaacaagcccgaggagggcttggggcaacagtgggccaaaagacacgaaaaaaaaaggacggggcgggtaaaacggcacgaaggcaaaggcagcgattttgagccacttggggggaacagggacaccacagga

SEQ ID NO: 667067 - DNA, 198 bp, Homo sapiens
  misc_feature (1)..(1): n is a, c, g, or t
ncccacggctttaatttcatgaaaacccagcgctggggtttttttctaatagttgtgaacatgtaccaccaatgaaaatgaaaggtttatctcgtgtgcccagaaacccaaggtttatcaaatgctcttaggaaccttgttttctttacacatgccataccgcccattccatgatttaaacccatccgagaaatacca

SEQ ID NO: 667068 - DNA, 237 bp, Homo sapiens
cccccccaccccacccccacccttgactacccattgctccgccgccccccccacatcaaccaagcaaagcatcttcaaatcaaactgtgtccggaattggtgggttcttggtctcactgacttcaagaatgaagccacggaccctggcagtgagtgttacagctcttaaggtggcgtttctggagtccgtctcttctgatgtttagatgtgttcggtgtttcttccttctggtgggt

SEQ ID NO: 667069 - DNA, 519 bp, Homo sapiens
gatagagaagattaggcctgtgcaatacacattggcggagcagaagaggtcgtcttccaagaagagcactccagactcagaactcagaaatacgtagaagatgatagaaggcaaagaagattatcagtttgatgaactcaacacagagattctgaataacttagcagatcaggagttacaactcaatcatctaaagaactccattaccagttattatggtgctgcaggtagaatagcatgtggcgaaaaataccgagttttggcacgtcgggtgacacttgatggaaaggtgcagtatcttgtggaatgggaaggagcaattgcatcctgactgtaggactgaacattatgttcactgcactctgattttctgtaggtacagttcaaagccctaaaggagtctggctttcactatctttcttaaaaaacaaaaaaagtcaaaaaactccaaaaaaggggatgctactagccttcacatgtccctctcaaagtaatggatatggtcataaaagggtatcg

SEQ ID NO: 667070 - DNA, 762 bp, Homo sapiens
  misc_feature (302)..(302): n is a, c, g, or t
gtgaggggggtcagggtcacggcgtcgggaattccaggatgtccaggagtgaggcgctggctgcgtcatagtgcccggcatgcactgggcgtgatcgacgtctaggaagcccaacgtgtgggaagcggaccgagatgtggtgaactgggattgtgctaccggcaagacagaggacttgcttcagcatctgggctggatctccaatgatgtaccgtagccaccgtctgagggtcaagagctgcctgggaatccgaattatacaaccgaaggtattcgatcttacaaacgctggagctcatgtngacttcgatgtcgcgaacggcgcctcgtggctgtcgcatgatcgcgcagttcgcctggggtttggtcaagaccatacttctgtggcagtacactggcacagaaggaaacgtgtggcagcggttagcgtgcgacacacatggtgcgagaacgcatggtctagcacatgggtacgtgcagggcacgagactgtgcgcgccggccccatatgtacttggcagcgctggagcccgtgacagcgaggcaggcagtacatagcgtagagctcagccaggggtgggtggaagggagatgcacgctgcctagtgggaaagcctgtcttcctcattggaccagcaggctcggcttgtctacagcttgctctagtttcctgcttgcgccagccccaggcctggaacggaccgctttattgagtggcttcatctctcttggggctccctggggtggctccatcaagcccat

SEQ ID NO: 667071 - DNA, 457 bp, Homo sapiens
ctctcactccttttgccctctgctttactctcatgtggcaaacgtgccgatcgcggtgtgagtgccagaacctgcctccttggtttggtcaccgtgtgcatcgcaccgatctgtaaatgtggcagactcagcctgcggccaggctttttatttaatgtaaatagtttttgtttccaatgacgcagttactggtactcctatgcaatattactcacttttttttattgtaaaaagaaaaatcaactcactgttcattgctgacaggggatgtacgcccatggacacctggccttcaagagtcgctgtgttgtgagagccggccacacccttggctttagagctgcgttgaaaaccatcttggtggtaaggttttaacccaaactcactgcatttcttaaaatagttctgaatccacctcgagaacacttgaacacacagaacaggagaccccccctag

SEQ ID NO: 667072 - DNA, 207 bp, Homo sapiens
  misc_feature (162)..(163): n is a, c, g, or t
  misc_feature (193)..(193): n is a, c, g, or t
accagcataactattacagcataactattacagcataaactattacagcataaactattacagcataaactattctgcatcacaggtattatgaataacttaataacaaagtaatcctaatttctccttccagtctcttgtaacattgctcagcatttatcnntctctatacacagaagcgtgtcgtgcacantatgcagatatgta

SEQ ID NO: 667073 - DNA, 122 bp, Homo sapiens
cgtgccccttcttactctcgcgagacttcccaacggtgggcttggctgtaggttccttcccccccttaccttctcctgtgatatccagcgcctttggacacctttttcaccattgagtgtgg

SEQ ID NO: 667074 - DNA, 548 bp, Homo sapiens
  misc_feature (144)..(144): n is a, c, g, or t
  misc_feature (162)..(162): n is a, c, g, or t
  misc_feature (173)..(173): n is a, c, g, or t
  misc_feature (288)..(288): n is a, c, g, or t
tactttcacaggagggtgtgagccaccgcgcccggcctgaaaagtgcatcttcattttacagggaattctttcaaatcaaataatcaaaaactgtaaaagggggcaaagtacttttttgcagatctacaagtttcttatgtaantaggaaaaaaagcctttncttttctggtntaagcatttaaattaaaagaggaatgaaactgttttctatccacaatgtgtgaggatgttttttatactgctgcctgaagtttaagttgctgattactttttaaatagataattnggtggtaagtactatattttaaaaatgcgtatgcccgttacccttcaattccattatactaaaatacccttgggaaatagagatacatgcactttgtttttcacagcacttattttaaagagaacccatagaatggatcttataagtaaatttcagttgcatccataggatgcaataatatgtgaccatcaaaggtgacaatagatatagaagtacgttgatgtgcaaagatgtattttgttttagccctgtggaacagc

SEQ ID NO: 667075 - DNA, 208 bp, Homo sapiens
cttaattcttactgaatagaaatactagaatgtctttgttgggagaaaaaaactagataagtaaatcaatgtttactatattttaaagatttgtttttgttttgtgagacagagtctcactgcccaggctggagtgcagtggcagtgattttggctcagtgcagctgccatctcctgggttcaagtgattcacttgcctccgcctccc

SEQ ID NO: 667076 - DNA, 270 bp, Homo sapiens
  misc_feature (9)..(9): n is a, c, g, or t
  misc_feature (61)..(62): n is a, c, g, or t
  misc_feature (83)..(83): n is a, c, g, or t
  misc_feature (143)..(143): n is a, c, g, or t
  misc_feature (148)..(148): n is a, c, g, or t
  misc_feature (153)..(153): n is a, c, g, or t
  misc_feature (162)..(162): n is a, c, g, or t
  misc_feature (165)..(165): n is a, c, g, or t
  misc_feature (177)..(177): n is a, c, g, or t
  misc_feature (198)..(198): n is a, c, g, or t
  misc_feature (243)..(243): n is a, c, g, or t
  misc_feature (246)..(246): n is a, c, g, or t
  misc_feature (254)..(254): n is a, c, g, or t
  misc_feature (263)..(263): n is a, c, g, or t
tcctttttntaatcatccctccatatcccccccagatctgactgaactcgtactttgggannctttgtgcatgaactatacanagagtatctgaaactaactgttgcctgcatagtcatatcgagtgtgcacttactgtatanctttncattnacatacttntanggaaaatatttngtctgcacttgtataaatacntctttatgtatttcattttccataactcactttaatttttgatgnaanttgtcttngtgaaatantttaaca

SEQ ID NO: 667077 - DNA, 115 bp, Homo sapiens
tcccgcctacgtggaatactcccatctactgttagagtggaaagactgtggtctttctggcagttgagtaatggtctccaggcctggctcagcccctcgctagctgtgccctcag

SEQ ID NO: 667078 - DNA, 138 bp, Homo sapiens
  misc_feature (3)..(3): n is a, c, g, or t
  misc_feature (9)..(9): n is a, c, g, or t
  misc_feature (72)..(72): n is a, c, g, or t
ccncaccgngtttaaacaggctttcattggtcatccttgcaatccattggggtctagtttggatctgtcctngcagcaagctcatctcaaaaataaataaaaataataaaacctccataagtaatcctgaaaaaaaaa

SEQ ID NO: 667079 - DNA, 793 bp, Homo sapiens
caaatgcaggctgtactgcccctggaattttgggatggggtcgcggcgccattgggcgtggggggagagctccggggttggcctggagccccgccccccggccttgcgtgctgtgacaatagtgcgccgctgcgtgtggcggggctgtcgtgcggcagcagggcggctgagtgtggccgctggagctcacggcggctgggctgctggctaggtgattggctgaaggagcaactgtgagagaatgggccgcgctgcgccctgcggccggggaaagcctgtctgggaaccctgggagagcctgtgccctatgggcccctgaccgcctgcaaccaccgactgaactcagctctctcgggtctgactcggaggccaacggcttcgccgagcgccgcatcgacaagttcggcttcatctgtgggctcgcagggcgccgagggcgctgctggaggaagtacccctggaggtgctgaggcagaggggagtccaacgtggctgggacattgctcaaacaactgggacaaactggatggccaagaagcacaaaaagattcgtctgcgggtgccaaaaacggtgcatacctgccttctctgcggggcacgtgcattggcagatagctgtcaggaggcaaggtgaagttaacagcagaagcctggaaagtctgacgaggctggacatgtccccttggggaccccaagtggcctgcaacgttgattgagcgttgaccttgcaccggcagttcccaatcccatgagatgtagcagtaccaggtgggtccacggccagacaggagca

SEQ ID NO: 667080 - DNA, 706 bp, Homo sapiens
  misc_feature (463)..(463): n is a, c, g, or t
tgctcaggtgattatcctggaccattcaggcctaatttagccccggctatgcccctgtattggattgcccacacggcgtcacaatgcaagccagtttgctgagctgaaggaaagattgatcccccttctggtaaaaagctggacagatggccctaaattcttgaagtctgggtgatgctgcccttgttgatatggttccctgccagccccatgtgtgttgagagcttttccagactatcccccctttgggtcgctttgctgttccgtgatatgagcaccagcaccagttcgccggtgggtgtcttatccaaagccagtggcaccagaaggctgctggagctggccaggtctccccagtctgccccagaaagctccagaaggcctaaatggatattatccccttataccctgcccacccccacatcctttaatccagtggtggaagaaccggtctccagaactngtttgtttccaattggcccatttaagttttagtagttaaagactgggtttcatgatacacccatgccatctgttaaacctctcagaaggaaaggagaatgttttgtggacccctcttggttttcttttttgcgtgtggccgttttaagttattagtttttaaaatccgtactttcttcatggaaaccacttgaccccaaatttgtcaccgaattttgagacccctttaaaaagtttaatgaga

SEQ ID NO: 667081 - DNA, 1642 bp, Homo sapiens
  misc_feature (665)..(665): n is a, c, g, or t
  misc_feature (1642)..(1642): n is a, c, g, or t
tgtggtttttggaaataaagtctgggctctgtcacctaaggctgggagtgcaagggtgcaatctctcggcctcaggtgcgaacctctctgtggctttccgtgggttctcaggggaattcctccgtgcctttagcccctcccgaagtgtggcgtgggaatgtgcgggtgtgcccgcccgcccgcgcccgcggctataatttgtgtgttttctcaagtgtggagagacacagaaagtgtattccaccagagtgtgtgtgcgccgaggtgtgggtctctctccaaaactctcctgtgaacctctcgaggtgtatactcttgtgccacacactctctgcggcctcctcttgtgagagagtctcgtggagaaatgtgccgagcgcgtgtaggaccccatgtgtgtgtcgcccggtgccacatataaagacaagacacctttatattatatatatgttctctataaacagattctcacatctcatatatgtgagagaagaaatctctatatgtgctggcgccaggcgtgtgtgcgcccttgtgcggctgttgtgggctattctcctctccctgctctgtgtgtataactctcacgagcgcctattatagagctgtgggagagagtgtgattggtgtgaataagacaaaattattttctacaaggagaagcnacgatgtgggcgacaagacaacacgaggaacaccacaccttattagaacagtctttctccccacttcgactgtgatgcccccctgttgttgggccccccgaagtggcgctattattgaggggggacacgagaacgccaagagggtggcggcccacacgagcggcactttttgtaaacaacccccagctgttgcaactctatagaagatttccccccccttcgaggggcccccctcttatttctttctcccgatgaaggagggtcttataacaacacacacgaaaagggcgcacaagtggctccctttccgtggtgtggcccccaaagaaaacacttctcaagcgcggaaccttttcgtcaagcggcaacataatcaaaggggtcgcacacgggggcctactatttcacaccgacgaggacaccttataggaggcccccctgtggtataatgcgaggacacaagcgggtatatcccaccacctctgagtgcacgcaacatcatattacacacccgatttatcaaaccgccagctgtggggctctctctacaaacaacaagacaagattttttgacgaaagaacactcgtcgagggacagagagctcaaaaaaagggggcccccattaagcacttattggcggcgatcctcactacagtggatgtaccccccctcagaatttacccccaggcggtttcatcaccacaagtgcggccaacaaacaattaaacccccgtgagaggggcgaacacattattatgttctgtataatccctccaaagtgtccccactggtgttgctcacaccagtcctgtgagaacaacaacaagactctttattagtaacataatcgctgcggaatataatgagcacacacgaatcctattggatctgaatcaactctattatgattgcaccacacagcaagaagcaaccgattaaaaatataaacacgcgtcggtcacacaccattagttcn

SEQ ID NO: 667082 - DNA, 185 bp, Homo sapiens
tatggtgtgtgtcctgctggcggttaagtgcctgagcctctgtggtgaaagttcctggtgttccgcactgtgggctcctccagctgctgactgcagtctctgctgttccaactgttcctcatagggtgattggaatatgatcattggcttgcgtgaagggtacacctcagcatgcgcgtgccttt

SEQ ID NO: 667083 - DNA, 183 bp, Homo sapiens
aggacccgaaaactgacaggagtcaccacatggtactggtgaagggccaaatagaatttgggtttgggatttgtttgcttgcttttgttttgagatggggtctcactctgttgcccaggctggagtgtagtggcacaatctcagctcactgcaacctcctcctccctacctcaagcgattctc

SEQ ID NO: 667084 - DNA, 139 bp, Homo sapiens
gtgccgtgaggacgcgccatggcttaagccgctggagggtcgccgctgcaagcctggtgctgctgccgccggtgaaggcagtgctgccgcgggctctgctgcccctaatacgccatggtggctgtggaccctgagggcg

SEQ ID NO: 667085 - DNA, 777 bp, Homo sapiens
tgaacttcctgtgctcgggaggggtgcagtgattttgtactgtgggagtctgagagctgaggatgtgtcctgaaatgcctgaatcacagtcgttcggaaagaggagtgagctgaaggctcgagctgtccgtgaagagggtgtggcctcgtgctgtgtgccttagcctccagagcttcttgacctgctgacgggaacacccgaagggggacgcccactttgcaagagtggtggtgccaaaatggacctttgtaagtgtgtggctgtgtcgccgctgcttgcggaggtttgtttattcactgctccaatggctgcgaattgtgatgtgattgcttgggttgtgtgtgatgggttggctgaactgtgcctgctccccttgtgttgttgtgcgtgatgcctgatgtgctgtgttgctatggtggccctcctgtgtggaagctgccttggtgttgttgtgtgtggggcctgcactgtgtagtgcttgccccttgccccctgttgtgggcccccctgccatgaactcggcgcctgtggcctccacgctgcttgctgatgccctgaacgagtgcgcggtctctttgtgccgagatcggcgcccggtgacgtctgagtcagctgccccgcagtccagactctcggacaccacagacttggcctgacaatccttacaatgcgccagcaaagagtgagagcttccagggagcagagcagccttgggaagctgagtgccgggagacccgtccgtcaggagctcctggagaagattacggaggccaggt

SEQ ID NO: 667086 - DNA, 785 bp, Homo sapiens
  misc_feature (7)..(7): n is a, c, g, or t
  misc_feature (401)..(401): n is a, c, g, or t
  misc_feature (691)..(691): n is a, c, g, or t
  misc_feature (696)..(696): n is a, c, g, or t
  misc_feature (706)..(706): n is a, c, g, or t
  misc_feature (710)..(710): n is a, c, g, or t
  misc_feature (723)..(723): n is a, c, g, or t
  misc_feature (725)..(725): n is a, c, g, or t
  misc_feature (728)..(728): n is a, c, g, or t
  misc_feature (731)..(731): n is a, c, g, or t
  misc_feature (733)..(733): n is a, c, g, or t
  misc_feature (739)..(739): n is a, c, g, or t
  misc_feature (744)..(745): n is a, c, g, or t
  misc_feature (749)..(749): n is a, c, g, or t
  misc_feature (754)..(754): n is a, c, g, or t
  misc_feature (758)..(758): n is a, c, g, or t
agcgggncgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagacccagccctagtgtcagggcgggggcctggagcagacccgaggcactgcagcagaagagagaaaagacaacgacgaccctcagactcgccagtccggtcgctggcttcgccgacgccatggcaatgagacagacgccggatcacctgctctggccacaccgcgacccgtggtttgatttggccttcaggnggcatcacgccttatgggtattctcttaaatcagcgcttgcaaaggatggtaaaacctatgctacgccagggagatacaggagactggatatggaacatttatgggtcataaaggtgctgtatggggtgcaaaactgaataaggatgccaccaaagacagctacagcagctgcatgatttcacagcccaaagtgtgggatgctgtctcaggagatgaattgatgaccctggctcataaacacattgtcaagactgtggatttcacgcaggatagtatgatttgttaaacnggggncaggataacntgtnacgcatatttgantngancananctgaancagannctanggaanttantggtaataaattctggttataacaaca

SEQ ID NO: 667087 - DNA, 911 bp, Homo sapiens
  misc_feature (7)..(7): n is a, c, g, or t
  misc_feature (911)..(911): n is a, c, g, or t
agcgggncgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagacccagccctagtgtcagggcgggggcctggagcagacccgaggcactgcagcagaagagagaaaagacaacgacgaccctcagactcgccagtccggatcagcatgagcatatcaccgaccgacacaatggacaaatgagagacagacagacacgacatcaaccatagacaacatgagacacaacaacagcagaccgcacgcagcgtagaaatctatgagcacatattcacgaagagaccaatcaaacagccatataaatgagagctactaatccatctacaccagtcaagacgactacagacacacagacatggataaacacacatatgacataaacagcccaaaggagaagacataccaagcgaacgcccctggaaactatggaacaaccacattacaaagcgagatcacgatacccatacgatggccactgctatccatgacgacgactagccaccacacacattggaacacttacacaggcattgacacacacccacaaaagaacaacaccataacacacacaaagacgtagccacagaataaatcacacacacagacgccaaacacggactgttggatacacattgacacttgatccctacaagaggcaagcacatggcacatgacggcattgccccccctggggacttacaataaaacacaacactttgctacaacaggaccttgtttgagcan

SEQ ID NO: 667088 - DNA, 815 bp, Homo sapiens
tgttgcgtgttgccgggagaagtagagccgaggtggaaagggtgccgtgaggtgatgtgtgcagttcccgcaattcacaggggtattgggaaaacatgcgcaggcggtgcgaagtgtgtaataagtaagcgcttataggatggaccggtggctaatggtgttggaatggaaggtgaaaggtggtgtagtgaacgttattgtgtctgaccagggggataaagcgtcaacgcaattcctgctacatctgggagcgcgtagttctagaaatcactagggatatgtgttgaataaagacgcaatagttgataggtctagtctgatctactcacttatgaaaagttataaggggcatgttgtgtcatttcagagtataggcgaggttgttaacaggttagtttttgttgttcgccagtcgggtaagaagtgaaaggttgttctagttcgtaaagtcgttggctaatcgcgagcacttaattgtaagacaacgtcttgcctggcattgccagtgtagtgttcgagtacctagccttatgttaggagttccatgttgctccttccctccactagattttatgtatttctcatatggcttctgtcactcataaagttataataattacttcgaacggcattacatcagaagatcaatcatatagaatcaaaaaagccatcaattcaaaaaacaaaagaaaaatataatataacaaatcaatagaataaataataacaaagaaaatcagaaaattatcaagaataacatatctcacatgaataaaggagaataagaaatcaaataacaaaaaacaccaaaatgc

SEQ ID NO: 667089 - DNA, 124 bp, Homo sapiens
atgagtggctctgcttcaggaagcatgttataatgtgtgttcctacacaagcctctggcaaagtggtttaggaagcttctgggctaggagagacacatgaaacacaaaacacaaagtatgtgag

SEQ ID NO: 667090 - DNA, 432 bp, Homo sapiens
aggggcatcaacaagaagaccaggactagtactgagggcggccgcagccctggctgactgcacggcttccccgtgcctccctccctgctccactcccacattatagtcctttcctaacacggtcggccgggtgctttgtgtcatagctgcagcactggggagccaggcgaggggggcttgggggcatggggccggaaagcaggcaaaagcccgtcctgggaggtgctggcccagttggtgggacccctgtccacacccaccctatttatttccgttgactctttgctgtgtcgcccaacatttcccagggtgctggtggtacctgccccaatcagccacctgtttctgataagccactgttgtgtatttgacaatatcattagttatattatacttactggattttcccttgccttttacctgttattattc

SEQ ID NO: 667091 - DNA, 227 bp, Homo sapiens
aataaactcaacccgttgtccaacccgtttttctactctaccatcctttgcaggcacactctatcacagcgctaagctcgcactgatttatatacctgagtgggcctagaaataaacatgctagcttttattccagttcttaccaaaaaaataaaccctcgcttccacatgaagctgccaccaagttatttcctcactgcaagctacgcgcgatattatgatacctg

SEQ ID NO: 667092 - DNA, 1445 bp, Homo sapiens
  misc_feature (138)..(138): n is a, c, g, or t
  misc_feature (720)..(720): n is a, c, g, or t
tgccttggaccccagctctcctcccccttgctctctaaggatgggccagaaggcatgaatctcctaacccctggcgcctacaggccgacgagacgcgtgaccccatgagcgcagaaaggatgatggagaattagcatntgtggactaaccgacagtctctaacgcggcacgttcacaatgtgatgacgtttgagattgggcgatccctctgcggcaaagcgtcgtttgtattgcctattaggcactgagtgtcctctctctgttctcttcctccctaggcacagtcccgaacatacctggcgatctcgtaccacatcgtattattctattgaccaggaggcaggattctactttgattcgtattgaggtaatagctctcgccacgccgcgagggagacctcgttagcatagagtagactagcaaggacaggagtcatgggcgaaccaattgttgcaccgaagacatgaccgaaatcgaagccatcgattacatgcgcatgggaggttaggcgatggacttgctgctacagtagttacctagcccatgtgggtgaaccgcaaagggtgacttgccatcaggagaacctataaaagtccaggtacaaagtcctggctactataaggggtctgcaccgtgggaggaaggcctggaaaggaattgggctggacattccgggcgtggtctcgtggtggccattgtcggacacctgccccttgaanagaacgcgaaacgaacacactggttggttggggcgacctcgtgtggaaccttatccctaggcccctcaagaaggaatggaccttggcaggggccgggcatgcaccaactggaagaaacgggtgtgcattcttgctcggttggcattagggaagttggctattggcgtaattgaacgctagcctggggttgggggggaaaaacgcaacctcccttttggagagacggtgcgagtctaccagcaagcggaagaaaccgtaaattggggacggaatatcgttccgaaagggttgggacgcctataaaatgtcttccccacggcttttctccgtgtgccccagtggggggaggccacccaggggaccttctatctctgccccaaatctgggtcccagggatgaaaccccttggggaaaacagggggttgtgcccgccgggggtgcccaaagggagtgtcagagcaccaacccccggttggcccggggggcaaccaccttggcagagggggggaggcacccaccaggcgaagaaaaaaaggtaggcagaaaaggagacccgcagaataacacggggcagcgacggaggagacacggaagctcgtgcgcagcaacacacaacaccagccgcaagagtaacacaccgtggagtaagagccgcccggtgcggaaagaaagcaaagacaaaaaacggcgagcacgacgcggacccacacacatatactagcagg

SEQ ID NO: 667093 - DNA, 135 bp, Homo sapiens
cgagatgcgggtcacggcgccccgaaccgtcctcctgctgctcttgggggcagtcgccctgacccagaccttggcccggcttccacttcatgaggtatttctacaaccgcatgtcccggccccgcccccggggag

SEQ ID NO: 667094 - DNA, 300 bp, Homo sapiens
ggccctttccagaggagacgattaatttgtcctaaagccgccgaagcagaaaccactgatgaaacactctgcgttcttttcttttacaaccccacgaacgcgcaaaaaaaaaaaaacccaaacccaacacgagaaagaaacacccccccaacccccactctttgtgggaaaaaaaggggttgtgcatggggggaaacacaataatttcaaaacttacacataagggggagctctataactcaactctttaaaaaaggtatatgagatatccagtcataaccaacacgggattggctttga

SEQ ID NO: 667095 - DNA, 152 bp, Homo sapiens
ctctggtaagtggatagtgttgccatcaatgaccccttcattgacctcactacatggttacatgttccatatgattccacccatggcaaattccatggcacgtaaggcttgagacgggagcgtgtgatcatggaatccatcaccatctccag

SEQ ID NO: 667096 - DNA, 422 bp, Homo sapiens
  misc_feature (48)..(48): n is a, c, g, or t
  misc_feature (267)..(267): n is a, c, g, or t
  misc_feature (397)..(397): n is a, c, g, or t
  misc_feature (421)..(421): n is a, c, g, or t
ttttttttttttcctgttctaaggccatttaaataaacttccattccngctagggaacttgccttggtctctttctgctttacatccctcagttgaattctttcttctgaaaatgcaagggctgaagttgctgtggatgagtacagatttgcccttggtaactcggggtaacttggttttcagccaccaataacattatctgaaattccatatttgggaaaattataacttaggaacttaaaactcagtatagtcatcctttgatanctgtgggggatttgttccaggactccactacagataccaaaatctgtagatggtcaagtctcttatagaaaatggcataatgtttggtatattacttatgcatattctctcatatggctttaaatcatcnttaggatttaaatttataaataanc

SEQ ID NO: 667097 - DNA, 468 bp, Homo sapiens
gcacgaggttggggaaatggagagatgttggtcaagggatagaaattttcaattatgcagaaaaagtaatttctggggacctaacgtagagcatggtgactatagttagtaatactatattgtataattgaaatcagcttagagagtaggtcttaaatgttctcactacacaaagagataattacgagaggtgatgtatatgttaactagcttgattgtggtaatcatttcataatatatacatatatcaaaacatcacagtgtacagcatacataaatatattcaatttttttgtcattacacctcattaaagctgaacagaaaagcatcactgataaatttctaaaataataatgataattggccagacgagatggctcacgcctgtaatacatatatacatatatacatatatatctgggcatgtatgtgtgtatatatacacatatgcacagatatatacatat

SEQ ID NO: 667098 - DNA, 251 bp, Homo sapiens
tcaaaggtccttacagtctattctaacccctgtagacagggactagaagtactaacctcattgtaatgaggtttaagagaaggcccagcactaagccaggctctcagtgacaattcaaacaacatgttcctctattgcccgttcaagtatacgcccctatttcatctagtcattgggctgaatgaaccacatggacctgtacaaccatagcacacaggtaataagtaccacatgaccacggtgcaaggcct

SEQ ID NO: 667099 - DNA, 151 bp, Homo sapiens
atcttgccataaactaagtgaacacctccccagtgactggcccagtttctgacgacccctatttagagatatcctatctatggtctactccagggcagggtgtcgatggtacatgcacattgctctctgatcctcaacagtcttgcctatg

SEQ ID NO: 667100 - DNA, 292 bp, Homo sapiens
tcgttttttgataggcgagcagaatgtaagacttcaccagtcaagcgaactactatactcaattgatccaataacttgtacacggaacaagttaccctagggataacagcgcaatcctattctagagtccatatcaacaatagggtttacgacctctgatgttggatcaggacatcccgatggtgcagccgctattaaaggttcgtttgttcaacgattaaagtcctacgtgatctgagttcagaacggagtaatcccagggcgggtactatctacttcaaatttcttccta

SEQ ID NO: 667101 - DNA, 556 bp, Homo sapiens
  misc_feature (1)..(1): n is a, c, g, or t
  misc_feature (5)..(5): n is a, c, g, or t
  misc_feature (33)..(33): n is a, c, g, or t
  misc_feature (99)..(99): n is a, c, g, or t
  misc_feature (109)..(109): n is a, c, g, or t
  misc_feature (210)..(210): n is a, c, g, or t
nttgnaagcacccaaaaagtccttcaatagggnatagccaaaacttaatggaatattatttagggctagaaataaatgagccatcacgtcacaaagagncatggagaanccttccatgcatattactaagtgaaagaggccactctgaaaagactacctattgtttgattccaactatatgacattctagaaaagttaaaactatggagncagtaaaaaggtcagtggttgccaggggctgggaggacagagggatgaaaaggtggaacagggaggatttcagggcggtgaaactactctgtgtgatattacactggcggatgcatgtcactgtgcacttgtccagacccacagaatgtgcacccccaagtgtgaaccctcgtatggactatgaactctaagcaataatgacatgtccgtgtagggtcatcagttacacatgtaccagtctgatgtgggatgatggtagtaagggaccctgtgcctgtgtggtgggaggaggtgtgtgggaactctgtacttctactcacttttgctgtgaacctaaaactgctct

SEQ ID NO: 667102 - DNA, 416 bp, Homo sapiens
aaatataactggaaaatactgtgtctaaagaaatttcagggttctatcattaaattatgtacttaaaaaaaaaaaggggaaaaaaaaaaaaaaaaaaagaaaaaaaaaaaaaaaaaaaaatgaaggccagaaagggccaaaaaagaatatagactaaagcaagttaatgaaaaggggccgaaattagagctaactgggccaattagccaaatagggggggggattaaaattaatgggccgtggtttaaaaacgttttgacggggaaaaccttggggggcccaagggaaaaagcctggaaaaagaggccctttttgaaagatgggggaatagcaaaaaaggcccgaaccgggggaaattccgagcggttgccacagcttgaagggggaagggaaatcgcatgttgaaaaattgggat

SEQ ID NO: 667103 - DNA, 846 bp, Homo sapiens
gacccacgtacgcaggtagcaagagtgccatggaagaggctgaagcgcggcatcattcacgctagaggactggttcgggagtgcttgtgcagaaacggaacggaagtgccagatcctagctgccttgttggttttgaaggatttccatctttttacaagatgagaagttacagttcatctcccctgttcagatgaaacccttgtgttcgaaaatggttacagttcgtttttcctcccatggttcacgttggctctgaacctacagtctcaacgattgagaacacagatgttgcagttaattaggatttgcatatcaagtagttaggaactgcccaggttgtatgccgttgtgtttaagcattgattttcaagatgctcggaaagttatcttacagcgaaagctgtggagttgcctccatagacagccagtgtctccctgttaatcttctctttggtatacactttgttagcccatgggtgtactattggtgccttttcagtaagctaataccactgtagggattttgtttggaacgcatattgacagcacgctttacttagtagccggttcccatttgccatacaatgtaggttctgcttaatgtaacttattttttgcttaagcatttgcatgactattagtgcttcaaagtccccttttacagaatgcacaggttataaataccgaagaaagagcgccaccaaactaacaaggaccccgaacactttcatactaagactgtaaggtagaatctcaattctggcgttattgtaaggtgagtaacaccatctggaagaaaatgactaaaactggttgcgtctctgcatggtttataactgaagtaa

SEQ ID NO: 667104 - DNA, 447 bp, Homo sapiens
gatggagtctccttctgttacccaggctggagtgcagtggcacgatcttggctcactgcaacctctgcctcccgggttcaagcaattctctgcctcagcctcccaagtagctgggattacaggcgcccccaccatgcctggctaatttttgtatttttagtagagacctggtttcaccatcttggccttgaactcctgaccttgtgatccactggccttggcctctcaaagttctgggattacaggtgtgagccatcgtacccggcagccctggtttcttctttagtttattggtcttggttttgatcaccacagtcacttttttgttctttttcctggtaagccgggagtcaaaacactttcccgaaaatgccagaattagaatttctacctactttgttcactctaggctcgaggtttcctatctctcactatcttgcttactgg

SEQ ID NO: 667105 - DNA, 431 bp, Homo sapiens
ggccccagggccttttcccctcaaacaaaatttgtgcaagacttctttgaaattatttttgttattaaaatacattaaagtaaacgtaagagaaaaaaaaaaaaatttaatattaccaaaatggcccctttatgtgcactggggtcttgggtatagggactctatcacctgaataattactttttaaaattataaggggggatttatttatttgtattcggcttgggggggggccctttggaattttccacatttggaatttatgtttgggtttatgggaaaattggttcaagggaatggggaatcattttactgtcagggtatatttgtttttcttaactgcatattgtcagactaatatttttgggaggggtttgaaatcttttaatatccagatgatctcatttgaggttttgaaaaagaaaccattg

SEQ ID NO: 667106 - DNA, 80 bp, Homo sapiens
ctcaaacccactacaccttactaccagacaaccttagccaaaccatatacccaaataaagcataggcgatagaaacttga

SEQ ID NO: 667107 - DNA, 379 bp, Homo sapiens
gctcggaccttttgtgtctggcttattacactgaaaatatcttcatgaatttacatgttgtagcatgtatcagaatttcattttttaaggctgaataatattcctttgtatgtaatatctcattttgtttatccattcatcggttggtggatatctggattgtttccgccttcggctgttgcaaacaaggctgctgtgaacatgactgggcagatatctgcttgagtccctgctttcgattgttttgcgtataggatatatatccagaattgaaattgttagatcatgataattcatgataattcggtttttgagtaattgttacagttttccacagtaactgtatcatttacatttctgtccagcaatgcacaaaggt

SEQ ID NO: 667108 - DNA, 205 bp, Homo sapiens
  misc_feature (3)..(3): n is a, c, g, or t
  misc_feature (6)..(6): n is a, c, g, or t
  misc_feature (18)..(18): n is a, c, g, or t
aantcntaattacgcatncagtggtttgtaatagaaccacgaagttgtgcagctatgacccaataaccacagttgatttgaaaaatgtgccatcaccctagaaagaaaccctgtaccttttagcagtcacctgtcatccccccactgtctcctggcctgggcaccactaatctactttctgtctccgtattaggattcggaccga

SEQ ID NO: 667109 - DNA, 389 bp, Homo sapiens
ttgtggctggggatgggttttggttttggggtttttttttaaattgttttgacttcgtacagggtactttttcccaacctcatctgtcagaaatccatgtgggcttcctggaaagaaaaaaaaaaaaaaaggaaacctaggcttgaaatcagtttaacccctaaatcttaacccatgccctcattggcccaccctccccaacccaaaaacccccattccctttggaaaaccccctcaattccctggaaacgctcctcccaaatcgctctacataaatttcgggacacacacccacacgacagacaaaccattcgcctccactaaatctaccccagatttttacgggaccttctaaagctggggaaaaatgggagttttttaaaaaaaaa

SEQ ID NO: 667110 - DNA, 302 bp, Homo sapiens
tcgctcggccctcctcagcttccaaagtgttgagattataggcgtgagccacctggccagctctttttgaactttataatgactgacccaatgtatgcttttagcattaaggatcatttcttccgattattgaggcaatgccattctgagtgcattatctcctctattatggtgtctttcaactgtggctgatgagaataccaacaacccttaaacgctttgagaattgttttacctaatcctttcccgtgttggctcactctggctcggggtagtctaatcacatggcgtgcacctgtagt

SEQ ID NO: 667111 - DNA, 164 bp, Homo sapiens
  misc_feature (85)..(85): n is a, c, g, or t
  misc_feature (119)..(119): n is a, c, g, or t
gttccatttactaaatagtaatagaggccgggcgcagtggctcacacctgtaatcccagcactttgggagactgagtcgggtggntcacttggggtcaggagttcgagaccaacctggncaacgtggtgggactccgtctctactaaaagtgcagaagttggct

SEQ ID NO: 667112 - DNA, 887 bp, Homo sapiens
  misc_feature (8)..(8): n is a, c, g, or t
  misc_feature (190)..(190): n is a, c, g, or t
  misc_feature (214)..(214): n is a, c, g, or t
  misc_feature (272)..(272): n is a, c, g, or t
  misc_feature (289)..(289): n is a, c, g, or t
  misc_feature (322)..(322): n is a, c, g, or t
  misc_feature (376)..(376): n is a, c, g, or t
  misc_feature (379)..(379): n is a, c, g, or t
  misc_feature (385)..(385): n is a, c, g, or t
  misc_feature (399)..(399): n is a, c, g, or t
  misc_feature (417)..(417): n is a, c, g, or t
  misc_feature (426)..(426): n is a, c, g, or t
  misc_feature (435)..(435): n is a, c, g, or t
  misc_feature (468)..(468): n is a, c, g, or t
  misc_feature (470)..(470): n is a, c, g, or t
  misc_feature (472)..(472): n is a, c, g, or t
  misc_feature (479)..(479): n is a, c, g, or t
  misc_feature (484)..(485): n is a, c, g, or t
  misc_feature (492)..(492): n is a, c, g, or t
  misc_feature (503)..(503): n is a, c, g, or t
  misc_feature (511)..(511): n is a, c, g, or t
  misc_feature (521)..(521): n is a, c, g, or t
  misc_feature (525)..(525): n is a, c, g, or t
  misc_feature (568)..(568): n is a, c, g, or t
  misc_feature (602)..(602): n is a, c, g, or t
  misc_feature (618)..(618): n is a, c, g, or t
  misc_feature (714)..(714): n is a, c, g, or t
  misc_feature (718)..(718): n is a, c, g, or t
  misc_feature (734)..(734): n is a, c, g, or t
  misc_feature (796)..(796): n is a, c, g, or t
  misc_feature (814)..(814): n is a, c, g, or t
  misc_feature (816)..(816): n is a, c, g, or t
  misc_feature (885)..(885): n is a, c, g, or t
aattaacntaattttattcaaagtaagtctacattaaattacaatattaacaatctctagacacaacgaacttataagacaaaaaaatagaaatctgtttggtctttcttagaccacatatcatggaactcataaatgaaaattttcaaagatagaaatgacaattaaagagtgaggattttaatatggnaacccacaaggtgtcatatttcanacccgcatgtttcaaaaagagactcttaataatttagcacaaaatcaaattatataancttggtatattccaganaatattgctttaaacacttatgccatgatcaanattcctttggtagcttttaatcaaaatgaaacatgctattatgtaaaatataangtncttttnactgttatctcacncgtatctttgtcatagtnccccttctnacatccctnctgccctttcctttccctgttcaccctcatgtntntntccaccncccanngccgggnaccagcggggnccttttgntctttccgcnaganagcctctgcgtcgcagcatcaaggctttgggtctccataaacnttttacagtttacgagcagagaacaagggtcgtncctgcgcatgactgtnaaaaccaaaccaaactttattattgcaatcacacaaatactgcaattaaaaaaaatcaaagagcagttaccccaatgcaaaaaaacagggactgcnagantcaatcttagaatggnaacacaaacacactagccccaaaccctaaaacagagattcacaaggaactcagctgacgaanagacgcagcagggcgganancatggccttggcagctcagggagctcacttagaaacctgacttacgaaaaatcagccatcaaagtttanta

SEQ ID NO: 667113 - DNA, 132 bp, Homo sapiens
gtccgttggccgagtgagacttgtgttctcaaacccggtatggtggtcaccattgctccacgtgcaaccggtaacaacggaagtaaaatgtattttcgacatagcaccacatgaaagcttttgatgtgaaag

SEQ ID NO: 667114 - DNA, 385 bp, Homo sapiens
aaaaattagccggacatggtggcgggagcctgtagtcccagctactcgggaggctgaggcaggagaatggtgtgaacccgggaggtggagcttgcagatgagccgagattgtgcctctgcactccagcctgggtgacagagcgagactccatctcaaaaaaacaaacaaaaaaactacattttaaaattatgtaagtaaatgcaggggcgcattggttcgtgtctgtaatcccatcactttggggaagctgaggcttgagggggaagaggattgcttgagcccaggagtttgagaccagcctgggcaacatagcgagaccccatctcttaaaaaaaattatgtgagtagtaagtgtctattgtataaaattaacaaagtgcagct

SEQ ID NO: 667115 - DNA, 929 bp, Homo sapiens
tggcaaacggcaaccaggggcggcggcgcgaaaaaacccaggggaggtttccgggtttcggaccccaggcggccggttggtgaaatcctccctagaggggttcctcaatagccattgtttcgccaaaaaaaaggaaggggataaacccagggacacacatccaccgcaagcccgcaaccaatggccggctccaaaagccctagcacagccggggaggaagacagaagagagatgtcccaggggtgctccctcccactgggtaggaagaaacccgggtccgggggcctcgaggaggagctacctagatgggcccatcaacaccacccgtgaagatccccaggggggacgaagggaatacgcacagaaggggatccacaaatcattccatggaataaacgttcatacatacactcccaagagaactgcgggcgtgaaatgtaaaccgagaaggaaacataaagcggttcaccaggaccaaagaacagaggtattctacaaggaaccgagacaccagaggactcacaagaacccccaaaacggcaatacaacgcgggcaaaccagctgccttgaagcgtggcggcacagcccctcttaaacgtagaaaactccccggggaggagagacacgccatgaacagacagggggaagcagaggcacagcatacgcaagacaccccgggaaattcggtcgaggagagacagcattgcagaagcacgacgaaatcgtcatcaaactggctcccaacagacaccgtaaggacagagagcccgctcttgcatcgaaccctacagattaggggcatgagaatggcgagacgggggactaccgtgtcccaagaagacccgacgatggcaaagggcaacgggtagaaaaactctcggacggagcgagcaatagcccacagagggaatgacccgcgcccctggac

SEQ ID NO: 667116 - DNA, 157 bp, Homo sapiens
aacgggcgatgcggatgcagcaagccgagaccacagcagtacaggccagcctgggctacagagggagacggaaggccgagggagagggagagggagaaaaaaataatgaaaaagctgtataagcctgctgaattctgtcaaaggcctgtgctaagtc

SEQ ID NO: 667117 - DNA, 1209 bp, Homo sapiens
  misc_feature (318)..(318): n is a, c, g, or t
  misc_feature (322)..(322): n is a, c, g, or t
  misc_feature (547)..(547): n is a, c, g, or t
  misc_feature (564)..(564): n is a, c, g, or t
  misc_feature (617)..(617): n is a, c, g, or t
  misc_feature (746)..(746): n is a, c, g, or t
  misc_feature (772)..(772): n is a, c, g, or t
  misc_feature (821)..(821): n is a, c, g, or t
  misc_feature (832)..(832): n is a, c, g, or t
  misc_feature (892)..(892): n is a, c, g, or t
  misc_feature (902)..(902): n is a, c, g, or t
  misc_feature (915)..(915): n is a, c, g, or t
  misc_feature (944)..(944): n is a, c, g, or t
  misc_feature (958)..(958): n is a, c, g, or t
  misc_feature (966)..(966): n is a, c, g, or t
  misc_feature (979)..(979): n is a, c, g, or t
  misc_feature (1015)..(1015): n is a, c, g, or t
  misc_feature (1112)..(1112): n is a, c, g, or t
agcggcgtaatcagcacctcgtttgtggtcgcctcggtcaccactagtggggggttataatattttgaggagagaagattatagaagaaagattttttggccccccccccgtggcgcgcaagaattatgaccgcgccacacacccctctctcttatgtcggtaagtcagcccttctctctcggcgatgaactctgtgggaggaattataacagcagctctttcttcgagaaaaaaaagaagaggagataattgttgtggtctccctctcggtaagagagccaggcttcgttcgttatgatgatttcttcgtgaggatngatnatcctcaccagccccaccaccttctggcgaggattggtttgtgaatagaaagacgacttctcgtggttgtgtttgtggcttccggagaattgttgttgttcggacgccccccctcctcgttgtatttatgtctaggagaacagttgtattaacaaccctcgtgttggtgctccccgccccctccctcgcgcgttgaatgtatattatgaccaccgacctggctgntgcacatcaggcggcgnggctgctgaggagatggtgttggtctctctgatggtggagattttatgttctnctctaattagaagaggaggcgctgcgtgctcacaacagagaaacccctcaccagctgtctggttgatgttagttggctggtcctctctgacggcgcggttgtccttccgtgcacaacggcgggcttgtngtgagataacagtttcgcccaccagncacggcttgatagggaagacgcgcaccagcctgtgttgccctcctgtgntctttgacagnacttcggagatgagtgttgctctggtcggacgcacaggagacaaccacactcgcctgcgngtggctccgntgttatacctctngcgctgtttggaagaggtgtcgggagaanagcccgggtgtgtngcaacatnttatacgccgccntccgtagaaaattgtgataggtctacattcttctanaaatttaatatgtgataaggtgttctttttgtgaaccgccacattttctgagatttttcttgagaagagagagatgaccacaccccaatgttgtggnttttttatactgttaatgtgagggacccttataggcccccagccacacccgtccattgtgtaagggaaaataaaagggctgccgttaaccccaaaaa

SEQ ID NO: 667118 - DNA, 318 bp, Homo sapiens
ccaaaaccctttttttttttgggcccaaaaaaaaaacaaggggtgaatttcccctccccaaaataaaaagtgggttttacagcaaaaagtccttttgtggatggctaaaaaacttcttttttttgaaaaaaaccacctttgggggaaatttgcaccatggttcccctttttttaaaatcctgctgtccaaaaaagttaaggtttccagggcaaatgaggcgtcacttttgggggctaaaattaacaagttttttttttttcccctcaatcgggaaaaaaatttttattgtttaaacaacccccccggtttgtttaaaa

SEQ ID NO: 667119 - DNA, 275 bp, Homo sapiens
gtcttactcttaccctgatgcccaggctggagtacagtggtgcaattatagctcattgcagccttgtactcctgggttcaagtgatcctcccacctcagcctcccaagtagctaggactacaagcacgcaccaccatgcccagctacatttgtttctttttttttgtagagataggggtcttgctatgttgcccagggtggtctcagactggcctaaagcagtccttcccacctagggccgcccaaagcactggcaattattagggcatgaggcc

SEQ ID NO: 667120 - DNA, 770 bp, Homo sapiens
  misc_feature (210)..(210): n is a, c, g, or t
tttgttacgggagtggttttcgccccgagctgggtgcggggtgtttcgccggatgagcatttgtgctccgccgcggtggtgttctggggcgcccacttttctctccctcgcgttggtgggtatccaagcggtcgtgtgtagtttctatctcacccgctgctgtccaagaggttcgtccttcctgggtgccgggagtgtgtctcgggtccncctcctcctggcagtgcagtttgctctcatcccagtcggcggcgtagtatgatgccgcggccttccctttcgtattacgatcggcagcgccacctgcgctcgcgcgagaagctccccgcgctctgtctcggcgcttcacccccgggtgcgcccgcggcataacacacacgcaccacggtcttctgtggtccacccaggggagtcactgcacatgctcccaccgctctctcgcgctggttgtctccactctcctagagatgagccgctgccctgtcctcatctcgtgcccccagcacacctccgctcgtgttggcacgcacgccgttctctcacttgtcactccgcgcgttctgatcttcggcgtgtgccgcactgcgcttctgcccctcacacgtggtcagactctgcctctcttgcctgggcgccgctatctctctccccacgcgagagaacaaaaccgccaaaacaaccgccggtggggccctctgagcgagaccttgcccgcccggagtccacaataaaccgctgttgccctctctgccacaacaactaaacaacaa

SEQ ID NO: 667121 - DNA, 124 bp, Homo sapiens
caaccctggcccctgcttctttggtacacagtctcaccatgttgctgaggctggcgtagaacccacaaccctcctgcctctacctcctcagtattgaggttggtgctatgccactgtgctctga

SEQ ID NO: 667122 - DNA, 462 bp, Homo sapiens
acatctatagtgccagctgagccccgatggatgacggctatgacagtagtgatggagccagtccgcctcgtccgatggagtgccttcttccgtgagggttagccaggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacag

SEQ ID NO: 667123 - DNA, 466 bp, Homo sapiens
accttcatcgttgccctgacgcattagtttacagtccctcagggtggaggtctttagtttcataagagcctcagacagattttcctaagacatgtgtaacacaccaacgtactgtgacctacgaaaggctgttaatgatgtctccaacaaaggatatggctttggcatggtcaagattgacctggatacagttaaagcatcacgcatgctagaaaccaaatataatgtctggaactatggacttaccttcacccacaaatggaccacagactgtactttagggactgaaacttcttgctagaataagatgcctgacaggttgaaacctgctcccggtcccatatttgtgccgagcacaggacagaagagtgggaaacagtaggcctattatcaacggaattgatttagcgttgtcagcactgaagagatataatgtcctgcaccaaccaattcatgggtggggtgg

SEQ ID NO: 667124 - DNA, 835 bp, Homo sapiens
ttctccttttttgtgtgctccattcttgctgttcgtttgcttaattgtcactccatccaccgtggtgggtgtccctacctcattgataacttttggtaactctctccttctttcttcgtcgtgttgtggggcgggcttcttcactgctactgcgttgtctgtatctgttacgtactgtccctttgtggtccatcccttattctgtgtttacttcttctcacatcgccccctctgcttccctccttgttctcttgatttttacagcccgtgggatactagtgcgcttcatcttctcgttccaattaattatgtccccccgtccttacgttgcgtcccttggtatgttgtgtatgctcctcgctctcgggcgacgtgtatttggagaagtattggtctaccctctgtgcctccatattgtgggtacctatgttggggtcgtgatctagcgggttgtcgtagtctgtctctttctttctccccttgttgctcgcccatatgccgccactccctctagctcttccacttttcatgtcacattggcatcccttatcctcatacctgtgccaatgctgattatatgtgatgctgcttatttagagagcaagtctccgggtgtctattttaaaaatgtacgagtacaatggtgacagtgttaacggaaataatatatatagaataccagaaatgccgtttacccggagaattttctttctccccatttgttgttgtttttactcaattacaccatttttagttgtatttcctgatagcaaaaggaaaaagaaacactcatccctcaacaaaggccaagtcccattacccgtggtcgtagttg

SEQ ID NO: 667125 - DNA, 434 bp, Homo sapiens
tgtgtaagatgatggtggagtgtgatatgcagcccagttgtccatcattcagagcacaggctccctccataactgagtggacgagggattcgcactatggaatccccagctcgtttccaggaagagaggaggggaggctctgaggggtctgcagccccccttgcttgggcatcccctgcagagtcaggactgctcccgtgtgtgccaagtgctgcccgtgggagccccccctgaacccatgtgcatggtgggctctcatggccctgtgccgtgcctcatgtgtctttcgttgcttgcaggctgctccagcccaagccccgaacctcagtgggcagactggccccttccttggctttctcgctatatgggcacctcccttgtccccaagcccccccaggaatatggtgctctccttgacccttgcctctggccct

SEQ ID NO: 667126 - DNA, 382 bp, Homo sapiens
gccctcagctgtggggcacgcctggggctcagctctggtcctctacctccccctgcctgcctctgctaccacccagctggcccttgatgccggagctcctgtaggctcagcccacccagggtagaggaccgggccagagcctcatagtcttagctgtgtcctctttgacaagtcactcaacctctttgagcttcagtgttctccgttacaaaactcagaagatgacagtatctgcttcatgaggctgctgtggttatcaaaggcattaacgcacacagagagcttagcacacgataaaggcttaagaagcgccagctgccactggcactcctggaattatggtcggggtcctcaagaacagcagcagggaggcctggaggac

SEQ ID NO: 667127 - DNA, 894 bp, Homo sapiens
gaggaatcagctgggctggccagcaagttcagctccggctagtcatttagattcacccggtgatgaaatgggggtcaagcagctctgtgggctttccacgctgtcacaggaccccacctcgtaaggctgtggggatgtgatggagggtcagaatctccagggcgagcttctttcgactcttctcactgcctgttctaatagaggcaggatgcaggaggcatgggaggccaggccctgtgtgggattcctccggcgtgatggagatagctgcagtggaactggacggagctaacctggcgaagtgttgagatgaagtcgctgtcggtgggcttgcatgttcaacgctggacgcgtgggatcttgtcgtactgcctgttgagactgggaatggcccctttaagacaaaggactcctggcataccccttgatcatcgttctcccagtggaccataggagtccgttcgaggacgttcgtaagttcatgccttctgcatggacgctggcctcacgtggctcttgtgggttgctgtagccacgagtcacagggcatgctggtcagcaggcaaccagcctatttcgtgcaagcaggacccaggaagagaaccagccaccaattgaatcgcgtgcagggaggcaatggcatccctgttccgtcagagttggagcgaaagggggaggacagcgagatttcaatgtggcagggacatcctccatggtggcatcagcggggtcaacgtcgtagtggtttaaccggcgttgttgattgcatcgcttgagatcagggtccaaatgccttgggggcacgagtgggtctccaggtgtggccttggttgatgtcggatctgatcgactttgaaaggggccacttcgactgaacgggcgggagtgaggggc

SEQ ID NO: 667128 - DNA, 223 bp, Homo sapiens
agctcggcccgcaccaggcgcacttctggctaggatgggaagtgaacagaatctcatctactgctgttgggaatgtaaaatggtataagcatttcggaaaacagtttagcagtttctttttcttttctttttttttttttggagacgaagtctcgctctggtccggcaggtgggagtgcaagggcatgatctcggctcacggcaacctcgtgctacctgggtg

SEQ ID NO: 667129 - DNA, 885 bp, Homo sapiens
gataacaggccgttcctgaaggtactccctgtttgctggcagaatgtcagatattttcggatggttcgcagtaacgatgtcgcgtatgttggccgcacagttaagtctcaaacttgttgtgctgcctgttttggtggactggccggctctgtacaaactctgtccaaaaagtgcatggaatataacttgtaaagcttcccacaattgacaatatatatgcatggtgtttaaaccaaatccagaaagcttaaacaatagagctgcataatagtatttattaaagaatcacaactgtaaacatgagaataacttaaggattctagtttagtttttggtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggattggttaatgacttatgagcaaggtggttcggcagacagtataaccaaacttttatatcatataccgaaggtatcacacttggtgaaatctcctggctaatctggaattggattcccacggggggtaccatgggctatgtgctgcgattaaaagagtaagtggcccccgtgtgcaaatacaaaaaaacagaaatgacaaaagacaagtgtgggagggcgtcgagcacccaaaaaactctagcacacactcagtggggaccggcgacaagagtagaacgagcagtatgttcacgaagacgacgcgagaaatcgcggattccacaaaaacgcggggcacggaccgacaccacaacggaggacagatacagc

SEQ ID NO: 667130 - DNA, 122 bp, Homo sapiens
ggtgctggaatacggctatcgaaggtctgtaggaggctgaaggccggatagaggggccccagtgtaggagcctcaggaagaaccagcaaaagacagtccaacgagactaaccgagatgctag

SEQ ID NO: 667131 - DNA, 847 bp, Homo sapiens
agcggaacgccacgatctctccagtaaacctgaggccttccccatgactgtcccgtgcccgctcctcatccgccggtatatatctataaacctaccttgtactctaccttacccgatcgtccctacccgtctgcacttccgtttcgtttttgccccagtgctaagaggatcactcagcctaaacatatcttaagtacggatgcattagcaccggcctatgaataggctagtacaatttaaccgctgattgttgcagcgcgtagcgcccttcgtgctgtgcgggactcgtggtgctagttcagcatacatctgatcttcggggctcatcaaagcatgtaagtcttctcatgaattgtctcctcatgattggtacagagagtctgcctcgacctccagtgcctattatgtccacacgacctagagcaggcctgagaggatagtaatggtccctgcgtactctcaggaacctctcatatgtagtgactacataaacatgatggtttctggtgggacggaagtgacgatcggcgcaaagcatgctggtctcaggcggtctccgctcaacgatccgttcctcaaagcatggttgcgtgagtacccagagtgcgaaggagttaataagcgtgatttagccaggtggccaatcatgagtgaatggatgaggaaaaggcccttagaatggcaagattacgtttttaccaccgaagggtccgaagtgacggacagtgagaagaatgacgtattacccggatggggtttaactaacagacccaagtcttctgcaaaggttctactgtcacccaggtggaatgcagtggggcagatctcgggtctttgtaacctccac

SEQ ID NO: 667132 - DNA, 690 bp, Homo sapiens
  misc_feature (146)..(146): n is a, c, g, or t
agatactctaaaatacagagaatgtgcccacgttccccccatgccccaaattgtcgcaggggctccccgctgcaaaagacgattaagattcctccaacctcttccacacctgcaaaagaagaatcggtgtgaagttccggtgtatnttgtgtgtattctactacaagagttcggatagtaaagcagtagctttcatacaatcagaagagtttgtccccggcacacacgaaaagcagtcctcctttcagcaaatatgtgatataattctcaacagctttgctaagactgggttggcgaaaagaattagagcattggctactcgggcccaggacaggcagggtcagagaacccgctgtgggcatacccaggcccaggatgacctctaggggacgacagagaaaccaacacgcggagaggggtgtggactgctaagtataggcgctcgtcgacttagccgcaatcaatgtccacaaagtaaccatgaagttttattcatttttaaattaacaatgtccagataagttatgagaattcaaaagaattgaactaggttcctggaatcaaaatacacagatcacctgaattctatgtacaagtcaaacttttttttaaaataagaaatttaaaatgccatgtaaaacatcagccaataataacaatgaagtgcaagaatgcatctccagaaagatg

SEQ ID NO: 667133 - DNA, 592 bp, Homo sapiens
  misc_feature (210)..(210): n is a, c, g, or t
gcccctcaagccccagagatgttgatgcctaagaagaacccggattgcccatttatgaactcccttttaaagagggaatcatggtggcccagaaggatgtcccacaagcctaagccacccggagctggccagaccagaatgtgccccaccttcatagtccatgaaggcccatagccagtctctcaagtcccgaggctacgtgaaggacanagtttgcctggagaacatttctactggtacccttacccaatgagggttatcccagtatctccgtgattaccttcatctgccccccgagattgtgcctgcccaccctacgccgttaacccgtcccagagactggccaggcctcggcctaaaagtctggagggtgagcgacctgcgagactccaccagaggggaagactgaccagagataacctaccagacggagtgctgtgccccctggtgccgaccagaaaaccgaggctggggctgggtcagccacccgaattcccagtttagaggcggatttggtcgtggacgtggtcagccccccccagtaaaattggagaggattctttttgccattgaataaaccttaccagcccca

SEQ ID NO: 667134 - DNA, 276 bp, Homo sapiens
  misc_feature (82)..(82): n is a, c, g, or t
gcactttgggaagccggggtaggaggatcccccagaagccagcaggtccacaaccaagctgggcaacacaagcaagacaccngcattacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacatat

SEQ ID NO: 667135 - DNA, 414 bp, Homo sapiens
  misc_feature (267)..(267): n is a, c, g, or t
  misc_feature (272)..(272): n is a, c, g, or t
cagcacccgtcgagaatcgggtcaacactgaagcattcacaccttcaggatatgaagcagagcttcctgtcacatctgcagatgttgtgctgttggtcaagagccagtgtgcagtgatctctccacctctcatgggagcgactgacctagacacagtctcagtctgagacatgggacttccattttgcacctcagagctgctggcaaggctgatgttctccaaaggttggggaatcattttgccaacgcaaagacgtaagtccaaantcatnttctgtggatggttcaatgaattcctcatcccctggattcccagttactctactgtttcttctcgattccactgcagagggtgaaagaaggactgaggatgaagtcgtggcaattctggagtctttgggtgtagccctctgt

SEQ ID NO: 667136 - DNA, 115 bp, Homo sapiens
gatccaggtgctctctctgttggtgatcacaccaattcttcctatgttatgactccagtcaccatacacaggttacaatgtcgaacatgatgaaatcagtaatcttgccaggctc

SEQ ID NO: 667137 - DNA, 1267 bp, Homo sapiens
tgggagcctgtagcctttattcatgcccccctgaccaaatgcagggaaaaacaaggccctgtgtccgaaaacaattccaggggcctgtggacttctgtgggttccccttacgtgcaaacactttctcctgtgtgtaagccaaaagtgtgtattaaaggtgcgtgggtggtgtgtgaccatcctttgtggggaaggtcaaagggggcaaaatcccccgaggggcccgtggaggaaagggcaagggcaattaggcggtggcctcccaagaagcggcgtgggaagggaagggcccggtgccaaccaacctctcgggggcttagaaaaacaaaaagtgcagcccgtgtggccaaggaaggggcacctgtgtatacatatgggaagccctcttcaaagcctgtgtgaaagcccccttagaggagaagggcgtggggagtatgtgtataagaggggggcactcacattctcgtgttaccccctgtttttacacaggcgaaggtgcggtcatgtgttacggaacacaggggccctttgcggcaaacttcttccagacagaaaaagtgcgggcaagagtccccctttctcggaagcgccctgtggatcccctgtggcggggaaccccgtggtaaggcgtcccacagccccccctgaggttgtggtccgcaaaatcctttcaaaaagacagcctcttcccgcggaatagtctcccctctcccttgttggccacaatgtgagagtgttgtaagaacactctcaacgaggggcatcagccccaaaaaggggcgacctgtggtaatcgcaggggatctgtgcccaaatatgtattcccccggggcgccctttcacccttcaaaaaaccgcgaaaccggggagcacccccgtggcgctcatcaacatccttgtgcggccaaaagactctcttcatcacatggaggttgattaccgtcccacactatggcgccacacagagggatccccttatcataaaatttccccacaaacccaaggtgacgattgaattggcggccaacggtctatagggcagcccaaccaaacggtcgattaaccacccctcagtggaagatcccagactctcccacgagcaaacggcgtgtccccaaagggctggggcaaggcggcgtggccagcgttggcacaaaagcgcccctatgacggactacaaacaacgagaggcgtccagggagaatgagcataaaggccgccgcgacctcgcaccgaaagagccctcccgcagcaccacgaaatacgg

SEQ ID NO: 667138 - DNA, 618 bp, Homo sapiens
cgaacatggtgaaacccagtgtctactaaaaatacaaaaattagccaggcgttgtaatctgagctactcaggaggctgaggcaggacaattgcttgaaccccggaagcggaggttgcagtgagccgagatcttgccactgcactccagcctgggcgacagagtgagactctgtctaaaaaacaaacaaacccgttttgtctgttggagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtctttaactcctggactcaagtgatctgcccacctcggtcccctaaagtgctgagattacaggcctgagctgcgtaatttcatgccgcgtgacacagtccagttaaaaggaacaaacccccgggggtcagcgtctactcacacaggtggactgatggctgatatccagcacgagccagagcagtcacagtacccatctactcacacaggtggactgatggttgattccagcaggg

SEQ ID NO: 667139 - DNA, 436 bp, Homo sapiens
  misc_feature (39)..(39): n is a, c, g, or t
  misc_feature (54)..(54): n is a, c, g, or t
  misc_feature (58)..(58): n is a, c, g, or t
  misc_feature (90)..(90): n is a, c, g, or t
ggataaagctggaaactatcattctcagcaaacttttcncaaggccagaaaccnaacnccacatgttctcactcatcagtgggaattgancagtgagaacacatggacacagggaggggaacatcacacaccagggcctgtcagggaatgggagactaggggagggatagcattaggagaaatacccaatgtagatgacaggtcgatgggtgcagcaaacaaccttagcacatgtatacctatgtaacctgcacgttctgcacatgtattccagaacttaaattataataataataataataatagactgaaactggccaggtggggtggcttatgcttgtaattccagcattttgggaggctgaggcaggagaattgcttgaagccaggagttggagaccagtctgggaagtatagtgagaccttgtccctattt

SEQ ID NO: 667140 - DNA, 200 bp, Homo sapiens
agtatgtccagtgcacgataaagctcttacctagcggttggtttgcttgagcatacatcttgctgtatgatcaggattatcagcacacagtagagtcagagagtatcgcattgtttggttacatctggtaccgtgtcacattaaagataagcattcgattgtcggcaccatacaccatatgacatgaggtatgtctcacg

SEQ ID NO: 667141 - DNA, 857 bp, Homo sapiens
tggggacggagtcttacggtgtcacccaggctggagtgcaggggcacagtctcggctcacgtgcaaccttcagcctctcccgggtttcaagcaattcttccgtggtctcagttcttcccgagcagcgtgggattacagggtgcccgccacaagtgcccagcataatttcgtgtattttaagtgtgaaacgagggttttccacccaggttgtggccgaggctgtggttcttgtgaaactctcctgtggacctctcgagggtgcactctgtggtccccacacttctgtgcctctgtgctatttctataagttcaatggctctttcttcaaccgaaagaggtgctctgtgctcatttctccgtggtgtgtttccaccgtgtgtggcaacataagtgccttctgtgaatatgtgttccaggggtgtggggggcctcgtgtgttcacccggattgtgctttctccaggctgtggtgctcgtgggttctcccaatttcatgtgcgggccccctcacagagcacagcggaataaaggttaaaacgcgggcaaggacacccccacttaaattcgagagtgcgcaacatggtccccgggggggaacaaacaagagggtcaaaaagggaaacacacgggagggaggagggacgccaggaggtcccaaagcggcccgacaaagtgggtgatccaggcgaaaaccagtgctccattccagagcaatacggccggccccaccaaaagtgtttccgtgcagccataacaaagtgggaccccctcagactctggcggggaacccaggaaagcagggctcacagcctcaagaaagcggccccacaatggtggccaacccacaagaacagcgtg

SEQ ID NO: 667142 - DNA, 261 bp, Homo sapiens
  misc_feature (139)..(139): n is a, c, g, or t
  misc_feature (185)..(185): n is a, c, g, or t
  misc_feature (218)..(218): n is a, c, g, or t
tgggaaaaaaaacattccccagggcctaaggctaacaaacgtgggcgctgaactgtgtttggtctgctgagtgtattttccccaaagcaatcctcattttctcagggggtggggatttggacaaaactcttcctgaacncccagcgtggtggggaagggtggccatggaggttttttgttccttntgttgtccctggtgaaaaacgacttggggcccnatttttaataaacccaatgctattagggtccccccaaaaaaaa

SEQ ID NO: 667143 - DNA, 171 bp, Homo sapiens
cggacagacgaaagcgcgaagagagaagaggtatagctgcaggaactttgatacacgtcatgacccagcgttcaataagggtttccagactgagagaaggtctgcgctggctccataggaaaaagacgaggcgcaagccagacctttcgctacgctaatagccgccgattt

SEQ ID NO: 667144 - DNA, 977 bp, Homo sapiens
tgcggagcgagatagtctcgactccgtggggctgtgactctgtggctgctgcgctactctctctggctggcatggtggatactcgagcgcttgtctagagatccaggttaagtcaacgatacgagtctcgagcatgagggaattgggagacccgtccgaagtctgtcctggaagttggctgatgttggtccggggttgtccagtccactcacgaacgaattgcacagttttgacatatactgagaggaataggagacgagacgttgaaacatatggagcagtgcaggaacttggtctaggcagacaagggagtggctctcgtctatctcttgtagctacagtggaatatcatcccgcactgaatgaagtagtgacgatatggcctggcggtgttggaaccattgtgcagttcgtcaacagtccactaggatagatgcagatggggatcgagacatgtaagcgagtgattaatgggagggtttgaaggagtgccgggatttggagttggatgaaattccagatgtttgtgcttgatatgctttctaaaatattggtgatgattatacgatgttacaggtatatgtcacaaaatgaagggaagaaaaatagggtggaaacgatggagcaataatttattttcatagaatctactttgtagtgtgatctgcatgtttggatgtaatatgaggaagtgtgtacacaggtgagctcttaggagggtggaaatctaaagttgggcgacgcggataggtctcttgtgaacaacagatttggtcaggattcgaactcttcaagcttggcaccaagctgtaagaacagtgacgtggttaagttaattcattctacctgcttagaatggggggaaataaaatttgtgggcgggctctgaaatggttaagtgaaggtgggcaaaaataagtaaaggagaggagggggaggggtttcaagagagggaacaaaagatggtcaaagaaagg

SEQ ID NO: 667145 - DNA, 244 bp, Homo sapiens
ctgactccagctgggagacaatgagcaaaactacatctcaagaaaaaaaaaatgcaaaggggtatggatagtagaaaaatggttatcaaagctaagtgggacatggacatccaacgttggacctgggtaggaaagtgaccggaatgggtggacaggagagaaacataggttggaatttggctagaacacattcatctcatatgatgaaatcaggaaatctaaattaataatttggaagcctgag

SEQ ID NO: 667146 - DNA, 179 bp, Homo sapiens
caggacaacagctagtctacctctagagagctatagacctggaagttagcattacccaagacgccgagaagttgagcacggaggaaccgactctccccggggagcaccctgacctgaggtcaagactgcggagggtccaacgaagacggacaaaagagaaagcagcgtaatttattgca

SEQ ID NO: 667147 - DNA, 881 bp, Homo sapiens
  misc_feature (3)..(3): n is a, c, g, or t
  misc_feature (103)..(103): n is a, c, g, or t
  misc_feature (113)..(113): n is a, c, g, or t
  misc_feature (120)..(120): n is a, c, g, or t
  misc_feature (187)..(187): n is a, c, g, or t
  misc_feature (189)..(189): n is a, c, g, or t
  misc_feature (191)..(191): n is a, c, g, or t
  misc_feature (208)..(208): n is a, c, g, or t
  misc_feature (214)..(214): n is a, c, g, or t
  misc_feature (218)..(218): n is a, c, g, or t
  misc_feature (227)..(227): n is a, c, g, or t
  misc_feature (232)..(232): n is a, c, g, or t
  misc_feature (244)..(244): n is a, c, g, or t
  misc_feature (246)..(246): n is a, c, g, or t
  misc_feature (275)..(275): n is a, c, g, or t
  misc_feature (295)..(295): n is a, c, g, or t
  misc_feature (303)..(303): n is a, c, g, or t
  misc_feature (307)..(307): n is a, c, g, or t
  misc_feature (312)..(312): n is a, c, g, or t
  misc_feature (315)..(315): n is a, c, g, or t
  misc_feature (317)..(317): n is a, c, g, or t
  misc_feature (356)..(356): n is a, c, g, or t
  misc_feature (365)..(367): n is a, c, g, or t
  misc_feature (373)..(373): n is a, c, g, or t
  misc_feature (375)..(375): n is a, c, g, or t
  misc_feature (378)..(381): n is a, c, g, or t
  misc_feature (392)..(392): n is a, c, g, or t
  misc_feature (394)..(394): n is a, c, g, or t
  misc_feature (414)..(415): n is a, c, g, or t
  misc_feature (423)..(423): n is a, c, g, or t
  misc_feature (459)..(459): n is a, c, g, or t
  misc_feature (462)..(462): n is a, c, g, or t
  misc_feature (498)..(498): n is a, c, g, or t
  misc_feature (527)..(528): n is a, c, g, or t
  misc_feature (543)..(543): n is a, c, g, or t
  misc_feature (812)..(812): n is a, c, g, or t
  misc_feature (876)..(876): n is a, c, g, or t
tangtggtagacaagaccccagatatatataaatatacatataggtcccagcaccatcagcaccagaacgttccccagccaggtccctgccagaaggaccaanagtcaggcangattgangacatagaaaggagagggccccagtctttgccaggtatcagtgatcacctgttatggtccccatgtnanangaagaaactaccctttnccttgnattnttgacactntggtncatgaggacggntngaccctctggaggcgccccctttcctgtntccagcctgtgccctcaatnccaaggcnacanaagcnaantnccagcaggagcagcttggggaatgtgagacactgcaggnccctccatnnncatccngntgnnnngcatggatttngngtcctatgccatggtgtgcnnatcacacnggagtctcccccattttgcgtggtggcacttgtgantcncttattctcccggatgtttcggttgcggtcgctgangctgctgatctcttccacatatgcctggnncacccaccccttctnaccatctgccaggcggaccccttccagccagccgtcactggtccaggtcctcactgacaggatgtcagtcttctccaaggtcagctcatctgggtgcagtgccttgtatgtcctaacacactgaacctgggggcaatcttccccctcactgatgacctccttgtcctcctgggggctggaggggcacaaggctgagatccatcgctgcttctcactttccgtccgggcccgcagcaggaactggtgcttcatgtgctgcccgtggaggngctggaggaggaacacgtggccggggatgccctgcagcttcaggctcaggtcccgcacctgcanctcag

SEQ ID NO: 667148 - DNA, 243 bp, Homo sapiens
atcgccatcatgaacgacaccgtaaactatccgcactagaaagttcatgaccaaccgactacttcagaggaaacaaataggtcatgatgtccttcacccgggaaggcgacagtgctcaagacagaattcgggaaaatagccaaatgtacaagacacaccggtgtcatctttgtatttggttcagactcatttggtggtgcagacactggcttggcatgattatgattcctggatatgcaagaa

SEQ ID NO: 667149 - DNA, 154 bp, Homo sapiens
gttatttagggggatgatggtcgctttggtatactaagcgatggtattgaggagtatctgaggcatgggggtcagggttgattcgggaggatcctattggtgcggggctttgtatgattatgggcgttgattagtagtagttactggctcaaaa

SEQ ID NO: 667150 - DNA, 626 bp, Homo sapiens
gcgcagatatgctgtctggacacacgcattatgcacagtgtatgctgtgtcgtgaggcacagcacgcatgcagtatatgctgcctggagacacacacatgatatgctggctcatcactcactacgacgtgatagtatagttgcctggtacgagccactactatgtgtcgacagtactatgtctgtctggtacgagtgcacacacgtgcatatatgctgtccggcatacacacgcacgcactgcatgcatgatatgctgcctgggcgacacaccttccggacagcacatgcatcacacaggtgcatatatgctgcctggatcgcacgcagactgacgtgcttttgggagggtgtgcgcgtgaatgcctgcagtactgtgctgtccctgtgagggctcatacgttagatgaagggacgtaatcgcctgcctccatccgatcagctccccccctaagtcatggcccgggcctcgtgtacagcacgcgctgcaagtaacacgagactacaatagcagcgacgtcatagtaccgcactggggcatatgaacaggctaatgcaaaagacagacctagcaatatgcgagtagacaagagaagttaaccacaactgacttgattagaaagaagt

SEQ ID NO: 667151 - DNA, 140 bp, Homo sapiens
tgctgctgtggacggtcaagacttctatataagagggggtccagaccgcatttgtcacatgtcttaaataggtgcttattaaatcttatgtacaacaagaatcactttgatagcatggttgaggacacaggacgggtgca

SEQ ID NO: 667152 - DNA, 145 bp, Homo sapiens
  misc_feature (19)..(19): n is a, c, g, or t
  misc_feature (105)..(105): n is a, c, g, or t
  misc_feature (113)..(113): n is a, c, g, or t
  misc_feature (139)..(139): n is a, c, g, or t
gaagagtcactacaagatngaggatggataatcgatgtttatattctgaccaaagtgtcagatattttacactcaattattcagtagctacaaagcaaaggtgcntaccatgntccataaatccttctgtcccggcggnccctat

SEQ ID NO: 667153 - DNA, 163 bp, Homo sapiens
  misc_feature (52)..(53): n is a, c, g, or t
  misc_feature (56)..(56): n is a, c, g, or t
tcgcgtgatctcagcacgtgggttcaatttacaatcttttcaaaacatattnnttncaaatttacagaatgttgttaatggaacaagacaaaacatatccactttagtttatcaaaaataaaagaagatttaaaaagaagcacatttctcacaaatagtattt

SEQ ID NO: 667154 - DNA, 418 bp, Homo sapiens
  misc_feature (5)..(5): n is a, c, g, or t
  misc_feature (35)..(35): n is a, c, g, or t
  misc_feature (209)..(209): n is a, c, g, or t
  misc_feature (254)..(254): n is a, c, g, or t
ccctnttaaaaaacccatcacccacaacagacaanggacatatccatccataccccaaaagtttccctcatgtagccccctcccctccccagtcttcccttaccctctcccaccccacccggcaaccccctgatatgcctttatgtaactatacattaatttgtatttccctagaattttatataattggaatcacacattgtatattnctgttttatctggcttctttcactcagcaaaattattacgagttntcactgacgttgtagcatgtatcattagttcattccttttattactgagtagtattcaactgtagggatacaccagtgattttacccattcccttattgatgaacattttggttgtttctagattttggctattgcaaataaagctgctatgaacattcatgta

SEQ ID NO: 667155 - DNA, 541 bp, Homo sapiens
tgactattcgggccgtaaaatggttaccatggagattttttttttttgagacagggtcacactctgtcacccaggctagagtgtagtggcatgatctcggctcacttcaacctctgcctctgggtttaagtgattctcccacctcagcctcttgaattagctgggactataggtgtgtgctaccacgcctgctaacttatgtatttttagtagagacagggtttcaccatgttggccaagctggtctggaactctcagcctcccaaagtgctgtgattataggcgtgagccactgcacccggcccaaaatgtggtatttattaaaggcagaagtaacgataaaaagcggaagtatggtatatcggaaataaggcatctgtaataaaatatatagcaataagagcctttctcaagagatatgaagacagtggagactaggtgatgggaagttttattcgagcacgggcagtttcctcctcacctcatttatggagctcctctggagtccatgcatagacttacatctaagtgtctaattgga

SEQ ID NO: 667156 - DNA, 787 bp, Homo sapiens
cattccggatttgtgccccgtcccgacgcgtggctcctgctttaagttatactgcagtttccataccttattaccccgcatatcctagatgtactaccaacttggaatttgagtctttggagcactctagcccccagccatgaagcctcgtgtccgaggaaccttaaggagggacaccaactggaaaccgggaaggagaaaggccacctgaggtgccccgcgtgccccactgccctgttggccagaggcctgtgtctgtgccacacctgccccggtggcagggggggtacccggggcagcatcgtggctcctgaaccccagaccccatgcttagcccaacgaagtggctccccattgtggccagcacccttctcagtttcgccgtggcttggctcgggatccttggccagttccccccagcccccccctgtctgctccttccccgttccttcccgggccccacacgctgctccagctgcccactttgctgcagagccactgccgcccttgagcctctcaccctgagtgagcccccagctctccacgttcccctcatagcagtgtcactccccacccccccctggccccgggacccgtggaccggttggggatggggtgtgtgccccctgtgctcatcacaggagcctcagttgagaatgacgcgggtaccgataaggcagtgcttcccccactggacctctttcctggttttcttttgccatacattaacagacccctttatccacataaaccatagtaactgagctattaaaggccacctctctga

SEQ ID NO: 667157 - DNA, 364 bp, Homo sapiens
  misc_feature (14)..(14): n is a, c, g, or t
tgttcatcagctgntgaatggatgagcaaaatgtggtccatccatcccacgccccagtggaatattactcagccttaaaaaggaaggagggctgggtgtgatggctcatgcctgtggtcccaacactttgggaggctgaggcaggtgaatcacaaggtcaggagatcgagacccgcctggccaacatggtgaaacccatttctactaaaaattagttgggtgtggtggcatgcacccgtggtcccagctactcgggaggctgaggcagaaagaattgattgaaccagggaggtggaggttgcagtgaactgggattcgcgccattgcactgtaagcctgggggacagagtgagacttcatctcg

SEQ ID NO: 667158 - DNA, 164 bp, Homo sapiens
gtttcaggaaggtagagttctgtgctgctaccttctagggaggggcgaatagactattctgtaccctggtgatgggagcctggggtctgctccagcgaacaacaattgaggtgtcatcaacgttggtccaacagtcgggtcaggatggggcatcagagcgctgt

SEQ ID NO: 667159 - DNA, 236 bp, Homo sapiens
tagagatgaagaatgatagtcagaagaggagcagagcagcagctccgtgagagaagatgagactaatgtgaagatggagtctgaggggggtgcagatactctgctgaggagggggacctactggatgatgatgatactgaagatcggggggatgaccagctggagttgatcaaggatgatgaaaaagaggctgaggagggagaggatgacagagacagcgcccatggggaggatga

SEQ ID NO: 667160 - DNA, 241 bp, Homo sapiens
aaattgtattatacgtacgagacagggaagtgtggaccaaacctgctattccagttcctgtgcgcattcgagtaactcctatgtccttataagtcagggtattatcttgcacagccctatgctgatagacttgagtctctgacagggactgataaggtttggtttccaggtgccatgtccatttcggggctcaggaagattagggtactcgttgcttatccagtacgggatatggcggaga

SEQ ID NO: 667161 - DNA, 1393 bp, Homo sapiens
  misc_feature (1393)..(1393): n is a, c, g, or t
ctatagctaaggaccgccccgaagatcgagacgatgctacctaagagcagcgtaaaagagcacacccgtctatgtagctaaatagtgggatgatttatagcgtagaggctgataatacctagcgcgagcctggtgataagctgggtgtagtaccagagatagactcgtatgagattcgaaacttgtaagattctgcccactagtaagccatctaaatccccgttggtagacattgtaaactgttcagtccaaatgaggaacagctctgtaaggagcatcgtacggacaaacacgccgttggtatgcacgagagtaaaagatctttgtggcagaccatagtaggtcctaaaacagtggacactcaattacagaaacgcgtacacagctgcaaagaccccatctaagcgtaatgattagttctcgataccattataaaactgagaatctcccttctaaaagcgcaaatgtgtgatgcggcaatctgaatttaatccctaattaggaaaagagacttagagtgtgtcaggtactaagagtcaatcctggaattaccttgtcttgccttccgggacttaagcgctgggcggtccgccatttacgtgacggactcgaatttggaacggactgaacccaggccccaattgtgcttaccctcttctacccaaaccaaagtcctttgtttaacccttaactgggctaaccccaactgcaagggccttgcgtccctaaaggcgacgggtcaaccaaatagccgtaccagagggagaacctccgccaacaaatctctaacccccgggctgtgtcaccgcatatatgtcacctcttagcattggccccagcacatggagcgggaaccggtctgtcccatgtgacacccttgttttacagggcccggggtaaccttaagcgggcacaggtgtgcgacaatacgctgtagcccctaaggaagggagccctgtgttgaccacggtgcccccacggtgggcacagcgcacgcaccaagcccgaagcccgacgagtgagacacgcgcctaaaaacagcgcggctatacccggaagacgcaaaccccatgagacggatcaccaatgcagacagcgcccgcacgaccaaaacaccagggcgcccccaccacgaccgccggacacaccacgcgggcaccaccacagaacaacccccggcagacaagatatcccccgccgcgaaactcctcctcccaatctagaggggcgccgaccacgaccactttatcacacgcagcgcagcagctggcccccgtatagcacgcgccaccacacgtcgaacagtacccagatcatttagaacgccgacgatgagacgtgcaccatccccgagaccgccgacaccccaacacgccgacccgccaccccgcgn

SEQ ID NO: 667162 - DNA, 668 bp, Homo sapiens
aggcagttgtccagcctctttcacttccagttgataccagagctgtcagtggggcctgaggctccttagggttgtctctctatttccccgcttgcttcctcattccctcgtctttcccataggcgatcacgagtcagtcgcctttcagcaatggcagactaggtggttcatcgccctggcaggcaggggccctgggctctcatgctgcccctgcctagcgggtcaggttgacaggaggttggagggaaaagccttaaactgcaggcattctcgaccacgctgtgtccggacccagttcttggggtgtgacctcaatttcaattcccgtcatgtacttgaacattatgaagatgggggcctctttcagagaatttgtgaaactagctagaattgaccgacacgctttccagtacccatggggctaggtccttaaggccacatccacagtctcccccacccttgttccggagctgttggttactacctcctctcctgacaatactgtgtgtcgtcagagctccccccaggtctatccctcccggcctggtctgtctggggggcttgtcgatagccagtgggattgccggtcttgaacgccgtcacgtgagctggagatctttggtcacgccaggggctacggcagttccctgtctgtgatgctgtatgcc

SEQ ID NO: 667163 - DNA, 371 bp, Homo sapiens
tgtgctcgcgggcccttctgtgcttgttagttgctcatgacatggctctgagtctgcatttgtgtgtgcctcggagatgtcactgcgtgttgcgcaggagggtacagagactggcggaggctcttctactggctcctgctgatgctcacactcactcgcttctcctcctccattctcctcaccggactcgcgctcggagctttgcactatagtttatatgcctgggaggactccggccatcttgggtttccgcgacattgtcatggtcttggatcttctcttgcagtgtgggtctgtgctctggctgtggctctggccagcgctagggctgcggttgagactctagtcctatgctgtagggggccggcgcg

SEQ ID NO: 667164 - DNA, 424 bp, Homo sapiens
tcaacagacattcgatactagagtaacttctatttacttgttttttttttttggaaagggagttcattctggttggcccaggtgggagtgcaagggcaggatttgggctcagggcaacctcggcctccggggtccaagtgattctctggcctcagcctcccgagtagcgggaataacgggcacccaccaccaccccgggctcattttttttggcattttaagaaaagatgggggttcaccatgtgttgggccaggagtgtctggatctcgggaccttcgtatccacccactggggcctcggaaagtgctgggattacgggggtgagccacgggggccaattaatccagttttaaaaggctaattaatgcttggaaaaatttgggcctttttctcggaaaggcctggctaggtgcggaatccttt

SEQ ID NO: 667165 - DNA, 155 bp, Homo sapiens
  misc_feature (84)..(84): n is a, c, g, or t
agataccctgtcatcccccttcgtagtggagggaatggcatgtgcaaagtccttaaggtgagagagtgcccatcaccttggagnagctaaactgtcagccagatcctctagtgcgagggggtggagtgttgagcagtaaaggaagagaggggtag

SEQ ID NO: 667166 - DNA, 696 bp, Homo sapiens
actacaggtgccctccaccacgcccggctaatttttttttgtatttttagtagagacggggtttcaccatgttagccaggatggtctagatctcctgacctggtgatccacctgcctcggcctcccaaagtgctgggattacaggcgtgagccactgcgcccggcctatcttaactcttaatcaaaaaattttttactttctttttttgagatggaatctcacatgtttcccaggctgaaatgcagtggtgacgatcttggctcactgcaacctcctcctcccgagttcaatgccattctcctgctctcagatgctcgggtggcggaggaggagagtcgcttgaggctggcgaggcggaggttgcagtgagccgagactgtgccacttgcactccagcctggctggcaagacgtgagactgtttacaacaacactacgtaataacttcctactttctcacgctgtgatacactcgaccccacgcttatctgcttcctgcgcactgccaatcggtggcgcaccacggctgacagaaacccttttcccccatgccccccaaccagcctacactcggtcagcgcgagaatccagcgggatcctcaccggctctgctcctgtcagttccttgacggaccacctttccaattacagtctcttgacactcgccaaactcagtctcttgtgcgctctgcatac

SEQ ID NO: 667167 - DNA, 920 bp, Homo sapiens
catgcgcaaccggttctccgaaacatggagtctgtaggcaaggtcttacctgaatcaggatgagggaatggtgggtccaggtggggctgctggccgtgcccctgcttgctgctacctgcacatcccaccccctcagctctcccctgcccttcactcatggaagtcttcaggcacagttttcacttacaagggactgcgtatcttctaccaagactctgtgcgcgtgtggttggaactccagagatagtatgtgcttttacacggttttccaacatccagctacgactggtacacagatttgggaaggtctgaccttgaggtttcatcgggtgatgcccttgactccttaccgctacgccttcagtgacaaaccgagaccacatcactattccatattagagcagcgccagcactcgtgataagccgcttctcggcggcatctggggctcccagaaaccgtcaggacacaaccttcttatctcatgactatggagaaattgtcgctcaggagcctactctacaggtacaagccagacatcgatcctggtcggcttaccataaagagctctctgtctgtcaaatggaggtatctttcctgagactcaccgtccactcctttctcccaagagcttacttcaagcatggccggtgtgctagtctcccagtcctcacacgactgttcacctccctttggcattcctctcggaggtctcacccccagtcctttgggcccgtatacctctggcctcctgagcagttggcctgttgggccctgtatgcagacaggatccgcaccactctgcgaccttctgctttgacgctcttacgtccccccccgagccccctccaacgcctcgtgtagcttcccctgcacttcccacgtcatccctggcccggctcgacccctacccattcgccgc

SEQ ID NO: 667168 - DNA, 305 bp, Homo sapiens
gcctcccgagtagctggggctacaggcgtgtgctaccatgcctggctaattttttgtatttaagtagagacgggataaaagataaatttttaaccttttaggaatcctgcactggaccattggctccaggaggaggggctgtgctttatctccctaacgtagggttgccaaagaaatacaggaccccagctaaatttgacctgcgatgggcatacttatacacatatactagaagtattcatgggtatttcaatcaaatgtactagggtccatagtgtatttctgagctgcaccttcctgattag

SEQ ID NO: 667169 - DNA, 221 bp, Homo sapiens
ccacctcagcctccccagtagctgggactaattttttttttggtagtgatggggtctcactatttttggcccagcctggtctcgaacttctgagctaaagtcatcctcctgccttggcctcccaaactgctgggattacaggtatgagcagcctcgcccggcctcaattactttttatattgacaaagagaagatgttgcagttgttgcagtgtgcttccg

SEQ ID NO: 667170 - DNA, 1062 bp, Homo sapiens
ccaggggggggggaaccccattaacaaaaaatgtggggggggagcgcagccaccacaccccggcggcgtccgtcctgctgtgagagggaagcacactctcactccaccggggaacacacccagccgagagcggggggggatcactattgtgtgtcggcgtcgcccaccaactctcacaagagggggcgcgctctctcttgtgtagagacccgaggcccctggggtctccacagaacagagacgcaaccacactcgcgcgtcgccgtataaagtgggtgtgtctgcaacccacaccacacacacagacggagtaaccacagaggcggggttgtcttctcgcaggagagcgacggagcaacccactgtggggtggtgaagagacaaacttctttctctggtcggggcgcccccacacaagagagcattcactgtctattctcctcacactcttctctctgtgtgaccacgcccagaggggtctggtgggaacgaataaaaagagaggagggggtggagcacacacgcgcgcgccgcactcctctttctggctctgtgtgggaccccaccagggcacgacgagatattctattagaagaggtgggggagcctcacactcctcatgggcggacagcggccccctttatgtacccacctcgctgggggggtctcatgaaaaacacagggggaaactggggttttttttccctcctatcttcgggggggggaaatttttttgggggtggtgggcggagcaacaacagcacctcctcgttctgggggtggcaacagcagcacaccgaagctcaggttgaagcacccccctactggcgggagcagcaacttgttgcgctcccctgcggtgtcttcacacacaacacggcccccacaattgtcgttcctccgcccgcggcggggaggctacagcacacatcgatatggggggcgcaccccgattcttgcggttcccccgcccccccccccccttttttttctgagccccctctgggggcccggggcccccccctggctggttctttaaaaaaaaatggccctttttgttga

SEQ ID NO: 667171 - DNA, 817 bp, Homo sapiens
tgtggtggctcacacgtgtaatcccagcgccctgggaggttgcttgagcctaggagtttgagaccaggccgggcaacaatagcaagacccgtcccaaaaaaaaaaaaaaaaaaaaaaaaaaaaaattgtgtgtggggcgcccgggcccccggaaaaagttttataaaaccatcggttggggcgcggggccccagagggataggaaaaaggggccaaggggtgtccccaagagaaactcggggccagaaacaaggggcggtgggattcccccccattataaaaaaccgcgcggggcgggacaacgcagcgcgtggttatgcgaacaaatcccaaagaggagagtccgaggagggccaaaaacgggggagcccacaccacaaagggagggccacagagcgagcgcgcgcaatcccaaattaacgcccccggacgggggggcacaagagcagaatagacactagacaagcagcagcaacagcaacagcaacgaaggaagtaacacaaaataaaaaacacacaacaaaggaagaaacacacatcaaaacacaacaaacaacaaagaaggagccaaatggatcagcagaaaacaacatgaaacgagagaagagaagagaaagaagcaaaacacaagcaagaagaagacaaaaaaaaaaaaaaaagaaaaacaaaaacaagaaaaagagcaaaagaaacaaaagacaaagacaagatcaaggaaaaaagataaaagagagagagcaaaaaacaaaagacagaacacagaaacaagagaaaaaaagaaaaaaaagaaagatgaagaaagacgaaagaaaaagag

SEQ ID NO: 667172 - DNA, 265 bp, Homo sapiens
tggaaaatcaggtcactcccacctgtcaaggggctaaaaatggcacacaggagattatatcctgcacctggctcggagggtcctacacccatggagtcttgctgattgctggcacagcagtctgagatcaaactgcaaggtggcagagacgctgggggaggggcgtgtgcacattgcccatggcttgcttacggtaaacaaacgcagtacaggaacctctgaacttgagctggagcccaaccacatgctcaacggacggtgtgcc

SEQ ID NO: 667173 - DNA, 598 bp, Homo sapiens
ctaatccaatccaggttcccaaatcgcccgcacatccacacactaaaaggctctaacctcactacgctcgtaacttctcctgacggaacgatagttattcccaaaggcaagaacaaaagtatagccgcccgcaactaatgtaactaaatagggggaagactaagaggagtgcctaatttccgatatttaactgggggcgtacccagcccggttgcgacgcagagagacgtctaactacccttcgtaagagcgagactacgctatagtagaggagctgtcgtcgttaaccgcgattctaaaaccgtcacaaccgtagaatgtacgagggcgcgtcagatgtgtactgttatgttgatatctacatgcgcgtcgagcttaaaaagtaggggtagacatacggataagtgcttcgcccacccctaacgataaagaggagtcggaaccggctacccttgcgttatacgatttaactctgctagcagcccattccttccctaaggaaggcggcggaggataaccagtgaattaagggccgggttacgcgggttcgctagctataaccgctttcgaggcgcgagatttcgtaggctagttgcta

SEQ ID NO: 667174 - DNA, 137 bp, Homo sapiens
  misc_feature (54)..(54): n is a, c, g, or t
  misc_feature (133)..(133): n is a, c, g, or t
tggctccctgtgggcgcggcatggggcgggttggggcgggggctctcggacccnccggtgccgctgacgtgattgaacttctcgatgcactcgtcgatcaggtgttgcggagccttcttgtgcgccaaccgtncacg

SEQ ID NO: 667175 - DNA, 416 bp, Homo sapiens
gagtgggaacacgctgagaattgtatagagacagatagggcttctagtgtataggatcatgtcatctgcaatcaaagatagtagacttcctttcttcctagttgaatacgctttatttctttctcttgcctgattgtcctggccagaacttccaatactatgttgaataggactggtaagaggacaattgtgtcttgtgttagttttcagggggaatgcttccagattttgcccatgcagtatgatattggttgtgggtttatcataaatggctcttaatattttgaggtatgttccttcaatacctagtttattgagagtttttaacatgaagggatgttgaattttaccaaggcctttactttgttcattgagataatcatgtggtttttgtctttagttttttatgtgatgaa

SEQ ID NO: 667176 - DNA, 726 bp, Homo sapiens
tgttatattaagagcgtgtcttattactgacatttgtaatcaagaaaagtgatatagaaaatatgtaggagacctgttaaaatggggtgattatggtaatatgggtcatgtgaatcaattttgtgatttataaagtactcacacaagtgtgtttcaaacgatgataattctctgtgaaacagagaggccatgggaagatttggaacaattatttaaacagaaaaaatttcctacaagatttttccaaatggcagaaggaacccattaagtcaaaaagtaaacatttcttttagtacgtaatgtttccaattaccattcattttaaactttttttttcaaaggtttaattctctgggaaaggaaagggaacaagggtcccctttaaaatttaattttaactaagggtttcctaaaaaaacaaaaatttttaattaaggaatttaacatggtgtcgtggacagcgtaccatttaaattacaggaagctgggaaaattaattctttcccaacaacttctgtctggacttaacacaaattttaagcgcaccaaaaggggtggcgcctgggggttgactctaaacacacattttccggaacacactttactgtcgggttttaaaaacccctttccaagggtctgggttgggaattcccttaaattgggttaattgggttcacacacggtgtgggcacaactctctcaacacatttaagggaatttaatagc

SEQ ID NO: 667177 - DNA, 421 bp, Homo sapiens
taaggtttacctcgggggccaaaaaacatccttaggaaatgcttttggtgtccccatttggatggcaaccaacccctgtgtgtgaagacattggtcgcagtctcctgacttatggccgccggcatccctctggctgagtgggagagccggatttcaggaggtggatgcccagatgctgcgtgacatttgctccaagtacttttatgaccaatgtccagcagtggctggctatggccccatcgagcagctcccagactacaaccggatccgcagtggcatgttcctgctgcgcttctaggcaggaagtctgcacaggcaggcaggagggcggggccgggcacccggggtccctgccacagacataccactcctgctgctcagctgtgtgcagccagttacccccaataaagccctattgaga

SEQ ID NO: 667178 - DNA, 347 bp, Homo sapiens
cactcataaaccacagtgaccccacagaaccagaaagatccctactattgaagtgataaacactagtagcaactcatagcttgctaatggctgtaacaagtatgtgccttacgttatagatagtcatgcataggtcttcctctttaagtgaacacattgttacacgagggaagagctgtgtaagattcatctttatgcttcccatagagtcttgcccatgagaagcactcaaaatacgtgtggactaaagaagcacgtaaagagaagaaatactttgtctagaattgcctatttctttctggtgtggtctgcatgtgtacccccaagttcatatgttacaacttact

SEQ ID NO: 667179 - DNA, 291 bp, Homo sapiens
attgtattcgtctgtagcaagatgctggctccactatggtcagtcatacactcatggttttcaccttgtacactgtgagaaccaaatatctaaaactatgtttttcttaacaaatcgtggttgtaacatatacaccataacctaatcagggtgttcactatgcttccacattagccagtcttctcacacttcttctggtttcaagtcctccaggcctgacagcccgcagggctaggattattctcattctttacaatacagtcttccgccccttgagagctttcttcatgt

SEQ ID NO: 667180 - DNA, 730 bp, Homo sapiens
ttaaaatattatatacctaaaaaagcgggaaatgggcaaaggaaaaaaaaaaagaaaaacaaaaaaaaaaaaaaaaaaaaaaaaaaaaaagaaaaaagaattttaaaaaaaaaaaaaaaaaaaaaaaaaaaaaaagacacaaagacaaaaagaaaaaaaaaacaaaaaaaaaaaacaaagaaaaaaaaagagaaacaaaagaaacaaaaaacacaaaaaaaaaaaaaaaaaaaaaaaaaaaacaaaaaacaaaaaaaagcaacaaaaacaaaaacaaacaacaaaagaaaaaaaaaaaaaaaaaaccacaaaaacacgaagaaaaaaaagaaaaaaaaaagaaagaaaaaaaacagagaaaagaaaacagaagaagacagagaaaaacaagaagagagaaaaaaagagagaaaaggacagaaggaaacagcaacaaaaacaaaaccagagaaaaagaaaacaaaaaaagaaaagaagcaaacaacagaaaaagagaaaaaaaaaagaaaagaaacaaaaaagaagaagaaagaaacaagaagagagaacaaaaaaaaaacagaacaagaacaaacagaagaaaacagaaaaggagcaaaaaagacaagagagaaaaagaaaaagagaaaacagaaaagagaaaaaaaaaaaaaagaaacaaaagagaaaaaaaaaaaaacaagagaaagaaagacaagagagaaaagaagaaaaagaaagaaacgaaaga

SEQ ID NO: 667181 - DNA, 1065 bp, Homo sapiens
  misc_feature (1)..(1): n is a, c, g, or t
  misc_feature (296)..(296): n is a, c, g, or t
nacaactcgtctctcttcgtttctctgtcttcttcgtttgctcttgtgtcctgtcctgttgtctccagctcccacgcatacgcttcgcctctgcagtcgacgtagcgggcgacgcggcgaagcgagcgcgtgcggcgggggcgggagggcggggtgtgtttggtcttgggatgcatggccttttattgatgacccgcgcttgaacacgcctgttggtgttggtgtcctcgctgtgggcgtctcggttgggctcttctttggttgccggcatctgacagcgacaattaggactgtanttaagaagggttctcgttgggcgaccggatgattatagggtgtccatcccacctgccggcgggtgaaataagcctcctctcccgggggatagaccttgtcttcaggccgacttgtggtgacaaggtcttctcggccccccgctgggtactcccctaaggggggcatcccccttcgggtgtaatataaggggcgacctactccgtcctctaaactgtggttcagaaggatgttctggtgtctaaaagaaaatttttgtagcgcggggcttctttcataaaaggcgatgttaatcccccgggcgtcgggttgtacaggtcctcgtcaaatcctctcccccgcgtggcgagaatgtgtggtgtccctttgaaggcccttcgattacgcccacttctcttccattgcccagtcacgcaacactgggggaacaagttcctgcgggcatgggtaggtggtggcaccctcttgcgaggaaaataattcaagagttatcagtgtagcataatcttcgggagtcacccgcagttcccggcggacggccgaatgcaaaatagcattaaagcagcagatgataggagcgaaattatagagaagagagagtacaccacgtaccttttttgcagaaatctaaacagaaagagatttaaaccctagtaagtctggggacgcgccaagcgtccaaactgcccccttcagggctagcaccacaacttgtcagagggccacaaagtcaaccacacactcaaacgaaaaatcaatagacagaaaaga

SEQ ID NO: 667182 - DNA, 152 bp, Homo sapiens
taggttggagggggaatgctggaaatggtaaggggtatggaaacttatcatataagtaatgctagggttggggggaaatttttggtatgatgtctgtgtggaaagcggctgtgcaacatttcaactgggttattatttatgtcctacaaggc

SEQ ID NO: 667183 - DNA, 900 bp, Homo sapiens
tataccttatatgaaaaaatacaaaattcaaaaggataagccagagacatgggaaaaccacatggaacgtgtgtcaaagttcttctctttaatcacttctgtatccagctgttcattggatgtgtggaacctattatttgacagagtatttcaatattgcttatgagtagggaaagaatgccaagatggtatttgacttaggagaagatgcattatgggttgtgcagtcattgaagatacattggaacatatatatctgcatagactcttacaacacaaaagaatatacaagtatatacataaagttcatcatgagtttcaggctccattaggcaatggaagctgaaatatgaacatccttgtggaagacttctaattcttggaactggattagtcatggaatcgtgcattgtgtgatcatgtattcttctttgggcatgggttgacatgcgtattattagaaactattgatgtccatagaggttatgaatattccgtctcaacctttacatctgatgcctttctatgcgggttctcgacatcatgaattcaccacctgaagttcatggaaactatgcttcaaaaattaacatggtgcgatcgacatgtggaaaccgactcacgctaataaggccctctacgcaaggaggaggacgtgtgaggaaacgcgaagacgtaggctaagtaaacctctcgagagaggttgccggatcgaaagtagagcaacatgactagggccacgaatagacattccggcaacaggaaaaccatgcaacaacaacgtctatggcaaacacatcacagaggtattgtgaaacactagcgaacggagggaaagaccacacagcagcgcgagacaagaggaacagaacgcgacggcagagaacgacaacgggggaa

SEQ ID NO: 667184 - DNA, 325 bp, Homo sapiens
tagcaggatgccttataaatgcttcggatgcggaaactgctttagatggttagtggcagagaatgggtaaggttgatagtgtggtggagatagctggggagaggtagagggtggcataagaatgggaatgagaataagagtgagtataaaagtaaagaatagaacttcatcagggtggaagtattggagggtgccttgccagtcaaagatcatctacccactctaagagggagttaagagtggcagtttggggatagcaccaagagatatcagctgtgatggcttgaagaaacagtgtaaaccggcggtgtaaacaggagtaggg

SEQ ID NO: 667185 - DNA, 164 bp, Homo sapiens
tgctgcggtgactctaccggatccttaacggtctttaccatatgcgacggcatgctgcgtcttacacaccacgttctgcgtggaaagcggccctgtgcagcgagctcgacggatttgtttgtagcagaggtagagcatttttcaccgaggcgttgtttgtggtg

SEQ ID NO: 667186 - DNA, 190 bp, Homo sapiens
ctatcagcatccccctttttgcggttatactgttctgcggccagccacccacgaccctactactagctgcgcacctgagccaatctacacattactaacaccactatcaattctataccacccatcctcctaccctaagagaggccctgaccccacgcgtaacgcggctgtttttgccctaaatgcggtc

SEQ ID NO: 667187 - DNA, 129 bp, Homo sapiens
accgctatgtgtaccagctgctcgggagtctgaagtgggaggatcacgtgagcctgggagactaaggctgtgtaatttgtgattgttccactgcattccagcctgggcaacagagccagaccctgtctc

SEQ ID NO: 667188 - DNA, 610 bp, Homo sapiens
gcccgtgagacaaccacactgtctgttcccgaaccatttgatcagcatatccactgctacagaagctacctgcccctgagccagccacactgtctgttcctgacatccaaccatcaacaccttatggcttgatgatccagatcacccaaaacagatactcctgctgttgacatatcctctgaaggtcagtaataacctaacgctacatcacaatgcctatgtcattcccctcacttcatctcatcacacaggccttatattattgcacatcttctcaagaaaaaggatgagtggctgggcgcagtggctcacgcctgtcatcccaacactttggcaggctgaggccagcagataacctgaggtcaggagtttgagaccagcctgggcaacgtggtgaaaccccgtctctactaaaaatacaaaaattagctgggtatggtgccaggtgcctgtaatcctagctactaggtaggctgaagcagaagaattgcttgaacccaggaggcagaggttgcagggaactgagatagtgtactggtctccaggcgggataacacgttcgcgagggggaacgaggcccaaatcggacacacgggcatagctagaaccg

SEQ ID NO: 667189 - DNA, 436 bp, Homo sapiens
gctgaggtgactctaaggatcccatgccagtaacctcccaccgacttcgcgaagccctgcgcctgaacaacgccgtgccacaaggcttgtcatcctgcatcttcaccactgacgtgcgtgaagccgagcagttcatgtcggcggtgggcagcgactgtggcattgccaacgtcaacatcggcccgagcggcgcagagatcggtggcgcgttcgggggtgaaaaagaaaccggcggcgggcgtgaatcgggctcggatgcgtggcgcgggtatatgcgcaggcagaccaataacgtgaactactcgctggagctgcctctggcacaaggcatcacgttcgactgagcctcaggtcggagtgagatcaatgtgggagcaggcaagccagcccccacaggtgataactgatcgttcccacgctctgcgtgggaacgcat

SEQ ID NO: 667190 - DNA, 518 bp, Homo sapiens
  misc_feature (498)..(498): n is a, c, g, or t
gtgggtccctgccctgcgcagcgagatcctgagcctgcccaaacgcaaaggcggcatcctgtgctggacgaaacacaagacacggagctgtggcaacgctggaaagtgctcactgcgcagcagcctgtgggacgcaccgatgaggcatcgctcctggccgccgccatggatctcgccgaaggcatggccttgcccctgtcggtggtctgggccgccatcaagttctgggtcgaccagggactggtctaggtcatggcggtggatgatgagatccaacgccgaggccccatggcgctatcagacctgttcgacggcgccttgaagacccttgcggcccaacaacaggccgcgcccgcccccgtcgccacggatgggttcctctacagcggcaaccgtcacgagagcgtgccccgcgcactgtttctggatcgacggctcacaccactggagcgcaacgcctggcaggtgtttcgcttgctgctcaacgacgatgcaggnacccactcggggtaccgagc

SEQ ID NO: 667191 - DNA, 132 bp, Homo sapiens
tcatgtggacgagaactagtatattcaatgcatccctctgatccagaatgtcaccgcgagacgcaggatctacaccttacacatcgtaaaagcgagtgatgggactagaggagaaactggacatttcacctt

SEQ ID NO: 667192 - DNA, 548 bp, Homo sapiens
gtctgtcagggatgtttgcgtggcaccgtgctggtgacagcaaaattgacccccaaatggaagcagctggcttcactgctcaggtgattatcctgaaccatccaggccaaataggcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgggtgttgagagcttctcagactatccccctttgggtcgctttgctgttcgtgatatgagccagacagttgcggggggggtcttccaaaccggtggacaaaaaggctgctggagctggcaaggtccccaagtctgcccagaaagctcagagggctaaatgaatattatccctaatacctggctcctccccctcccaatcagggcaagccaacgccccttatccagtgaacccctatcccgaaaaaacctctccctctttttccta

SEQ ID NO: 667193 - DNA, 442 bp, Homo sapiens
gagaacccagcggagatgtgcataagtgtcagatccacaccatatcaaagagacggtacaatatctcactagtatatgacaacatgcaaagaatgccatatccgtaatataccgtgattgaatatatcatatatatcatttaatatataaataaaatatatcatattaatatatattttatatatttatatatattaatgtatcaaggtataatatattacctactattacatattctgcagatatataaaacatataacatatattctcatatattatccattactatactataacatatattaataatctatgtaatatatcaatatataatttaatacatgatatatattatttactatatattttaatatataacttaatatacttaatatagtataaatatatactgtatacttaatatacagtgggtagtcacaga

SEQ ID NO: 667194 - DNA, 425 bp, Homo sapiens
tagttgtatttgtagtttcttttcttttggggaacctccatactgttctccatagtggttgtactggtttacattcccaccaacagtgtttaagagttctcttttctccacatcctcatcagcatttgttattttttgtctttttgataatagctatcatcctaactggggtgagatgattacctcattgtggttttgatttgtatctccctgatgattaatgatgttgagcatgtttccatatatttgtatgacttttggtcatttgtatgtcttttgagaaatgcctgttcagattatttgcccattttttcagattgttgttgttgttggtgctgttgagatatttgagttccttgtatattctggatttaatctcctgtcagaagattggtttttgtttttcagccttacattcctcggat

SEQ ID NO: 667195 - DNA, 104 bp, Homo sapiens
aagacggttaccgcgtgctggtggtagcgacccgcaatattcctaaagcgctggaacgccagacagtacactaccagcgacgaacgcaacatctgaggtatcaa

SEQ ID NO: 667196 - DNA, 591 bp, Homo sapiens
tttttggtgtcattcaaagatgtgggacggaagcctcctacttttggagatgcatcagtcattgcccttgagttgttaaattctggatatgaatttgatgaaggctctatcatttttaatcagttcaagtctgttatctcctacaagacagaagagaagcccatcttctctctgaataccattgcgactgctgagaccatgagcatctatgatgacattgatgctgatgtgctgcagaattaccaggagtacaatctggccaacctcatctactactccctgaaggagtccaccaccagtgagcagagtgccaggatgaccgccatggacaacgccagcaagaacgcttctgatatgattgacaaattgaccttgactttcaaccgcacccgccaggctgtcatcacaaaggagttgattgaaatcatctctggggctgctgctctggattaatgaaaatcaagttgcatcctcagacaagaggtaaagaagaagaatgcgcaggctgattttaactgattgctgtctttgtcagaagaaacttggtccactgagttacaaagacagcaggatgtttgtaaattatcttac

SEQ ID NO: 667197 - DNA, 288 bp, Homo sapiens
aggctaggtctggtccgtactttctatagctctagtagatacacatgcaagctcccgttccagtgagtcaccctctaaatcacacgatccaaagggacagcattcagcacgcaggaatgcagctcaaaacgcttagcctagccacaccccacgggaaacagcagtgattagcctttaggcaataaacgaaagtttaactaagctatactaacccccagggttggtcaatttcgtgcccagcaccgcggtcacacgattaaccccagtcagtagaagcctgcgtaaaag

SEQ ID NO: 667198 - DNA, 136 bp, Homo sapiens
ggtctcgaacttctgacctcaagcgatccaccagcctcagtttcccaaatgctgggattacaggcgtgagctacgtgcctggccagaatctattatttattgagagcttcctcttaatattgtctgatcagctaaa

SEQ ID NO: 667199 - DNA, 903 bp, Homo sapiens
ttaactgtctagtttgatagaatataccaggtctggctgcatgaagatgtggcacgtgtcattttagtggtttcaatcctcttatttatggttctaactctaagaaaatttaaaaggaagagatgtttggatgacaaacacatgccttattgcaaaactaaagcaacttctattataggaagaaactatgggaattgatacacatagatgatgatagtttatttaaaacaaaaacaacagcaacaaaaaatcctagcctccagttgccttttcctttcttagctcctgtattggtgaattactacaactgattgactttacagcctttttggctagatcctgagaggctatttttcttacgaatataccaacatcctgacaagttaaagaaaaaaatctaatgtatgaatgtgactcaccaatttttatcacctaattccttttttttattaaaggcatgcagggataacaggacttctgttacaatggccactctgacatggtcagacacatcttaaccttgtgtgtctggatctcctctgtcttaatccacgctcaggctaactctggggatactgtggccactggcagttgtccgaggtcttgacggctgacgagtgctcttgtgccccaacgagtccccgggggcaaacaggtcccctagggctaccaccaggtgtggggagagctaaggacaccaagcctgcgcacgaatcaacaaactaggtaaacccagaatatcatttcaacagtaggagaactcacactcaatccctgactgggaagagacaaaaagtcatccctaacgagtaagaagatgcgcaatgtactccctcaactaaggcactacaacgacaaataaagaaaaacaaaatgatcagaggactccacagagaccaacaa

SEQ ID NO: 667200 - DNA, 105 bp, Homo sapiens
taagaataataatacctttctcaaatcaactgaagggagagaaaacactgccaacgtcttagaatatgtacactcagctagagcagtgaacaatcatggactttg

SEQ ID NO: 667201 - DNA, 109 bp, Homo sapiens
  misc_feature (63)..(63): n is a, c, g, or t
ttcaaaaacttgaaaagcaggacgccattaagtgtctggtaataattttggaatatttgtatnacctacaattaattaataaaagtgggtttaaaaaacctttccagga

SEQ ID NO: 667202 - DNA, 362 bp, Homo sapiens
  misc_feature (3)..(3): n is a, c, g, or t
  misc_feature (22)..(22): n is a, c, g, or t
gcngccatctgcagggcagaangaagagagccctcaccaggaactgaataagtcagtcagtctgggacttccagcctctagaactgtgaaacaatgaatttctgtggtgtaagcaactcaatctatagtagtttgttactattttgttatagcaaccaaagatgactaggccagacaggttatgtcactcgccaagtgtcttggtctgtttgtgctgctataacgaaataccttagactgggtaatttacaaacaacagagatgtatccagagatccacagttctggaggctgagaagtctaaaatcaaggcaccagcagattccacatctcgtgagggctcactctctgcttcacagatgg

SEQ ID NO: 667203 - DNA, 431 bp, Homo sapiens
gagatgccaaggacaacgtatggagggagtggagcaaagagcttctgtgccctatcctggagtgtcaccctcccagcactttgatgtgttctccaacctggaagtgctctaaatctcattgttcaataatttttatagagctcaatttccagcccccacaaccctacttcttagagttcagtgagtggggctgaaagttccaccctgtagtccctggtcattctagggacggggtctttctaggtctttccagtcccatcctggggctatctaggggccccaacctaagtttattagcataaactctggtgtgatcaaaaagggctgattataaataacaaaagacactcccatcacgtaggaaattcccaggattttaggagttctgtgctgggaacctgggacagagaacaaatatattttgtcttata

SEQ ID NO: 667204 - DNA, 145 bp, Homo sapiens
agtgtgcatctagaagaacctccccgtggaaaataattaaattatgttaaattggcactcggctgggaaggtggatcccacagcccctgtgcatgaagctcttgtcctgaaggttcttatcacgcggttctatagactactccca

SEQ ID NO: 667205 - DNA, 231 bp, Homo sapiens
ccttggtgaaaggaacgatctgtaggatggtgaagtacaggactctggtcgccaggggtcctcagcgtgcatggagacgactggatctcaggcccaccgaggattaatgcccacatcttatccctccactagtaccaaggcccacctgcatcgggagctggatgcctgcgtatacgcgggcagcgagtcttcgctactgccttctcgcgccgtcacgcctgactcagatca

SEQ ID NO: 667206 - DNA, 124 bp, Homo sapiens
ccgcgaccaagctgcgcatcacgcgcacactgccctcgcggcgcgagtatccgtcatttcagacatccacttgggatgccgtggcccatacccgcgcttgcccggacgttttacgttcaacctg

SEQ ID NO: 667207 - DNA, 378 bp, Homo sapiens
ctagagagagatgacagtatgaggaaatccaacaatacaaaaaatactacatctcgtcaggggtagatctctctatgccgggtaacatacattaagtggcactacttacacagtaactatagggtacctaacatgaaaccacagcactgtcactctgccacagctgcatgcaacttgggctttgctggttgagcccattttcaaacaaactgcccaccccagagctatgccaacaaaatctgttcacggcagtaaagccctgaagtggtgactcaccagagtcacttgcagctgacagataataggcaggccatgttagttatacaagtcgttacagcccacttcacaaaagttaccaactgtttctctttctagaac

SEQ ID NO: 667208 - DNA, 146 bp, Homo sapiens
  misc_feature (44)..(44): n is a, c, g, or t
  misc_feature (97)..(97): n is a, c, g, or t
  misc_feature (140)..(140): n is a, c, g, or t
cccatacagacattctcagatagcgctgcctggtgttaatggtnccaacttccagacagaaactaactgctcgtctctgatcctagaatccagcctnactgagattccgtgtcagtgctctcggaaaatcccactaaatnctaaag

SEQ ID NO: 667209 - DNA, 114 bp, Homo sapiens
ggggggataaggtttttttggccccccggtttttcccctggccagcccttgggtttccaaattttttaaggggcttttgttttgtaaaaaaaaccggggccctgtgtttcccca

SEQ ID NO: 667210 - DNA, 325 bp, Homo sapiens
gtcgacggaaaaagtacttcatttgtgtagttatataatcagtctatttaaacaggttttgtcagaattctttatgaagtgtactgtaacaccatactgcaaaaggctttaggctaacaaagacaggagtgttttagattcatcactctagtgcaggggttttcaaccaggggtccgtggcagttcaccattgactttttttatttttataaatatacctgggcccgtcgacatacttatgtctgaatagccaagtcgcattgcccaaaatactgatgtagacccatattcagcgaagaaattacactgacaagtattataggca

SEQ ID NO: 667211 - DNA, 122 bp, Homo sapiens
actgtcaggcggattgcaccatgagccaccatgctggctgggagtttattttgctgtgcaaaagttcttttgtttaattgaccattggtcatttttggttttgttgcaaccgcttgacagtg

SEQ ID NO: 667212 - DNA, 265 bp, Homo sapiens
aacttgagtatcccgaaaccctgataacgccaacatcgaaaaatctacatactgtatgattccaactatatacattctggaaaaggcaaaactatagccagcttaaaaatatcagggattgcagccataggaggaagaggacagacaaataagcagagcacagagaggattttaaggtcagtaaaaaaaaaaattctgtatgatcttgtaatgatggatatatgtcattatatatatatacctccaaaccccgtaattagggtta

SEQ ID NO: 667213 - DNA, 254 bp, Homo sapiens
  misc_feature (4)..(4): n is a, c, g, or t
  misc_feature (35)..(36): n is a, c, g, or t
  misc_feature (50)..(50): n is a, c, g, or t
  misc_feature (58)..(58): n is a, c, g, or t
  misc_feature (67)..(67): n is a, c, g, or t
  misc_feature (72)..(72): n is a, c, g, or t
  misc_feature (74)..(74): n is a, c, g, or t
  misc_feature (84)..(85): n is a, c, g, or t
  misc_feature (120)..(120): n is a, c, g, or t
  misc_feature (185)..(185): n is a, c, g, or t
  misc_feature (187)..(190): n is a, c, g, or t
  misc_feature (196)..(196): n is a, c, g, or t
  misc_feature (200)..(200): n is a, c, g, or t
  misc_feature (246)..(246): n is a, c, g, or t
cctnctgcatcataataaatatatctatatatatnnagcataagacgtgntatttttnatttctttntttananggttatattnntctcttagagttaaaattttctttatataatattngtcatatgtcatagttttaatacaattcacatgatttctatgtttcttaatgatattttccttgncnnnnattgancggnttggttaaaaaacaattctctggaatttgtgcgttcatgctttctnggtattct

SEQ ID NO: 667214 - DNA, 430 bp, Homo sapiens
  misc_feature (111)..(111): n is a, c, g, or t
ttttttgtagagacagggtttcaccatgttcgccgggctggtcttgaactcctggcctcaggtgatctgcccatcttggcttcccaaagcgctgcgacctacaggcgtgantaccaatacctgacccctactactaaggttaaaaggagaccaagcacagaggcttacgcctgtaagccagcactttgggaggctgaggcaggaagattggttgaggccagaagcttgagaccagcctgctgggcaacatggggagactctacctctgcaaaaaaattttgaaaattagccggaagtggtggcgcatgctggtagtcccagctattcaacaggctgagatgggaggattgtttgagcccagaagttccaggctgcagtgaagctatgactgtgctactgactcccagcttggggtgacagaagtgagacc

SEQ ID NO: 667215 - DNA, 1237 bp, Homo sapiens
agcgggaatgagtgatcgaaacgcatggtgtccgtggtgtcggcagctgacgtgacccggacgaggcgttgacatccttgcctaaggccccactcaggctacaagctcttggctgtcaggatacgccatgcccagaagatctgggctggtagactccaaaacacccttcgagtggatcagctcgtcagcgcatgtacgtccaaggtcatcaagaagatatggaatggtctcctactgcttccactggctgcgtggcaatcatcacttggctacatctacaggggcccacctgtcacggtcgttgagtcgatcctctatgggtaggcacccatttgcttgggtgattgctttggggcataagcagattacaagttgatccttgtgacttgcaccttggaaccataagtggcgagtatgtccttgcgtcacgtatagtgagagatcctatcggttggcctctaatcgcgcagcaattaccacaggagtgcatggttggaactcctagcatcggacacgaagggcttggcccagagggcgttggccgtcgatcgcgtccttcacgacagcgacatctattggctcggcaacgcttgtggcttccccttggccccgatgcactcgtaagggccattccctttcaaataggcatgggttgatgccttattcgcttctgcgcttgttctcttgggctgtgaaggaggacccactgcggagaacatgaacggactgtgcatgccgcgcagagaatgtaagcagaggaagcactgggactgcactatgccacggacaggctcctagggcttggagcgagttgagtcgcaacgggcgcgaagcttcgcgcgaaagcgaaaaggagagatcctggcttggattgggaggaacttcctggtcaagcgtgagcaatcttcttgcacgaggttgaaccttgcctggaggggaaaaacccctttttggggggaagaatccctgtgagtcctgggggagcctcctggacaatgttaaacattggctggaagtggcctatgcggggttcgatttggaaaaaccggccattgcctataattgttaggcggtaaccaacgaccaaaaaaagatttcataggaagaaagaccccttcccccccagtaccccccatgggaatacacacggcaccaaatacaggagagcctctaagaacacgccatcggaagggaagggcggcgccccggtttacacccaaacctttcttggtaacga

SEQ ID NO: 667216 - DNA, 609 bp, Homo sapiens
  misc_feature (300)..(300): n is a, c, g, or t
cgtgtctagaggatcccgcactggtcctgtcggtttgctatgttacactgatgctatggaaaaaatatactgtactgctattattagaggaagaataatttgtaccatcatataaacaatatactcagttttcataaagcttacatgaactgggaatcagaatatttttccattaaaaatttgtgtcttggccaggcatggtggctgatgcctgtaatcccagcattttgggaggccgaggcaggtagatcacctgaggtctggagttcgagaccagcctggaacaatatatagtgaaancccatctctaccaaaaaatacaaaaattagctggatgtggtggcacatgcctgtaatcccagctacctgagaggctgaggcaggagcattgattgaacccaggaggtggaggttgcagtgaaccgggaccatgccactgcactccagcctgggcgggcgacagagtgagactctgtctttaaaaaaaaaaaaaaaaaaaaggacgattttccaaaggtggggggaagcgaggataaccccataaggtcagcgatggtggaaaaaaagggtaaggggccagagcagccacagatgcattgaccttccact

SEQ ID NO: 667217 - DNA, 531 bp, Homo sapiens
gggtgttcctcgtcagccccatttctgagaacaggtgaatggcagaacagccctgcgcttggcccagccagctctctgtgttcgcgcccttagagcctctgcgccctcagttccgtcctgctcttggctaaattccagaccctttcagtaaatggccgaatggccctaagtcctctcctcactctgcactcccaaaaacagcaacaactttacaggtatgctatcgtctttcggtgtggtggtgtgttgttaatttcagagaatttagaagaagtcattgctccgaccacggagaacagaacatacacagaatgaaaatcaagggggggcccggcatgaaattctttcccctcagggggccccgcgctgtttgcacgcgcgtccccgcggcctgtttctgtggtcgcaagcgtgggaccccgcaatacgtaggcgtgggcggtatttatgtgagcactgccggggcaggagccggccgaagttccccctaactggtgcagtgcgtgcctgaggcctgaaatggcgagttct

SEQ ID NO: 667218 - DNA, 402 bp, Homo sapiens
gcatgattcgctgaagtccttaccctctccgttagattctgaaagtattgtatcacagagctaataatcggctgggcgcggtggctcatgcctaataatcccggcactttggaaggccgaggagggtggatcacttgaggtcaggagttcgagactagcctggccaatatggtgaaatccatctctacaaaaaatacaaaatcccctctcccctctctcctcccccttccacggtctccctctcatgccgagccaaagctggactgtgctgctgccatctcggctcactgcaacctccctgcctgattctcctgcctcagcctgccgagtgcctgcgattgcaggtgcgtgccgccacgcctgactggttttcgtatttttttggtgatcgtggggttgtaa

SEQ ID NO: 667219 - DNA, 1045 bp, Homo sapiens
gggcacatgcagataaccggcgacatgtactccatgaccaggaggtttgatcgcaggcacgtgtgtgcctatgagatcatcctctggacctgaccaggccccgtatcacccgtgtgacagagtagctcttcctctccgtgcagtacggaagtacctggtgcattcgacactgggctatgcgcatggtccagccccagtgccctggtcctcctaggtgcacggcgccacgtatagttgtggaactgtccaagcaatcaccgggccaagtcgacatacatcgtagcaagtgacatcataacagcggtcaagtgctaacgttgaggttgggagcataaatggcattgtagctagacttgcatgcacccaattggaatagagaagggcatggagcccaggagcactacgtccatgagagggtccgaagagggttcctgcctctctgatcaatgataatctcggatgtctaccctgcatttcactcaagtgacttcgagggtgatgccagtttctagtgactgacaactgggaatcgtggtgcgaaggtgcatccatagcggacgaagatactctccacgtgctgtgccggatagatactggtggttccttccggaatgtcgctgatgatcttcatgaacctaagatctctgctgaggcagccagaggccaagtcccagttgaccaaatgggtatccgggagccgcttccagcgggtgatcctgaagatggggccgtagcacgggccctggagcaggtgcagggtcatcttctgcgcgggaagggtactatgaccgcgaggaagcggggcagcaggacctgggagaaaaagtgggcatcagcgccggggagagtctcatacccttgacgacagccggagggagagtccagtgcggcggcgggtcggggggccccaaatggggaagaaatagccgcttgcaggggggcgggccatgaagtgggcccaggggacccgaagaaccggcggaaagggacgccccccgcggaaaaaggacccgtcgttggcggaaaaagcgggacaaacacagac

SEQ ID NO: 667220 - DNA, 787 bp, Homo sapiens
gttgtgatcggcgaggattgttgccatcccggcggcgaggcattgcagatgtggaagatggcaaagttcatgacacccgtgatccaggagaacccctcaggctggggtccctgtgcgggttcccgagtcaggtttcgggatatgccctatccaggcgttcagcaaaggagatcgggtaggaaaggttgcagactggacagagagccagataccaagataagaggtacacaaataagtactcctctcagtgggtggtggaaggtcagatatgcttagttgtccactgaggaggatgaaagtagcttccagctggtggatacatgcgcgctacagcagaagacgggctaccagcggacatcgaactgagatttgcgccagaggaacctccgcagagagcaaagatcgtcggagacatgtggcagttcaacctgcagatcctgcctaagagtgccaatacagaaagagagagaacgcattgcgacgtgcagaagaagttccgagaggacgaatttggggttcaggcagaaattgggatcagaatatcatcagaatatcccgtagactcttcagttgaagttcgtagtgattgggaagtgaaagaggaaatggattttcctcagtgatgaagatgcgctacttggaagtatcagagccacaggacatgagtgtgtggggccctagaatactacgacaaagcctttgaccgcatcaccacgaggagtgagaagccactgcggagcatcaggcgcatcttccacactgtcaccaccacagacgacctgtcatc

SEQ ID NO: 667221 - DNA, 406 bp, Homo sapiens
  misc_feature (264)..(264): n is a, c, g, or t
  misc_feature (349)..(349): n is a, c, g, or t
  misc_feature (376)..(376): n is a, c, g, or t
gagatggagtctctgtcacccaggctggagtgtagtggtatgatctgggctcagtgcaacctccacttcctgggttcaagcgattattctgcctcagcctcccgcatagctgggactacaggcacgcaccaccacacccggctaatttttgtatttttagtagagacggagtttcgccatattggccaggctggtctcgaactcctgacctcgttgatctgctggccttggctgcccaaagtgctgggattacaggcgtgacanccatgcctggcaacaatttttatttgtcaataaatttgtttttaaataaaaaattaaaaaactgaggttgacagttgcaaagctnctgtgagtattccaaaatttcactganttgttacatttgaaatggcatgaaatgtat

SEQ ID NO: 667222 - DNA, 143 bp, Homo sapiens
aggacctttggagagaagcggggccagttggactaccagtccctcttggtgcgcctgggactgatacgtcagaaagtgcgggagaggctccataatgaggaatgtcagaagatggatctctggatagcagttcatctggggac

SEQ ID NO: 667223 - DNA, 162 bp, Homo sapiens
  misc_feature (12)..(12): n is a, c, g, or t
ggcccccccggntttgggggtaaaaaccctttttggggggggaccccccccccccccccccggggggttttgggggttccccctttttttttagccccctttgggggaaaaaaaaaccccctttttttttcccgggggggaaaaaccccggggtggggggga

SEQ ID NO: 667224 - DNA, 267 bp, Homo sapiens
cacacacacacacatacacacagagagagagagagagagagagagagagaaaagcagaaatacgttggctgaaatctaccctagctctaacctttacccatagcagccctagacacccaagagaacccttagagctgcatggaacacaatctgaaagcccaattttttcacttacagatgagaaaggcccagagaagtgaagggactttgccaaggtcacacagtgggagcaaaaacgcattttcctagaacagattctgaagaagg

SEQ ID NO: 667225 - DNA, 81 bp, Homo sapiens
tctgctgtattcatggacacttggacctgtgtctggctaatggcgcccacgaataaagttgctgttgactttcattttgaa

SEQ ID NO: 667226 - DNA, 268 bp, Homo sapiens
  misc_feature (4)..(4): n is a, c, g, or t
gtangtaccttctgcagatagatagaatctcatacatctcatctaagaaacaaaactacatgatgaggtcctctggaagaatgggagagaggaagaagaggaaactattccatctgaacttacttataaaagcccatatagttgggaaccacatttaagattttaatggtcctcatgggatatgaccacatattggatctccaaaaagtggcattattaattaacactaatcctgaatttggttattgagaatcagggaactgaaatg

SEQ ID NO: 667227 - DNA, 615 bp, Homo sapiens
caggctggtacgcctcggttgcgggatcaggtgctccgggaccggaccgaacctgggctggggctggattgatttataaataaaggcacattcgatccaaaaaaaaaaaaaaaaaaaaaaaaaaaaaaaaaaaaaaaaaaaaaaaaaaaaaaaaaaaaaaaaaaaaaaaaaaaaaaggggggggcctggatgaagatcatcttctctcggaggcggcaaccagctagttagcaccactaccaccgatgtttttgtgtcaacaaaaggggcgcccccatatgggcgcagcttttataatactacaccgcagacagcgccgcgcgcttttaacaaacacagcgtgcgcgagtggagcaacaacacgacgactcgggcgcactctcttgtgtggaggaaagggacgaacccccttatcactgtgtgcggggcgcgtgcccaacacatataagtggtgagtggacgaaacaaacctctctctgtctctcgcagcattattatacaggcgccgcctctaggcggcgcatatatctcatatacaaattttaccaagcggatgtatatatacgcgggtgtctacaacacccaccgcggccatcatatcgtcgcctcgcactc

SEQ ID NO: 667228 - DNA, 582 bp, Homo sapiens
  misc_feature (1)..(1): n is a, c, g, or t
  misc_feature (152)..(152): n is a, c, g, or t
  misc_feature (215)..(215): n is a, c, g, or t
  misc_feature (239)..(241): n is a, c, g, or t
  misc_feature (247)..(249): n is a, c, g, or t
  misc_feature (253)..(253): n is a, c, g, or t
  misc_feature (255)..(256): n is a, c, g, or t
  misc_feature (276)..(276): n is a, c, g, or t
  misc_feature (280)..(280): n is a, c, g, or t
  misc_feature (288)..(288): n is a, c, g, or t
  misc_feature (293)..(293): n is a, c, g, or t
  misc_feature (302)..(302): n is a, c, g, or t
  misc_feature (305)..(305): n is a, c, g, or t
  misc_feature (307)..(307): n is a, c, g, or t
  misc_feature (309)..(309): n is a, c, g, or t
  misc_feature (318)..(318): n is a, c, g, or t
  misc_feature (322)..(323): n is a, c, g, or t
  misc_feature (325)..(325): n is a, c, g, or t
  misc_feature (327)..(327): n is a, c, g, or t
  misc_feature (331)..(331): n is a, c, g, or t
  misc_feature (334)..(336): n is a, c, g, or t
  misc_feature (338)..(338): n is a, c, g, or t
  misc_feature (348)..(348): n is a, c, g, or t
  misc_feature (354)..(354): n is a, c, g, or t
  misc_feature (357)..(358): n is a, c, g, or t
  misc_feature (366)..(366): n is a, c, g, or t
  misc_feature (370)..(370): n is a, c, g, or t
  misc_feature (374)..(374): n is a, c, g, or t
  misc_feature (383)..(383): n is a, c, g, or t
  misc_feature (385)..(385): n is a, c, g, or t
  misc_feature (388)..(388): n is a, c, g, or t
  misc_feature (395)..(395): n is a, c, g, or t
  misc_feature (397)..(397): n is a, c, g, or t
  misc_feature (406)..(406): n is a, c, g, or t
  misc_feature (410)..(410): n is a, c, g, or t
  misc_feature (414)..(414): n is a, c, g, or t
  misc_feature (420)..(420): n is a, c, g, or t
  misc_feature (428)..(428): n is a, c, g, or t
  misc_feature (431)..(431): n is a, c, g, or t
  misc_feature (433)..(433): n is a, c, g, or t
  misc_feature (443)..(443): n is a, c, g, or t
  misc_feature (449)..(450): n is a, c, g, or t
  misc_feature (455)..(455): n is a, c, g, or t
  misc_feature (457)..(457): n is a, c, g, or t
  misc_feature (464)..(464): n is a, c, g, or t
  misc_feature (466)..(466): n is a, c, g, or t
  misc_feature (471)..(471): n is a, c, g, or t
  misc_feature (474)..(475): n is a, c, g, or t
  misc_feature (487)..(487): n is a, c, g, or t
  misc_feature (544)..(544): n is a, c, g, or t
nagcatcttttttgttatttgtttgcatccctcccccacaccctggtgttttaaaatgaagaaaaaaaaaccatcactttttgtacaaaaactcttaatgattaaaaaacaaacaaaacatattggccttgtcatttgtgtgaaagtgggcnaagactggaatagagttagacaactgaaaccaattttcatccttatataactgagggaacccntctttcctcttttttttatataannnatagtnnntaangnnggtacttatactccttaccncaancccccccnctctngttttatcnagntntnggaaagagncganntngncctnccnnncngggtagaccntacccntannttgggggngggnggtngggtggggngnggntggggangnggaggtgtngggnggtnaaatanttttggtnccngnggcggaagangccaanngagtntntatactngntgggnttnntgccatggatgngggggagaaaattcggtcacaagggggttagtgacaacaaaaagaaaaaactctgangcgcacagcgacactggggggggggcggtccggatttt

SEQ ID NO: 667229 - DNA, 1008 bp, Homo sapiens
  misc_feature (638)..(638): n is a, c, g, or t
  misc_feature (773)..(773): n is a, c, g, or t
ggagagaactagtccgagtttttcgttttatatttccaaaagggaaatcccaatctttttattacggaaagccatcaacggggtgtggggatttttgtcaaacctgttagtgaaagtcctccaggggaattttcctccctccaagttccataccacacaagaggaaagttcttcaagccttctatttcacccctttcttcaatctccccacaaaatatagggggttgtgtccaacttattgtgctctctcaatgtgattaaaaaccttggtggtgcgttaagaggtttcctcccttgaggaacctagcgcaaacaacagctatggaggctcttataccctttatagagtgaaagaaccattaaagcgaagcccagaagagggctcttagagcgaagcacaagagagtctccttggggggaaacaatccattaggcgtttctaataccccagacatcttaaccctttgaggggtttcaaaaactcttgagggctctatacaaccccaaagcctgtgtgtgccgaggtctacaaactataaacgacagaggggcaagttgtagtggaaacacccccacgagagagtttttctccagtggacagaacacaccctatgtggagagaaatggctccgtgaaanattaaagctgtgtataagcggcgaggttataacacccagacaatctgttagaccccacaaaggctgttgtgcagagggagaaacaacctaatttttgtccccccctctccacgaatccctatatgtggaacaaanctcgctcataatcactgatgtggccactccacaatgtgtaggaaaaaacaagggttgtggggacaccaaacaatgtatattgtgaggacaatgggcccttcttccctgttgaataatggggtgtgcccctagtgaacacacaatgtttccccactataaaggatgttgccccttcttttataaacaaattttccaagaaacggcgtttgtatgttgctcatggccccccaaaccc

SEQ ID NO: 667230 - DNA, 408 bp, Homo sapiens
gcggatctgggacagaaaccgggagaggagcccaaccgcaccgagagcgcgaggccgaccgggcaaggagtgggaccgcagccgggacgacaggaaccgagagcgcgcaggaccggagcgcgaccggaccgtccgagcagagagcggacgagacaaggccagggacagggagcgggccacgcaagaccggagcaagacaaagaacgctgggacccgaacccgaggctcgaggctcgacgctggcaccgctcgcaggcctagacgccccggccggcagagaccctttttaaagccacgttcgtaagatgcgttgaacaaatagcttttgaaatagccacgatcttagattcaggatagaacattctggacttaaacattactgtaattttgtgtaaatggtttcttaca

SEQ ID NO: 667231 - DNA, 324 bp, Homo sapiens
gattcccccatgagatgtacttaaagaagacttggaagaagagaaagacaaggcattatctgtcagcagctgctggtagcagctgagatcaccaacagtagctttccttgcttctggaagttttcctgagaaacatccactgcagcaccatggataattagtgagggcatcactaagattcctgaacttcagaattttctggaaatagcatttctgacctttgtccctcaatgcttccaatagttgcagaagcctttcattccctgtattaaaactctctttacttaaaaaataagaaataaaaatgaattaatgttttatgtt

SEQ ID NO: 667232 - DNA, 394 bp, Homo sapiens
attaatatttctgcaggtaagcgccgtgtgtgtcccatatgctccatgttccaacccacatcgatgggtcaagtaataggtcgactgtccatttacttttcagtctactacttttgcataatctacttctgagtctttcacctgccccctttcaaatggatatagctgaaacagcaaaaatattctttaacagtgatggttataatggacatgctgtccgatcattaaccacagcagtccttctactagaatacactgctgtaacgaaatcctgcgagctaaaatttactgaataccctaatcacatatttgctaatgcctctgaaatgtctaaatcggtcaaattaataaaaatcagtgctatctattaagtctgactattgagcctagggcc

SEQ ID NO: 667233 - DNA, 581 bp, Homo sapiens
  misc_feature (51)..(51): n is a, c, g, or t
  misc_feature (87)..(87): n is a, c, g, or t
  misc_feature (117)..(117): n is a, c, g, or t
  misc_feature (173)..(173): n is a, c, g, or t
  misc_feature (255)..(255): n is a, c, g, or t
  misc_feature (271)..(271): n is a, c, g, or t
  misc_feature (305)..(305): n is a, c, g, or t
  misc_feature (322)..(322): n is a, c, g, or t
  misc_feature (329)..(329): n is a, c, g, or t
  misc_feature (339)..(339): n is a, c, g, or t
  misc_feature (342)..(342): n is a, c, g, or t
  misc_feature (386)..(386): n is a, c, g, or t
cccccctcgagtcacggcatcgataattttgattcaaccaatactgccacnctggaggcatttattcgctgcaataaaaacagtggnaaaatccccactgcttaagtagagtaactngtcagctcatttgatcacaaatgcttggatcacatctctttcttttgcctccccangaatttggtatttcattggtctaatatttcagaaaatcattacccaggttcagagaaacttagaaatgctccagattctggngtgactttgaggcttnatgggctgaaaggcatccaagctttcactagagnagtgcatgggctcctgngcttagngcatttgganaancttacaaggcacaggcttgggctcctgagtcacacacagctctnttcttcagctctcctgcctcctgacctctccttattaggacacctttgtgagcatctgcctcaccagctccttcctgggcaggcagtattgggtgtgaatcaagttccttggaaccgtgggatccattagttctagagcgaacgccaccggcgtggagctcaatctatagatcccgtaatgagggtaaattgcgc

SEQ ID NO: 667234 - DNA, 503 bp, Homo sapiens
  misc_feature (45)..(45): n is a, c, g, or t
agccttaggggatgccgctgccatcgggttggtgtcacccccccncatggagagtgttttgggatattcccaaggtcccccaccgcaggagggagtttttcattgttggaaaactgcaggatggatttttgcccatccctacctgcagttttgtggctccctggaacagccttagtttagctcagggccgggggtttcccaaaacccaccctgttgggtgtgaggaaagcccagtgttttcctgtttttccctcccctgcaaaatgcaaaggggccctcattgtttgtgggggggccagctcctccaagggttttaaaaggggttccagtcccgtcccctttcctgccttccttgggagccaggggtgtgcccctggcagtcccttgggttccaaaaaaccttaattctgcccggagtggaagtttaagcctgcccagggtcccccctgtttcccctcccttttttttttcgggcaattaaataaaaggtttcccccccccca

SEQ ID NO: 667235 - DNA, 114 bp, Homo sapiens
tgctcagaagacgaaaatgacataagtaattcagggtcgaagtcaacttaatgaaatcactgatcaaaggcattcttttgtttttgaaacgggaccctcagctctgtcctcagg

SEQ ID NO: 667236 - DNA, 368 bp, Homo sapiens
tcgagtcttacccttattgtgtgtgttcatccattgtacattttttgtttcccttcatttgttggtctctcgagttagtggtataagttcacatttattgatacttcagtgctaggcaccactgctgatattctttaaattcattgtctcatgacaaatctatgaagtggattgcatgtgggctgtttttgttcatgcagaccacttttctacttttctatacccctttttgtggttcctgtaggaaactcctttcccacttaacatggtcttggtggggctgtcagctacagtgctctgatcagagtaccccttttcctggccactgtgatagactgaagaactgagtatgtatcacaagtacagtt

SEQ ID NO: 667237 - DNA, 420 bp, Homo sapiens
  misc_feature (8)..(8): n is a, c, g, or t
  misc_feature (249)..(250): n is a, c, g, or t
aatactgncggttaccagtattaacccttcatctgttcttgaaactggttggggaatgaggtgataaacaaggagggtgtaagtttaggggccaaaaaagaaagaatgaataatacgagcagaccttctctgtagaaggtaatggtctgagaatgaaaaggtgttttatggacatgttgggggggccccaatgcaaacccctgctttgagtcctaaggaagggaggggcccttttggccaatgccccanncttccttggaagtggggtttatggggaaagggagggactaagggcaaagtctttgggtttcaggcaagcattatgttatttccattccctattacttaaaaggttgggtgtaaacagggtcatttttgagttttcagggcccttgcccccccccccatttttttaatgga

SEQ ID NO: 667238 - DNA, 361 bp, Homo sapiens
accggtcctgcgggggacgaagaatttatcttgcccatttagcactaaaaatcgttgctcttaaattcttacatggttcacctggatcgatgattactggctattaaacaataacacaggaatgtcttatgttctggatctttctcgaagaccataaacaaagttcgttgagattaacattacaggcttcacctctcgtcccccgtttgtcatagctttgtgctgtttttaaaaagtttaacacttactttgagacttcatttctctaaggacattttttgtttattttgaaatgttctgagttctgtatgattgctttcaatccatgattttcagactttatttcagcagtgtaacttac

SEQ ID NO: 667239 - DNA, 175 bp, Homo sapiens
  misc_feature (32)..(32): n is a, c, g, or t
gccttccccacagtgagtactgggatatcaantaaactcgagaatgtttcttcacatctccttattcttcgtccctccaagtactcagtttggtcttctttcaggtgtaggataacttgttgtccacgacccatatgttcacctgtgtctagtcctcacgtgtggggagaagtgg

SEQ ID NO: 667240 - DNA, 262 bp, Homo sapiens
  misc_feature (217)..(217): n is a, c, g, or t
  misc_feature (237)..(237): n is a, c, g, or t
  misc_feature (239)..(239): n is a, c, g, or t
taggttttaaagggaaatggcccagcctgacccccctggcccctgccatcctgctgccttcccagtggggctggtcagggggcagcctggcccctgcctaactggaatgggaggaagcctgcaggtggccccggtggccctggctgcagttttgggcagcatcctcccaaacaaagaccctgcttaagctcctggggtgtggggtgtgggctggaanccctggctccctggtagggncnataaaggttttgggtctttttta

SEQ ID NO: 667241 - DNA, 183 bp, Homo sapiens
ccctctgactatgatacgggttgcaaatattttccctactttgccattcgtctttgtttatggtgtttttcactctgtacgacttatagctttttcctgttgaccgcatttgtctttttttcccgctctgcgcccctgtgtgcccttctcgccccccctttactctcctgtatcccttctccc

SEQ ID NO: 667242 - DNA, 169 bp, Homo sapiens
ccatggttattgtgagggacattccccaagatgataatgaatgccacatgactagaactgggtcttctatttttatgactcttgaactgggtttttttgttttgtttatttttttatggcagagtctcgctctagtcgcccagtgctggagtgcaataggtgcaatctc

SEQ ID NO: 667243 - DNA, 857 bp, Homo sapiens
  misc_feature (18)..(18): n is a, c, g, or t
  misc_feature (28)..(28): n is a, c, g, or t
  misc_feature (30)..(30): n is a, c, g, or t
  misc_feature (101)..(101): n is a, c, g, or t
  misc_feature (137)..(137): n is a, c, g, or t
  misc_feature (147)..(147): n is a, c, g, or t
  misc_feature (229)..(229): n is a, c, g, or t
  misc_feature (319)..(319): n is a, c, g, or t
  misc_feature (372)..(372): n is a, c, g, or t
  misc_feature (392)..(392): n is a, c, g, or t
  misc_feature (479)..(479): n is a, c, g, or t
  misc_feature (505)..(505): n is a, c, g, or t
  misc_feature (530)..(530): n is a, c, g, or t
  misc_feature (549)..(549): n is a, c, g, or t
  misc_feature (557)..(557): n is a, c, g, or t
  misc_feature (572)..(572): n is a, c, g, or t
  misc_feature (599)..(599): n is a, c, g, or t
  misc_feature (649)..(649): n is a, c, g, or t
  misc_feature (687)..(687): n is a, c, g, or t
  misc_feature (693)..(693): n is a, c, g, or t
  misc_feature (698)..(698): n is a, c, g, or t
  misc_feature (703)..(704): n is a, c, g, or t
  misc_feature (739)..(739): n is a, c, g, or t
  misc_feature (755)..(755): n is a, c, g, or t
  misc_feature (766)..(766): n is a, c, g, or t
  misc_feature (780)..(780): n is a, c, g, or t
  misc_feature (815)..(815): n is a, c, g, or t
tgccagcgccccagaggncccgggacancncgaggcgccgcgcccgcccgaccccgagctccccaagccttcgagagcggcgcacactcccggtctccacncgctcttccaacacccgctcgttttgagcggcagcncgtgtcccanagaccgagttgccccagagaccgagacgccgccgcgtgcgaaggacccaatgagagcccccgctgctacccgccggcgccantggtgctgtcgctcttgatcactcgcgctcaggccattatgctgctgcgattggacctcaatgacacctactctgggaagcgtgaaccantttctggggaccacagtgctgatgcgatttgaggttacctcaagaagtgagangtcttcagggagtgagattncccctgtgagtgaaatgacacttctagtagtgaacccgtacctacgggatgccgactattgactactgcagaagaggtattgataancgaaaccacaaaatacctaggctatnatttgttcgactgatctcagctcangagtgtgaacagggtagtntaacgccnccccccaaaaacaangacgggaacagtgcaaaaatacgttcnagaataacaccccacaaaagaaaagaaaaagaggggagggcaaaaaatgngcaaaaaaatagtaagaaaactagaaaagaacgaaaanatcctntgttnatgcnngcaatttcaaaaatttcctgctattcacaggaganatgcaaaatagtatangagcaacctgngaagcaagtaacantgcaaaatgtcagccaagaaatatttcgggtgaancggatgtgggggaaaagtccaatgaaaacctcacagccatga

SEQ ID NO: 667244 - DNA, 434 bp, Homo sapiens
gatagagcaggatccagcagacagtgcagccattgcttcactcgctggcctcttatcccacctcgttaatcatgtcaacatacggatgcaggttgagctggaagagggcgagaatcccgtcccggcattccagagtgatggcacagatgaaccagagtccaaggaacctgtgtagaaagaggaggagccagatcctgagcctcctcctgtaacaccccaagtgggtaagggcagaaagagccgtaagttctctcgcctctcctgtctccgccgtcggcgccatccaaccaaagttggtgatgacagttagctgagctaaggctttgaatcggactcgagccatgactcagcccgggccagtgagggctcagaacagtgcgttctcacaagaaggtcttgaaggtgggggtccggctgtctaaggggtacccgcc

SEQ ID NO: 667245 - DNA, 338 bp, Homo sapiens
  misc_feature (173)..(173): n is a, c, g, or t
aaacccccaaatgtttgttttttaaggggggtttttaaatccccccgcccgggggtgcgcttcctatttttaggggtggggaaccccccctgcctccagggggccctttcaaaacaaaaaattttttggggggaacttccccttaaaccccttcctatataaacagctttggntggaggggcccttttttttcccggaggggggttcccccgtttaaagggccatattaagtttctttttttatgtggcccacccatagggaaaggtacggggcccttttttttggcccgcccccatggggtcttttactttaaaaattaatccgttaggccggccca

SEQ ID NO: 667246 - DNA, 552 bp, Homo sapiens
tgcgtggaattacgctgatcctatcaatcgcacttctcggtatccaaaataattgaaagcaggctctttgcatatccttgtttcatagcagcattattcataatagccaagaggtgaaaggaacccaaatgtccatagatggatgcttggattaacaaaatgtggtgtatatatacaatggaatattattcagtttttttactgtagcttttttttaggtcttttttttattgttattttagaaatggagtctcgctctgttgcccaggccgtaatgcagtggcacaatctcagctcaccgcaacctccgactccggggttcaagcgataatcttgcctcagcttcccaaagtgctgggattcacaagcatgacccaccaggccgtggccggttatgttcttatggacctgaacatacatgttggtataatcacacaagtaaaagctattggtatttggtgaaaaagacaaaatctattggtgttacaaatcatgtgtcctgatatcaatccagctagtggtggacatcatataggagtgcaacagaaactt

SEQ ID NO: 667247 - DNA, 334 bp, Homo sapiens
tttggtcttggagaaatccaacgagcaaagtggcatatatccacaggtcattgccactgacgatttggggcttataaggcaccccatagatgtgacatagtttgatcttttatcactaccggttcgtcctcttcctcactcgttctattgtatgcgcattcgaattctgttcttcaatgcaaaagctgctgatttggatacggtgattggagattccttccttttcaagtacacccgctggctttccactacttgcttctgtgcgcctcgttgacatgaaattcaaagtgttcatcctctgttttcttctttgattcctgatgggacgaagatg

SEQ ID NO: 667248 - DNA, 225 bp, Homo sapiens
caccatgtgctggctggacactttggtcacttttgaagcatgttaataaatgtcactgattaaaaaaaaaaaaaaaaaaaaaaaaaaaaaaaaaaaaaaaaaaaaaaaaaaacccccctttttttttttggggggggggggggggggggggggggaccagggggggcccgggggggggggggaagagggagggggggggtgggcccccccccaatataggcccca

SEQ ID NO: 667249 - DNA, 318 bp, Homo sapiens
ttgttgatccccttactatctgggtgtgacaagtcactgttcacacggaggctactcatctttttcacgtggggtgctcagtgtagtcacgatagaaagacagtcttgcttgagcaaagtctgaatggctccacttttttcaattctctctccaatcttcagtaagtcacttcaatgtcgggctggatgaagccccaaacattgactcaggaaatttgactttccattctctgctggatgacgtgagtaaacctgcatctttggagtacgcttggatagcctccgggcagaaagagagagtagcgcgagcacagctaa

SEQ ID NO: 667250 - DNA, 205 bp, Homo sapiens
tttccccccccccccgttccggggccggggggaagcccgggccccccttttccccctgtttctttggggggggtttcccccccggggggccccccccccctttgggggccctttccccccccccggcccccccccttttccccccccccagggggggggggggggggggttttttttttttttcccaaaaaatttttttttttta

SEQ ID NO: 667251 - DNA, 316 bp, Homo sapiens
ccttttacatataacttaaccaaaaacttggagtaaattccatagcttcacctctctggtcttattctcttactgccaacctcccagcctctgctaccaaggactcccgtcatgtcacagctgggctaggcactcccccaactgcttttaagacccaggtgcctgatcccttcaaagcacaaataaaaccagttattgacaaggcgtggggtcctactctgttgcccaggttgctctcaaattccaggcttaagggaatcctcccacttcagcctcccaaatttctgggattacagcatgagccaccgtcgacgcg

SEQ ID NO: 667252 - DNA, 281 bp, Homo sapiens
aagggggggtttgggggctttttttccccccggcctttgccaaaagggcccaaaattggggggctttttttaccccttaccccccttccccgggggggccaaaaaggtttgcttttcccttcccggccccccacgggggtttccttaaaatggggtttttttttggaacccttttttttaaaaggcccccccccccccccttgggggggggggggggtcctttgttcccccccccccttttggggtccccctttttaaaaaaaaaacttggggccccccca

SEQ ID NO: 667253 - DNA, 114 bp, Homo sapiens
agaagataagaaagaaacagaggacaaaaaaacagacgttaaggaagaagataaatccagggacaacagtggtgaaaaaacagataccaaaggaaccaaatcagaacagctcag

SEQ ID NO: 667254 - DNA, 361 bp, Homo sapiens
ccgtatcagacatcttaatatggcattcattctcatcataccctgctatcattaccctgctgtattttctttcagtgcattactcactctctgtaaatccttatttgcttgttttccatcctttccatctaggaatacatttatcacgaataagggaccttgatctgaccctgttatatcatgctgtatcctctagttgctctaaccagtgtcctgcgaatgctggcatgaatgttcttgaacaatactcctagtatgacatgagacaatactacttgatcaggcttgcgttagcataatgctcacatagttcgggagacagggcgaagaatgtttacatgaagcccaaatgacgggcata

SEQ ID NO: 667255 - DNA, 509 bp, Homo sapiens
  misc_feature (79)..(79): n is a, c, g, or t
  misc_feature (108)..(108): n is a, c, g, or t
  misc_feature (250)..(250): n is a, c, g, or t
tcagggcggtattccgccaaacgctcccaaaagctcagtgtcccattgtggagcgcctctctaattccatgatgatgcncggccgcaacaacggcaaaaaggttatgnctgtgggcattgtcaagcatgcctttgagtttatacccctgttcacaggggaaaaccctttgcaggttttggtgaaccccatcatcaacagtggtccccgggaggactccccacccattgggggccccgggatttttaaaanacaagctttggatttgtcccccctgccccgttttaacagaccatttggttttgggcacaggcgcttgtaagggtcccttccggaacattaaaaccatttttgagggcctggcaaatgagttcatcaatgttgccaagggctcctcgaactcctttgcccttaaaaaaaaggacaagttggagggtgtggccaagtcccaccccttatttttccagctgttgcccaataaacctttttgccctttggggcagccccccca

SEQ ID NO: 667256 - DNA, 1149 bp, Homo sapiens
tgaggagaacacgtcactcatggaccagcctattccaacagccgccgtttcgacccctcttaatctgagtactcgaaccatctgatcgcttcctcgataggttgggaacctcttctccaaggaggaacccacgcacggtataacctgggtatgtcagtaaacccgggccgctgttcgtgctcgtagtggaccacccttacgagcaagaggtttctttcccggagagcaacctgtccaattgggagccgaaggactctcgtgaagtccatgcaccagcttcgacgtaacgagtgtggccaagctatgtggtgtcataagacactgaattgctcggcacaccttgaagccacgtttaataagaactcaagcatgccctcccatccagcctatacgtctcgtccgggaaacacccttccccggagtgtcccacgtccactcacacctgcctcctcttgctgcaacgtactcgctactcggctatcctctcgcacaggacctgcggcgtcttactacggggagctagcgactaccgagtccaggctcagaacagtcgaaggcacacattcaacgtccatccggagaagatttgtctcctctcatcttccgaaccatacacctttcctcgaggccccacgtagtgttcctctgtcccatacacagggagctcctcctccaagggtagatcggaccgttacatgctgcctaataggcattatgtccctcgaaccaggatactcctgtgccggcatcctagtgtaccaacatgacatgttttaaccgaatcacaatctatcacaatgtgctcagaatccacctgtggcccgaatcgagtataggttcctctttctactccatctgcagatgaccaaacctgtacccgctgccactttcctcactgatattgggaggagggaaggcccagccgaagttccactaaatatgccctcaggagaataggcaccgggctggcttgcacaaagggtttgggttattattgcctctcgtgttacatatcttgctcgccgacgagcacaaagaagtaagggcagttattggacaggtgttatttaaacattctattgtaaatgaatgtgttgattcggttctactgcatagtggagatgcgggggaagagaactgacccagtta

SEQ ID NO: 667257 - DNA, 399 bp, Homo sapiens
taaatgggattctgacaagaatgaggaagagatttgacccagaatcaaagaagttgcagcttcacaccttgtgactcaagccacacggccacattcctctcaaggtgcaaaatgatctcaacttacaacagcttcacatctgaattatttcatttcacagggactttataccaaggttctccacgttgcacaaagatcactacaccttccaaaaccctgctcaggacgtcttagtcatgcattcacaatgggaactggaagtaaaaagcattgagactgttccactgacaattgttttacttcttttttatcttcattagcaggcatcaggcaactttaaccaaccttctaggcagttgtcagtgatcattgtcatattaaagtgcatgttatagatta

SEQ ID NO: 667258 - DNA, 406 bp, Homo sapiens
atgatggaagaagggaaatacgcaactccatacactctagccatcttgtcctatgcaagggggtcaggagggcctgagaagcatgtgtgaagttcacagttcagtggtacaagctcagtaaaagattgagaccccctcctaggactatagaacccttcctctccctccatattttatcaccacattactaaaggcctgtttgcagcagttcctcttaacttgtgtgtcatgtccagtaatcaagaaaaaaaattacaagacatattaaaggcaagaaaaaacagtttgacgagaaagagcaagtatcagaaccagagtcagatatggcagggatgttagaattatacaccaagtgggatttatcccaggtattcaaggctggttcagcattcattcaaaagtcaat

SEQ ID NO: 667259 - DNA, 116 bp, Homo sapiens
tacaatgctggatgttctcggccggtcgatagacctgggagaacactgagaggtgatcctgtctttaacaaaaaagtcacggcctggtgcggtggctcacacctctaatcccagaa

SEQ ID NO: 667260 - DNA, 837 bp, Homo sapiens
aggaaaagtgttgttggtagagagataggttatggaaaaaggggggggggcagcatcacgcccatgggggaaagaagagggcttgagatgatgttggagtatttatacacgggggtgtgtgagaaaaaagaaaatatgatatacgtggagacacaacatatatgtttgtttttaatggtggccgcagagtcccaccggagagagagagagagacacactgtggggctgccacgcctcccacaagagccacacgcggtggcgagaggactgcacgagagaggctgagatgtggtgagtgctccacagagatgaatgtatagagtagatagggtttcacggagagatttaaaggagagagagagagtgggggtgatgatgattttgagacgccgcctcactgatcaatcccgctctcgctcttctggaaggagtgcaccccacttggttgaaccaatctgttttttgtcctctctgtcacggagtcatgccctcttctgaaattttcgtctcttctagagatgttctaagatgtggtgtaatattgagaccctcgctgggcgtgtcacaataaggggcggcagtctgctgcacgcaagaatttgtgaaagccactcttagagaaattctttctggagattttcctcgtggtttatgggcccactagtgaagtggaggccttatattaactgggggtgaggggagcacaccttatcacccatacttgacccacgcgttgttttgggtaacacatcccgaagaaagattttgtcaggaattttttttattttataaatatttccggatatttttcctttaccaaaaaataccattacttta

SEQ ID NO: 667261 - DNA, 327 bp, Homo sapiens
cgtaaaagaaggaaaagctcttctcaccaaaagccatagtaacaattacagaaagtgaaaggaaatagaaaatcaccatgtatatccaatataattaactgccgtatgactcagccctgtgtactacaaccactcgagttgaaaggtagggaatgagcatattcccatattattatattactcattacttacacaagcataaaggggtacctattacaatgggaaaaaccctaggcagacaccacctataagtatgtcagtcgagacaaccactcccttaaaaaacagcgcgggtaccatgtgtctccttgataaatgctcaaccac

SEQ ID NO: 667262 - DNA, 124 bp, Homo sapiens
tgcatggtgactcttagaggatccccctcgcttcacagtaagagcaggtatcatctgcgaactctcctgcagcttgtgccgttcacagcagcttgtggtttcacagtagccttgtgccttcaca

SEQ ID NO: 667263 - DNA, 580 bp, Homo sapiens
cctttaaaacatacctctgacagctccttctctgggcaagttgcatgagcctctcctctcaagtctcaccaggaatttaagagtaattcccaaattgcttctgggccttgactttctgtcatctattcaaatgtcaaaaccttttcctggaagaatgtgctacacctgctgcagctccagttatgcccttgataaaatcagtcagaattatttgctatacaagagtcattcattgatttgtccatcctttctataagcatttcctgaacatctattatgagcaagataccacattggatgctagataaaaagaacagagaaataaagtctattcttaaaggcagcacagtcaagggaggtatggacaagtgaataaagtgtgacagtcactgtgatgagggctatgctaaaggagaaaggcaattagtaaatgtagaagaagaaatggaatttgaaaatcactatttggccaccatcatggtaataattgcttgagtcaagaatcatcagtggatcattctaatgggtggaagtttaaccactaacaggatatttcatggtctcaaagcctcttcccaca

SEQ ID NO: 667264 - DNA, 210 bp, Homo sapiens
agttcatcagctatcattgttagtgtatttaatgtgtggcccaagacaattcttcttccaatgtggtccagggaagctaaaagattggacacccctgatataatgtaaccatacaattcctaaattctgtgagatccttgaagaaatattgaccatttgtctcctaaagctccagaattctattttctaggtcccttctgtcgtcttctc

SEQ ID NO: 667265 - DNA, 897 bp, Homo sapiens
agcggacagacgctgggagcggccgaggcgacgtgatttcttctgacttgaggcctgcagtgtgctgtgagagatctaccactagattatctcaactttggtctcctgggacgcagctcgttgctgacagtcagaacactgaattcttgccgccaggatggggaaatcagagcagcaatgcatgcgcccggaggtcatgcaggacttgctggaaagcacagactttacagagcatgagagtccaggataatggtactacacacggcttcttgagcagactgccccagtggacactttgttcaagtggaagagtttagagaaaatatatgggcaacttttgcccttatggggatgcttccaacatttgcagaggcatgtcttccgcaccttcgatgcatatggagatgggacaatagactttagagaattcagtcatcgtccttgagtgtaacttcgagggggaagctggagcagaagctgaattgggccttcagcatgtacgacctggacggaaatggctatatcagcaaggctgagatgctagagatcgtgcaggcaatctataagatggttgccgtctgtaatgaagaatggctgaagatgagtctgccccagaggaacgagcagtaaaagatcttccgtcagatggactccaatagagacgggaaactctccatgggaagagtccatccgaggagccaaaagcgatccgtccattgtgcgcctcctgcgagtgcgaaccgagcagtgccggccagttctggagccctgaggccaaccatcgaatgtgagagctggtttgtgtcccctttgatgcttctctttgaacatttgggttctttgggccaacatttcatgggggaaacggaccccggtgcgggcttatgcggcccaccc

SEQ ID NO: 667266 - DNA, 1271 bp, Homo sapiens
  misc_feature (384)..(384): n is a, c, g, or t
gcaagtctgctgctaccacctctgacctcaccatatccccattgtcctattacttgaagtatgtggtgtcctccactctctatgctggctgattacattgctcttgtttctcgagagatccagagggttaagcgtatgatattgccttcggtgaccaatctaagtagcactccgttcaagtgatagttcgctcggatggcctctctttcagatatcagcgcataccatcgtattcattggcgcatagagtatcgtacgagactggacatcacttgtgctttcttcctcaacttggtctagttcgtcgcagtaatcgattatgacgagcgctcgcaagacgagacgtcgttgctagtttggttcgctcaaggtgtagacaattgntcaacgatgttgacttgtccgcttgattaaccatatatatagatagaaatgatagggagactttgatgtggcttggttgacgctaggagttccctggtatataccctatgtggtgacaacacgacaagcctgctggagggtacgaggacatgaaacccgccttccggctttcttccctttttgcacaagtcgcgtccaccatggtatggagcttggatcttcgcccatgatagtcccgtgtgcgcctattgtatgcatctatcaagatagatgcgtctagagtctctaacccatgcgactatcaaggcatcttagggaactaagaaaccagcgaaaaaaacaacttgatgggccccagattttcctttgggacggaggaaaaacaaacctatcctctagcttccttcttgtttccttaccccggaaaaacctaaacaatttcatttccagtgggcccattcttcagagaaagcccaaagactccttggggtctaaatcttagttttcccaagcaagttcccatgcacagacaagaacgcgacggggcaccgcaccacaacatttttctccaagagggacacgcttctttggctccattgctggttctggcctggttttccccaaagcaacaattcagggccctatactggacaagactcgttcattgaaggccttgtcttttgcccttggtggacaggcttatcactttttccctatttcccatgagagcaccttttcaaacagtcttgatcgtgccaaaagcctttcctggataacaattccaacgccaaagccctttcaggcactcccttttccttgcaaaagcgcacatttactaccaccccaattataaatttacattgggccttatgcctccccaattccac

SEQ ID NO: 667267 - DNA, 336 bp, Homo sapiens
cggacctgctgctcctcttaagagcagagtccagtgtgggccaggagacgtcagatccatgtccgggtgcgggctctggtttgtgttatcctcagtgggcaggactgggtcgtggtggtccatcttgacccttctctgagctatgcagcgttggcgtggtgcgtctccggcctgtattctctccccttcactcaggcccggggaaaccagcccagttttctggcaggagaggcagaggaggtcggtgcctttgctctgggcttcgctgagcaccagcagaggatgtctctggagaagatgaagagggaggcaggagggggatcctgctatgagtcg

SEQ ID NO: 667268 - DNA, 221 bp, Homo sapiens
  misc_feature (30)..(30): n is a, c, g, or t
gccccgcctttcaggtgacctggaaaaagnatgctagttccaggaaacaaatattatccctagtttcatattcacgggattttctctctctaactatgtaattataaatagagacaagtgctcaaaggaaaaagaacttctctctctagagcgcataatgaaggagctcgacctagacaaggtcaagaaaggtgtctctggaaggggatgcccgctctgac

SEQ ID NO: 667269 - DNA, 496 bp, Homo sapiens
  misc_feature (6)..(6): n is a, c, g, or t
  misc_feature (37)..(37): n is a, c, g, or t
  misc_feature (42)..(42): n is a, c, g, or t
  misc_feature (472)..(472): n is a, c, g, or t
  misc_feature (480)..(480): n is a, c, g, or t
  misc_feature (494)..(494): n is a, c, g, or t
aaaagnttggattttcctggaattggcaggacatgcntttantcttggtaggcttatgcattttagttccagtggtccatagggaaaggcagcatctcaggttctacaccagcacggtcaacagctctatgccagcactggctgcatttcaagatcctcaccccaaaacagagcacacaaatgcacagaccttgcaatggtaaattaggtcacttgtggtggcaaatgactgtaatttttgtcactcaagtggcagaaacaacacagaattcaagatcccggtgatctatatagcaagttacaggccagagaaagtgatgtagagaaaccctgtctcaaaacaaaactcaaaatttaataaagtcagacccaagactgcacactatgagattcaattcatactatgtacagcagactaggcaattccaggcaacaccgtgccactcgtggatgggtatgtgagctctttgangtaataanagtatattgcatgngc

SEQ ID NO: 667270 - DNA, 425 bp, Homo sapiens
gagagagagagagagagagagagagagagagagagagagagagagagagagtgctagcatgggctctactgacatgctgttagataccataggagccaacctatcacaatcctagtagcatatgaagactcacataatagaggctatttacactatagtggcgtagctctaggtcatgattgatttgctatgcctgtcatgactgattagcaagtaatcatcgcagatccatctactcactattgctggcttttgaattgcaccagaggatcccggaccccattacactgtctctcttgatcgtgttaatgatgccatccagatgcatgacaggccctatgaagtctgactgacctgctatgcagacatgaatgtcttcctactgtgctctcacttattcgcggccatcacgggagtgccctgcg

SEQ ID NO: 667271 - DNA, 487 bp, Homo sapiens
  misc_feature (27)..(27): n is a, c, g, or t
  misc_feature (61)..(61): n is a, c, g, or t
  misc_feature (64)..(64): n is a, c, g, or t
  misc_feature (79)..(79): n is a, c, g, or t
caatggcttcaaggttacttcgcggantggaacgctggccgcgcagcctgagggttcgcgngcncagtggcgcggccgnaatgcgctccatggcatctggaggtggtgttcccatgatgaagagcaggcgactgggttggagagggagatcatgctggctgcaaagaagggactggacccatacaatgtactggccccaaagggagcttcaggcaccagggaagaccctaatttagttccctccatcttcaacaagaagaatagtaggctgcatctgtgaagaggacaataccaagcgttcgtctggttttggctgcacaaaggcgaaggcccagcggatgcccccgctgttgaagcccatttacaagctggtgcccccagcaagcttggcacactgagcaactgcaactaaaattacttcaaaaatgttgctgtaaaagttttcttcttttccagtaaaagacttagcccatttgcaatttgggca

SEQ ID NO: 667272 - DNA, 483 bp, Homo sapiens
gtcaacccccgtgctcgctgctcacgtacattcatcacttctagtgatgatgcaactttcgaggaatggttccaccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctggccccggcccgccacctcctgagcccctccctggtctgggccccgaccttgcgccagaaaattgtcattaatgaggatgtatatcctcagaacttctttcctgccctgattaggtcttactgtaccgttctatcctgttatcaactttgtcatctctatatataactattagtttaaaacctaacccctattcttacaaaaattgttatttattataaatagaagtcc

SEQ ID NO: 667273 - DNA, 486 bp, Homo sapiens
gtcaacccccgtgctcgctgctcacgtacattcatcacttctagtgatgatgcaactttcgaggaatggttccaccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctggccccgagccttccgcttctgaggtgtcgttcatctgatcagatgtctgagctcctcagagagcttctttcctgccctgattggggctcttgctgttccgtttcttctccctgcttctcccctttgtcatctctgatctttgcctatctgtttctttttccttttcccctagtacttacagggtttcgtcgtgttgttttaatctaataaacaatagaaagatcccttttg

SEQ ID NO: 667274 - DNA, 858 bp, Homo sapiens
tggtaaagctcggccataaacttctagcgtgtgccaagggtcaccggccaaacttcgcaccaggtgtggctccgggttagccagcaaacagagttcgtggccatcagcagaccaggccagggagggtgcacggggggtggttcgtgcctggccgtgcgtggatacgtgataacttctggcttcagttcactctacaagtgaatctttccctctaaatcccagaaatctgtgagtgcgtggggccgtggtggcagacacacgagccagataggcggtatagggcgtgaagcaacaggggcgtgtgagtgagtgtccccacacatcttagggggtgtaaagggtgtttggccttcgttggaagatcccataaacatgtgggcgtgggcaattcttggctcccaaaagcgccacagagagggagactcacaatttgggaaaagaaagtcaccggtggttcaagatacgcctgtgtgggccaactggtgggtgggatctctcagctggacagtatacgccaggggttccaataccttgtgaccacgcgtgtgtcccagcacaaaggagaaacagagagaataggagtggcctagacgtgatggggcagaaaacgggagaccaacaaagaaaaccccacatcttgaaggtgcggcacccaacaactccccggggaaaccacggaggataatatggggcacaccaccacacacgagaggtatattatcccaaaataaactgggcagagagatataaaaaatacgcggaggaaatcacagaagcaaccaactcctagcccgggtatagctcaggaggcaacaaagggcccacaactccacggacaacactccagttgagaaaagg

SEQ ID NO: 667275 - DNA, 308 bp, Homo sapiens
agcccccgcctaccaccccccccttcgcggccggtcggacttttttccttttttttgagatagggtatagctctgtcacctgggctagagtgcagtgatactatgagggctcactgcagcctctacctccccaggcttaggtgatcctcccatattagcctcccgagtagctgggactacaggcatgcgccaccactcccggctgtttgtattttttcttttttttagagatggggtcccgctatgttggccaggatagtctcgaactccttgcctcagcctcccaaagtgctgggactacaagcgcg

SEQ ID NO: 667276 - DNA, 1126 bp, Homo sapiens
  misc_feature (1)..(1): n is a, c, g, or t
  misc_feature (268)..(268): n is a, c, g, or t
  misc_feature (716)..(716): n is a, c, g, or t
ntgggggttccccccctccttttccccggaaggggtagctattctgtccccccgttgctatcgcccgaaggggggttctctccctgtgaggcgcgtctcacaccgatgggagaaagaattgggggtgtgggaaccacacggaagtgtgggggccccccagggagtgttgtgtagaggggctctactcgccccgtgggtgtagccccccacgtgcttcgactgatggcccctcttatattggtgagcggtttgtttttttggggggggnccctggtgtggcacaagttgaggcgtggtcgactgagtgtgcctccacaataccccccggttattggtggggagcccccctctccacccgctcggtgaacacacaggaaagttgggggcgacccccccttgcagcccttgtcccagagcgtcgccaagactcatcccacagaggtgtggtataaacagagatgcctatatatattagagttgagccacactcgtgttatagagggacccacgggagaatggccacacagagtgagccccacggggcgccacaggcccactctccctcatagcgctcttataggaatagaaggtggggagtttgagatatacacagagacccctcggtggcccccccgagagggggcctcgggttttttcggccactgaggtgttctcgagatggcgtttattcccccccatgggatcccccccagccncttttcgaggccctcatttcacccccgagtaggagtgtgcgtcacgtccaccctcatgagtgagagcccggtgccccttggggagactcggggtttgtgttcgagaaggagcatagaccctggggatagccggaccagaaaattgtaggagccagaatgaccatttttgaccgggtgtacaaaccctaaggggtaccagatttagaatagtcctacacatgtaaaagccaccagataagaaaagtttgaccaactctggagaaccagacgggtttcccactcttttgtgatgtgaaaggaatttgtgaagatttttttttggacttcccaggaatttcatttactattttaggatggtaaattaaaggggggtttgccaatggttataatagagtaggtttttaggacca

SEQ ID NO: 667277 - DNA, 713 bp, Homo sapiens
  misc_feature (32)..(32): n is a, c, g, or t
  misc_feature (165)..(165): n is a, c, g, or t
  misc_feature (710)..(710): n is a, c, g, or t
ggaatcctgtactaggttttctttatctcccnccagcaggatccatacctatcatcttggcactccccatccagcattatgtttttcatttcagccccttgtcaatctggtatttgtcaatatgcactaactatgtgggaatatgtcctatgagcagattctccncgacatttgattctgtttttaaagctaagccttgctctgtctcccaggctggagtgctgtggcgtgattttggttcactgcaacctccgccttccaagttcaagagattctcctgcctcagcttccaagtagctgggattacaggcatgtggtaccacgcctggctaattttcttgtatttttagtagggacatgttggccaggctggttgtgagctcctggcctcaggtgatccacacgcctcagtgtcccagagtgctgatattacaggcgtaatatgtgatcttttgtgtctggttcctttcacgttgaacgctatttttgaggttcgtgcctgttgtagaccacagtcacacactgctgtagtcttcccccatcctcattcccagctgcctcctcctactgtttccctctatcaaaaagcctccttggcgcaggttccctgagctgtgggattctgcactggtgctttggattccctgatatgttccttcaaatccactgagaattaaataaacatcctaaaagaatgaccttcccaaggnaaa

SEQ ID NO: 667278 - DNA, 607 bp, Homo sapiens
cctcacgcgactataagttggctgctcctatagattatgtgtttgtgtgtattatggatctaagtccataatctcttgtcatatatcatacacaataagtcgttataactaagtcaaacatgttagtgtctatctgaatgaatggtcatcctttgttttggaaatgttactagtttgtgacgacaatttgtttccagtctaaattaaattttctttctatacgagtctttaacatacttcgagaacctatttgggccgtccatgatatgtccaatccggtcctcgatggattgtatcccatactgtggttctctgagtctcacattataatagggttggctctcacagaataataccttgtctcgagaacggagtatgtggccagtgtttgattactataatgttaaaggtctctatattatgaagatgtatataatagctttgtgcgcgttcgaaaaaaaaaaacactattgggggaatcatccttttatttctttttcagccagggacctgtccaactcccttttggaaattaatatggggaaagaaatttaattagaggatgaatggagagaaagggtttgaagtgtggataatttggttggaa

SEQ ID NO: 667279 - DNA, 453 bp, Homo sapiens
  misc_feature (421)..(421): n is a, c, g, or t
aattaagctataattatagtatatcaaggtctcataagcatttttatacttatgttaatcaaattcttctacacttttcaccttataagactaaataagtcagattctcttgaacatttaaaatgctttaagtaacaaacacatgcagggtttttgttttgttttgttttgttttgttttgttttgtttgagatggagtctccctctgttgcctaggctggagtgcaatggcgcaatctcagctcactgaaacctcctcctcccaggttcaagcgattcacctgcctcagcctcccaagtagctgggattgcaggcacccgccaccatgcccagctgaatttttgtatttttagtagagatgggggttttcgccatgttggccagggttagtgttcaaactcctgacctcaggtgatccantcgtttgggcattcccaaagtgctggggttca

SEQ ID NO: 667280 - DNA, 207 bp, Homo sapiens
gatacccattatgtgtctaattaagatttcacgtttcatgtattctccgagaaaattaggctgagtgatggaagtacctaggagtccattagtggaaaagagatgatgtcccaaggtaagaaactatactagcagttaatccatgacaccaccatcctcttatccagaatgatagcatttctctaaggcagcccacgtgaataccat

SEQ ID NO: 667281 - DNA, 330 bp, Homo sapiens
atgggtgctccatcccccgcaaaaagaaaagaaaatcccattttctgaggagaatttcaagctggctgtagagatttgcataagtaacagggagctgaatgttaatcaccaagacaatggggaaaatgtctccagggcatgtcagagatctttgaggcagcccctcccatcacagatccagaggcctatgaggaaaacgtggttttgtgggctgggcccaaaggtccctgtgctgtgtgcttggtcccctgcatcccaggccactccagccggactggaaaggggtcaacattagagctcgggcccgtacgcttcagcagggtgacaagc

SEQ ID NO: 667282 - DNA, 123 bp, Homo sapiens
gaacgggtgatgcggttgggagcactgctgtgatctgggctcccgtagactctccaagccagccaggaggaggacaagaggacggcagcgatgggttttccaagatttgcctggagagtacgt

SEQ ID NO: 667283 - DNA, 114 bp, Homo sapiens
tctgtacgtaatcagatggcatctttactgatgcagcggcatctttcactaatgagcggccatctttactactgagcggcatctttactaatgagcggcatctttactaatgcc

SEQ ID NO: 667284 - DNA, 140 bp, Homo sapiens
gaatttctattattggatctttaggggagatatccttttatacaaattaagaccttctgcccttcttgagtcaatgcggcctcgctcgcggatgagggataacgcgaccaaatgccacccacctcaggcggaaaaaaaaa

SEQ ID NO: 667285 - DNA, 678 bp, Homo sapiens
  misc_feature (240)..(240): n is a, c, g, or t
ttattcagtacagttcagggcagtctatactgagtctcagaggagccaaagtgtcataatgaatgtgtagcttggacctagagttctttcagtcattaatgacagagattccatgtcacactaggagtgcatcatctacgttagtgagattcacatgtatcgcgataggtgatgctctgtgcagctcatccacttagtcactgtagtccagtcagtcatagatagcaccatctctcctcntgtaacaataccgtattgacacacgttgcatattcgtatcagcaataaacggcatatctgatgtcatcttcagtaatgagctatccatggtctgaccgaccattgtaagtaaccaggtaacagtcatacaaggtcatgcgtcattcctcacagcatctagatactgcccagttggacgcttccacaattaagcaggcatacaatgcagttctactttgcagataaagcgtgatcagttccgttcgagcctatacgagtcttatatgaagtcctaagtatgagtatggtgacccatacaatgcgcattaggcatacagtgtctgggcagttattggtctggcgtaatctgaggatccgggagtcatggtgctgattcagtaccgggttacaggagacaattcacgttcctctaaaaccgtctagcatgcgccatcataa

SEQ ID NO: 667286 - DNA, 166 bp, Homo sapiens
ataacatcatgacttacgtgtctagcattctaccaggcacattctctggagcacataaggcggagcccgcagacaatacgcatctgcgagtgtgtaaggccgtcaacccaggaagaacgagcacgcttataggaagactacgatgaagcttggacagtgactctgt

SEQ ID NO: 667287 - DNA, 896 bp, Homo sapiens
  misc_feature (894)..(894): n is a, c, g, or t
gggcttgtacgccctggatgacatacaatacaatggggaagctgctcatcttcagagaaattccacctccacctgagagtgtacctttcgagcaagatgaatgtacttttactcaggagaaaagaaaccgagcagtgcacaggaggaggggagaaactcccattcctacacaggaccaaagggagatcacactactggggtaggctactacatgtacatgtgaggcctcccatatggtgtatggacaaaaagcacgcctctgtgtcacaggcctctggaggagtctctgaaaacactgctgtgacctttttctaccacatgtatggagggggcactgcctgtgagttgtttatctgaaaaaggaccgaagacagtgaagagtccctcttatggaggcagaagaggtgaacagagcatttcctggtacgagcactgtgtgaataccagctgtgagaggcaaacaccagataattttggaagccattcgaggagtatcactacgaagtgatatggcatggatgatgttcaatttcaggcaggaccctgtggagaaatggagatacactcaacattcatcaggatatactgaggacttaatgaattggtattaggaaatgatcggattggattatagagaaacataactttttaatcaaatgaacaagaatgatatgggcggttaaaattataagtataaatgatttgaagacctctcataatttgcaaaataggagcaggctttcttggaatacaggtaaaaggacggtggagaaactatgggcggagacagggttatggtatagacagcgacagagataatgagggtggagagcggtgtaataacatggggcgttgtcttcgcttcttgtgattatataatattattattagacnta

SEQ ID NO: 667288 - DNA, 194 bp, Homo sapiens
gctggacacgagtatcaaatacccatcaccacgatttatgtgcttaacaaaatgtggtatctatactatagaatatcattcagccattaaaaggccaaaagtactacggctacaatactatcacatgcttcacactcggaaccctcatgtcaaggctgcgcgccggtcaccacaatcagcaccactattgtact

SEQ ID NO: 667289 - DNA, 1349 bp, Homo sapiens
gcaagaaccaacagagcatcccagcacttgggaggctgaggcaggagaatcacttgaacccgagaggtggaggttgcagtgaaccaagatcgcaccattgcaaccccacctgggcaacaagagggaaaccctgtctaaaaaaaaaaaaaaaaaaaaggggatttattatggtgctcacgtgcgtggcttcaggccccaaccttctgtggccttttaagtttacctagaacttgagttctggcatccagaagcttaacaatcattctttcagaatcacccacaccggagtggaatctctagctatttatatcagctaagaaaaactcggggctaataacgaaaaagcagttagggccgtggggcttagcactgagtttcagatccagcttttcaggaggacagtgtggaaagagttgcagagccttcttgccttaggcccgtgggccccacgaaagcgaggacgaggcagaagcccaagggttacgtgctgggcaatctcgtggtcctttccctttcgagggaaacccctttaccttattgtgccttcaaccaagaactggggttacacaattaaagaatcaagttctcccggggaaaaacccaaaaaaatagaacaacatacacaataaacataatacagaagacaatataaccataagaccaataataaaaaagaaagatacaacaacacaacagaggcggggggggcgcggccgcctactataaagaaatatttctccctccagaagagaggaggcgcccccatattattatctggtggcgtcccacgaagcgtttttgtttttgatacaaaaaggggggggggcggccaccactataagggatgggagaccagtactattattaaatgaagagagaacgaaaagatgtgaacgggggccgagagcgagttatattaaaaagacacgaagggtgtttgagtgatagggggaggaaaaaaaagctgctgattgattgtgggatggtgacaatatattggatgaagagaaagaaggaacacttaaaataagtggcggaaggaggggagagaaagaacgaacaaatattgtgtgtgggcgagagacacacactctccattccatgagcaaagaagataatattttgagcaggagccctgcaagagagaagaacaattaactaaaagaaaacggtcttaacaggagttaagtataagaaatcggtcggtgataaaaaaaacaacacagcgagcccatataataaatagtatggtggagtgaagtaagaaaagaaaaaaagtatagttgttgtataaaaagcaaagcaacactagtgattgagtagagagcaaaacatatatttttacaacg

SEQ ID NO: 667290 - DNA, 82 bp, Homo sapiens
  misc_feature (52)..(52): n is a, c, g, or t
  misc_feature (66)..(66): n is a, c, g, or t
ccagacaaggcgagggcagggagaggccacgggcacacagccggcgcccagncacccggcccaganggagggcggccgggcc

SEQ ID NO: 667291 - DNA, 109 bp, Homo sapiens
  misc_feature (29)..(29): n is a, c, g, or t
  misc_feature (54)..(54): n is a, c, g, or t
  misc_feature (74)..(74): n is a, c, g, or t
agttgggggctaggggaggggggagccanatgccaggatgcctgagccccctgntttcccaaagggagggtggnagagacagtgggcactaagggtggagagttggggg

SEQ ID NO: 667292 - DNA, 404 bp, Homo sapiens
tctcttgaacgctgcctgctgagtagctgggactacagttgcgcaccaccacgcctggctatttttttgtgttttagtagagacagggtttcactctgttgcccaggctggtctcgaactcctgagctcgggcaatctgctgtcaggcacccaaagtgttgggattacaggtatgagccactgtgcctgcccagaattatttttatggtcagaagcattccaaacatttcccccctactaaaatagcttttaaatgatcaaatgcacatgttcatgtggccaaatgatcttgtttttctcagtataacagtaaaaggaaacgtaactgtgcttagctgtggcatggaattgtgatattaccaggtcaaattcaggaaaaccatatttcctctttggattccaaa

SEQ ID NO: 667293 - DNA, 542 bp, Homo sapiens
ctggcccccccttctatcatgcacacgagttgtcatgcacacacgaattcttattttcgttttgcctgaaagtttaagctttaaatactggcaatgttatgtacagatctacacgtgacaacaaagatgacaacgagagccgactacaaggaacagaaaaagaaaaacaaaataacagtcttaagaaaattacaaagcagctagaaagtattctggcagtgtgtacaaattaattgctatttttgtacaaaattgctaaataatgaaaatgtgagtagactacatatcaacttaaataaaacgattgctatgcacaactctgtacatataaacacactcctaacactgtttgacagctcatgtgttgccctttatacattttattttctaaggctcacgcagtcataatttgcacacttgtaacttttagccatttcgtgtgtgagctttaatagcagcaactcaatggtaccaggaaacctgcatacttagtacttaaagtaacgcaaatactgtagtactaacccactttgtgtgccgga

SEQ ID NO: 667294 - DNA, 464 bp, Homo sapiens
tttttaacaaaaggggcacttatttttttatggataagttttttgaccagtttgtaaatttaacgtggtggagtttatacacggtcgaatttgcacatctggggttttacactaagagggtaattgtagagtttatactaatagggaaaacagtcatgtgaaagaacgagtctttataaggataactctatgttgatgagaatgactagctttttacttttgccgttaactatgagattcatatcggatgtcttcacatttacttacgtgggagatggtagttaatacgcttgagattacagtcgctagcttgtcgcatagaggtcgaggttcttgagcctaacgcgggcactgcgcgagttagttcgtctgtcgttttccgaagggatgggtatatttgcatgatatgtgaatctgtcagcaagcatgttttctagaacgaatatgggatggagtgcccaaac

SEQ ID NO: 667295 - DNA, 1574 bp, Homo sapiens
  misc_feature (1317)..(1317): n is a, c, g, or t
gggcggcgcgttgtacgggcgcatgacccctaggcccactgtctggctaccaggtcccgacatccggcgtcggccaccgtactccatctctggccctgcgacaattaggatgtccggtaaggtgcagggctaaagctggcttcccggtgagcggccggcgcgggtccatgcgtcgcggagtcacgtcgagggggccggcgccccgaggctgcgtcggagccggcacttggctagcagatagctgcgcatctcacggggtgagtcttcggaggcttagcgcagggccgcagtcgctgggtgcgccaatgctcattaggaggcactaacggacctgcgacgggccgagcctctacgctcaggcttggctcagcagacctctcgcgcacaccgcctacgcgcaaggtccagcatcctcatgccggcactagaggaccctccgagaggaccacgtcaaaaacattctgtgctttggcgcgaccttggcaagattatttccggatcattaatccaactcctacgaaaggcaaagtgctcttacagaccgaaatcgcgaccgggcacaagacggccggtgttatcgaaccggatacggattgagagatttatcacttgtgctcctttgagacactcatcatttttgagctagataccattgtgcgagaccccaaaggccatcgatgctagatacccattaagccaaaaaacagagccgcaaggaaactgcgttgtaaacaggcaacttggaacctaaaacaaagcaaattagaacggggcaaaaccacggcctttggggaagactcgccaagggggtcgagggacgcattttgtgacgcccgaataaagcaagaacctggtggcacaacaggaccgcatttaaaccccaagtctgggcgtcttacaatttcacattgggacgacgcgaaccacagtaaaaccgagaaaggaaagagattcccacagttggtgggtaacaaaaaaagacgaagcacccaaaagtgaattggggggcgattgggcgacttaaattttccaaacgaagtgtgggaaaacagtttcacacatgggacaagtttggaccgaatttatccaaagaggtataattatatccccaagaaaagattcacttggggaaagcaaagtgacaaattcctagagcggaaaaacgttttatattttataaccaaggaggaacagagattaacttcaccaatggacgcttggacatcacccggcctaagagcaacaggcaactgggagccgacttccactatttatccccacgagtttacacactatgaattccacccagacaagtcntaatacgctattcctccaccattatttaggcgtaacacagaccataacatttccgcgatctatcgacaattcgcctggacgtggagtaacagaaagatgtgacaccacagccatggatcgtaataagaagctcccacaaggcgggacgaccgttaaaaggcaagagaacgccccttatataatagacttcataattacatggtggcacaaaaactttgtcgaaggacagcttcaacgaaagcaacaacgaaactatt

SEQ ID NO: 667296 - DNA, 224 bp, Homo sapiens
cctagaagtctggagctacatgtccttgcgtgagctctgtgaactacaaccaacagtcttcactgctactaggcctcagctactttgctaagaccatagtcaatggccgtgtacgcctatatgacaagaccaggccctgtactagtcatattcacgtatcatttaataagtcgaccacgatactataagacaggtactactattatgcccacagaatccttacc

SEQ ID NO: 667297 - DNA, 187 bp, Homo sapiens
gggcaagatcccggtcatgcaacttcactcctggcttccagaaattctctctgcctcagcctcctgagtggataggagtgcgggcacccaccaccctgcccagctaatttttgtagtattagtagaggcagggttttgccatgttgaccaggctgtctcaaactcctgacttcaggtgatctgctca

SEQ ID NO: 667298 - DNA, 308 bp, Homo sapiens
tcgcgctgtgtacgctaccacgtggttggctgtcggcggctgcggagcgagtactgctggagcggtggtcgccatggacgtctcaggcacccactgcgcttcagtgagagggagggctgatatacctcaatgacttcgcgcgcgtggtgatcagcgaccatgaggccgtgaacggcatcctggacttcattgaccgtgtcctgctgccccccgaggcgctgcacttgggagcctgatgatgctcccatcccgaggagaaatgtcaccgccgccgccccgggcttcggttaccaagatcttcagcgggc

SEQ ID NO: 667299 - DNA, 1065 bp, Homo sapiens
  misc_feature (165)..(165): n is a, c, g, or t
  misc_feature (202)..(202): n is a, c, g, or t
  misc_feature (223)..(223): n is a, c, g, or t
  misc_feature (286)..(286): n is a, c, g, or t
  misc_feature (294)..(295): n is a, c, g, or t
  misc_feature (313)..(313): n is a, c, g, or t
  misc_feature (331)..(331): n is a, c, g, or t
aatgctctaccacttagtaagactatctttatctcatagttgctcaggaggtggcgttctctgcatataatacgggacatgttgaactagctctttgagatacagctagaaaataaaaacagatggtaaagccacattcgcgtatgatgccagcctcacgcattngtatatctccagaaattcaggtatgcctcaccaattngcccgtctttaataaaatctngtgtaaaattgcatcacgtcgccttcctatgtatgacgaaacaagaaacagagatttccaatngctctttnntcttcagacatttagtantataaagtacctattttnatgctgaaatgtttatacaggtttattaatagcaggtgcaactaactggcggatgcctgtgagaacatttgatatattagccatgcttccggggtaaggcaagcccaaatccttatctttgtgcagtctctctgggatcagtaagagagaagaaaaattaatgggtgttaagagtgtgggaactgtaaatctgttctattttaagtttttgtatagcccatgtacctacctgtggtttagaaagaatcatttcgaaaactttcgaatggaaggggggtacacggaggccatgaaaggtttttgggaattatcattaaatgaggaatcccaaataattcacctacagattttagccaaaaaatagacatgtgtacaacgtgtacacctttacgataagtattctatgcggaggaaggtactctgatctcagtaacaagtttttgccttttaaatcattaatgggtagataagagcctattatctggaggcgaattaagtcctatgtggtaggatcggtctacaaagggttttctggagaaaatactgcttttttacacactgagatggcgtaataaacaggggaggtctgggacaaaattttggcggaatctcaggggggggggacaaagtggtacaaggggattataaattcagcggggaaaaaaaaaaggggggcggaaatagggagaggagtttgatggtgtagttagtagtatgtaggtaaggggaggggt

SEQ ID NO: 667300 - DNA, 196 bp, Homo sapiens
gcagtcaatacgcaccgtccgatgaatcagttgtccagtcttgtaactctacatcaaaatagccattcacagtccttccagaggccccctactaagaaaaataacagtcaagaggaacactgtattacttcatttccaatttactagctcttccagtgtcacagagggatactggttttcaaaatattctcatctg

SEQ ID NO: 667301 - DNA, 216 bp, Homo sapiens
ggtagtgaacatatatatataaggaaaccatcttgagcctgtgtctagacacaggctcaagatagctatcctagcattttctcctcttggccttaaaagttccctgtatagtgagacgggaagtcctgagaagtgtgtgttgagtggctgtgcgcacgcacacaagaagggagtcaacctgtggctacctgacccaagataatgacccattagaac

SEQ ID NO: 667302 - DNA, 428 bp, Homo sapiens
tccactgtcatcatgactggcttctgcttgtcatccacacaacaccaggacttacgcacaaatgggactgatgtcatcttgagctcttcatttcatctcgactgtgcatctatctggagtggaggcatcagtattcaagcaccaacatgtcatgtcaggttgtctacagggtcacatgcctctaaactcatcgagacgagaatgcctttgtagtttacatgcatatttccacactacaattgatcctgtcagagttcctggcagaagctcagagcctgcattgtcaggctcactcactcatccaattaacttctacagtggcagcactcacttctgggcactggaatataaaaaagaatcaaaggttctgatttagagttgccatacagggaaagaccatgctcatagccgtgcccacatctgacgtg

SEQ ID NO: 667303 - DNA, 892 bp, Homo sapiens
  misc_feature (28)..(28): n is a, c, g, or t
  misc_feature (33)..(33): n is a, c, g, or t
  misc_feature (35)..(35): n is a, c, g, or t
  misc_feature (41)..(41): n is a, c, g, or t
  misc_feature (43)..(43): n is a, c, g, or t
  misc_feature (45)..(45): n is a, c, g, or t
  misc_feature (47)..(47): n is a, c, g, or t
  misc_feature (55)..(55): n is a, c, g, or t
  misc_feature (57)..(57): n is a, c, g, or t
  misc_feature (59)..(59): n is a, c, g, or t
  misc_feature (69)..(69): n is a, c, g, or t
  misc_feature (71)..(71): n is a, c, g, or t
  misc_feature (78)..(78): n is a, c, g, or t
  misc_feature (92)..(92): n is a, c, g, or t
  misc_feature (96)..(96): n is a, c, g, or t
  misc_feature (98)..(98): n is a, c, g, or t
  misc_feature (100)..(100): n is a, c, g, or t
  misc_feature (122)..(122): n is a, c, g, or t
  misc_feature (139)..(139): n is a, c, g, or t
  misc_feature (145)..(145): n is a, c, g, or t
  misc_feature (159)..(159): n is a, c, g, or t
  misc_feature (259)..(259): n is a, c, g, or t
  misc_feature (294)..(294): n is a, c, g, or t
  misc_feature (298)..(298): n is a, c, g, or t
  misc_feature (348)..(348): n is a, c, g, or t
  misc_feature (365)..(365): n is a, c, g, or t
  misc_feature (422)..(422): n is a, c, g, or t
  misc_feature (511)..(511): n is a, c, g, or t
  misc_feature (517)..(518): n is a, c, g, or t
  misc_feature (525)..(525): n is a, c, g, or t
  misc_feature (541)..(541): n is a, c, g, or t
  misc_feature (568)..(569): n is a, c, g, or t
  misc_feature (623)..(623): n is a, c, g, or t
  misc_feature (633)..(633): n is a, c, g, or t
  misc_feature (636)..(636): n is a, c, g, or t
  misc_feature (646)..(646): n is a, c, g, or t
  misc_feature (683)..(683): n is a, c, g, or t
  misc_feature (687)..(687): n is a, c, g, or t
  misc_feature (742)..(742): n is a, c, g, or t
  misc_feature (788)..(788): n is a, c, g, or t
  misc_feature (790)..(790): n is a, c, g, or t
  misc_feature (814)..(814): n is a, c, g, or t
  misc_feature (886)..(886): n is a, c, g, or t
cgtcaaaggaataaacaaaaaaaaaggnaggantngcccananananaagtaganananagacagacananggacaanaaaacaaccaagtnggtnanangcccaggccaggctcagcagcngtgtccaggcatcagcnccagcnctgccctggggaantggtggaggagaagggctggccggggcctcagtccttacagggctccttctcctcatgccctactatccctcatccagcctgctgggatccttggcaggnggaattcccagggctatggatggctgggctgagtnagcngaggatcgaggctcttggagactccctggggaggtggaggcctgggtggngtggggtagcagcagcnctggggggaatctggtcaagttccaggatggggccactgctcagcagggcccctgtntccagggcaggccctccacctgcccaccacaccaacatggtgcaataaataaagtttcaagtagtaagttagttttaagcaggagagcngcaggnnggcaganaggcagggactgaganagagaagcctccagccacccaccatanntgctcagtgggctcaagcggtcgcaagtttgttttgtgcactggagttggtgtntggccctgangtncacatgagcnctccccgcaggttcagcccctcacaccagcgccagancctnctcggtggggcagaagcagggcaacacggtgcccacagcgtccacgatggctgcnaggggctcgtcctgcgccttatgcccacagagctgcatgaagtttncnagatgcagcaagttttcaaggttnttgccggagaagccccggcagggcaggatctgcgttgcaatggcttttcaggcgcagggcccaggtaaacanggtact

SEQ ID NO: 667304 - DNA, 356 bp, Homo sapiens
tggatctgagatctgaggctcataccatatgaccttctgtatccgccttcttcatgcatctgcttgtatctccgagaaaaattgcaataaattcctttcaaaaactttacaaaagcaatagatgctcataaaaaatagttcaaatgatatggaagacagaaagtgagtgtgtttctttagtgtttggatgaatgtgtctatggggtagtcactaataacactgggtgtatttccttccagatcttttccagtgtacctacaaatatatatgtacactttgtaaaaaacaaaatagtactgataaacattgagtccccctacccccactcagcagtctacatggatatcctttcatg

SEQ ID NO: 667305 - DNA, 651 bp, Homo sapiens
  misc_feature (28)..(28): n is a, c, g, or t
  misc_feature (33)..(33): n is a, c, g, or t
  misc_feature (35)..(35): n is a, c, g, or t
  misc_feature (41)..(41): n is a, c, g, or t
  misc_feature (43)..(43): n is a, c, g, or t
  misc_feature (45)..(45): n is a, c, g, or t
  misc_feature (47)..(47): n is a, c, g, or t
  misc_feature (55)..(55): n is a, c, g, or t
  misc_feature (57)..(57): n is a, c, g, or t
  misc_feature (59)..(59): n is a, c, g, or t
  misc_feature (69)..(69): n is a, c, g, or t
  misc_feature (71)..(71): n is a, c, g, or t
  misc_feature (78)..(78): n is a, c, g, or t
  misc_feature (92)..(92): n is a, c, g, or t
  misc_feature (96)..(96): n is a, c, g, or t
  misc_feature (98)..(98): n is a, c, g, or t
  misc_feature (100)..(100): n is a, c, g, or t
  misc_feature (122)..(122): n is a, c, g, or t
  misc_feature (139)..(139): n is a, c, g, or t
  misc_feature (145)..(145): n is a, c, g, or t
  misc_feature (159)..(159): n is a, c, g, or t
  misc_feature (259)..(259): n is a, c, g, or t
  misc_feature (294)..(294): n is a, c, g, or t
  misc_feature (298)..(298): n is a, c, g, or t
  misc_feature (332)..(332): n is a, c, g, or t
  misc_feature (340)..(341): n is a, c, g, or t
  misc_feature (361)..(361): n is a, c, g, or t
  misc_feature (364)..(364): n is a, c, g, or t
  misc_feature (367)..(367): n is a, c, g, or t
  misc_feature (375)..(375): n is a, c, g, or t
  misc_feature (380)..(380): n is a, c, g, or t
  misc_feature (382)..(382): n is a, c, g, or t
  misc_feature (401)..(401): n is a, c, g, or t
  misc_feature (403)..(403): n is a, c, g, or t
  misc_feature (413)..(413): n is a, c, g, or t
  misc_feature (419)..(419): n is a, c, g, or t
  misc_feature (432)..(433): n is a, c, g, or t
  misc_feature (439)..(440): n is a, c, g, or t
  misc_feature (444)..(445): n is a, c, g, or t
  misc_feature (448)..(448): n is a, c, g, or t
  misc_feature (450)..(450): n is a, c, g, or t
  misc_feature (453)..(453): n is a, c, g, or t
  misc_feature (455)..(455): n is a, c, g, or t
  misc_feature (463)..(463): n is a, c, g, or t
  misc_feature (465)..(465): n is a, c, g, or t
  misc_feature (468)..(468): n is a, c, g, or t
  misc_feature (531)..(531): n is a, c, g, or t
  misc_feature (546)..(546): n is a, c, g, or t
  misc_feature (582)..(582): n is a, c, g, or t
  misc_feature (642)..(642): n is a, c, g, or t
cgtcaaaggaataaacaaaaaaaaaggnaggantngcccananananaagtaganananagacagacananggacaanaaaacaaccaagtnggtnanangcccaggccaggctcagcagcngtgtccaggcatcagcnccagcnctgccctggggaantggtggaggagaagggctggccggggcctcagtccttacagggctccttctcctcatgccctactatccctcatccagcctgctgggatccttggcaggnggaattcccagggctatggatggctgggctgagtnagcngaggatcgaggctcttggagactccctgggaaantaaaaagnntaaataatataagggtaaanaanagnactagggnaaatntngtaaaataccaaaataggncnactacacaanaagacncctatatccaagnnaagaannccanntananaananaccaacanantgnaataaataaaatatcaaatataaataaatataaaacagaaaaacatcaaactgtgcaaatagncaaaaactaaaaaanaaaaacctccaaccacccaccataactacacaatangctcaatctatctcaaatatttataatacacataaaaataaatatataacccataaagtncacatgagc

SEQ ID NO: 667306 - DNA, 918 bp, Homo sapiens
gacgaatgtttgggcgcgaattactctaagcgcggctctcagaagggtgcaagaagaatcagtgattttttttttttctcgaagcccctggtgtgtttagactccagatgttcttgggtaaagccaatgtgttcccaggaaaaacggctccaccgttaaaaagaaatcccaaggagaaacagagggtatatgacaggaacggtttgtgtgtttgctctcgagcacaataacggcgttagaaaccccgctgtgaacacaccacttttacaatctctcttgaaacgacatcttggcttcctgaagggccacaccaaggcccaacctaaccttataaacccggggaaaagacacgtagaggcgaggcagagaggaaaaacacccggtggggaacctccttgttgtccacagcgagttatcccacaaaaaccccacattttgcgcgaaacctatatgtagtggggaaatcccggtgacaatactatggcccaactttgcgcggacgtataccggcttttaccagcgacacccgctgacacgcagaaattctcacagtaaccgccacgttctctacaactcttccgctgtgagaaagcaccaccggatattgtgtgccaacacacagtgtttgtgaaaccttcttgttaaaaggtccccctctcccagataaaggcattgtggacagaatttttacacccaaacagggttctccacgggttctaccctgagaactctccgcgcacacagggggggcccgataaaacaaaaggctactccttgtagcaccacaaggggtcctggggcaattttccctcaccggggcacgacacctcttctccgtacaccgtgcggtgagaagacaccccccacgaaagggttacgttcacctggtgggaacatcttttctcaaagccccctaaa

SEQ ID NO: 667307 - DNA, 115 bp, Homo sapiens
gaagggcagcaatacgagtactacctcctcagctgccatagcactcacagcctgtgccatccaggaacctccacctttgaacacagagccaggctgggccctatttatgggctcc

SEQ ID NO: 667308 - DNA, 455 bp, Homo sapiens
  misc_feature (10)..(10): n is a, c, g, or t
  misc_feature (29)..(29): n is a, c, g, or t
  misc_feature (40)..(40): n is a, c, g, or t
  misc_feature (227)..(227): n is a, c, g, or t
  misc_feature (270)..(270): n is a, c, g, or t
  misc_feature (359)..(359): n is a, c, g, or t
ggcccaaggnaaaatccaagtccctgaanacttaattggngggatccaaggcgctgaaacaaaggtgccccaggcaaacataatgaaaggtgaacatgcaagttccctacgtgctaaggagcaaactggcccaggatggagaaggaccttgggttaaggctgtgtgctgtcctgctgagccctagaagaagcaagaaccagaaagaacgtgtccgggatccatcctncgccagggctaggccgtgtgctcagacttagtgaggttgtganagtcacgggtggcgcccgcacccctgagcacctgacgtggcccaggttgatgcccagcagtggtggtggtgtctgtgctgtcatcctgnccccttgccttccaaatttccttgctgccttgaagtgtcccctctgtcagcatctgccctctgctgtctgtcccttgccgcccccacctttaaaaa

SEQ ID NO: 667309 - DNA, 125 bp, Homo sapiens
caggatctttgcctgttgtccgtaagatctcactttcaattctcccgctcgtttctgtttgcgtctatatgcacaaccccgggacagccatttaggtaacagccatttaggtaacagccatttag

SEQ ID NO: 667310 - DNA, 726 bp, Homo sapiens
cattcccgctctccgcggaactgctctgacgtctcggcggtgaaagtgtgagagggtccgtagttgggtcaactttgactcctctcgcctgcccggatccttaagggcctcctcgtcctccctgtgtctcctgtgtctgctgcctgggtctggtgctgcctgtgtcctgcgccctgcccttcgctctgccaatgggctgcttccagactcctcacgcgctgtgccctgcctctggctcccatgccctgtgacctgggcccaaggtggctcggggtcgccgctgctaggacttggcctgcgttggcctggggacttgtctgcctgtgctgcctgcgcatgtgccatgtgtggcagcctggcggctgcatgcagggtgtgggcaccgtgtgcgaagctctgtgatctacccggttgaaatcctgcaaaggtgtgtgcctggtgatgcgatggcttgagtgcacggccatggggctgcagcagcggaaacctgcgggacaggtttggctggtgattaaggaagatggacacatgggtcactgacccgacaggagcctcgcctcgtgctcatctccatcatttatgagaataactgcttgatcttcagggctccagacaatggaccagctggtattgcctagcagcagcttcctcaaacaaatccaaaaatgcaggatatttggcttgacattaaggcagagactgtggcaatgaggcagtaagtggtca

SEQ ID NO: 667311 - DNA, 566 bp, Homo sapiens
  misc_feature (54)..(54): n is a, c, g, or t
  misc_feature (108)..(108): n is a, c, g, or t
  misc_feature (171)..(171): n is a, c, g, or t
aaccttaccccttaggtatttaagggcccatggccattattatatccaccgttngtccttgacctgatttcctggcaccataggggatggattggaaaagagggaagnaattatggccagggaaatgaatttaaagtagttgtggtagtttagatgaaaagatgatgagancctgaaagtatatctatggccagtgagggttgagagaaagtagatggaattgagagcttgtataatagtaaaatcaaaaggatttggtgaaccatggagtgaggaagagatagtgttataaatgacttccaaactttaggaaaccagatgccgccatgataagattaaaaagaaaaatacaggaagaggaacaggtttcagtaagccaagaatagattctgtttcatatactttaagattattgtgtttaggaaacagccaggtggagatatccagcatgtgattggaatatgactctggggcagaagagagatttgggctagaaatttaaaaaaaaaaatgtgagtcatcaatactaagaaggttcttcaagctgtaggcataagtgatggtag

SEQ ID NO: 667312 - DNA, 468 bp, Homo sapiens
  misc_feature (192)..(192): n is a, c, g, or t
  misc_feature (267)..(267): n is a, c, g, or t
  misc_feature (315)..(315): n is a, c, g, or t
  misc_feature (402)..(403): n is a, c, g, or t
  misc_feature (462)..(462): n is a, c, g, or t
tcttgagtatcccctgcagtcctctctgatgtcacgcatctgatttcccgctcggccgtggtggtgaagctgttgccgcgctcggtgaggatcttcatgaggtagtcacgtcaggtcccggccatgtccaggtccagacgcaggcctggcatgtggggagggcatacccctctgtagatgggcacagtgtgnggtgacccctgtcaccggtagtccatcacgaatgccagatggtacggaccagaggcgtacagggtatagcacaangcctggatagcaacagtacatgtgctgcgggtgttgagaggtctcagnaacgatgatctgggtcatctgtctcgccggtttggcccttcggggttccagggcgggcctccggtccagcagctacgggtgtgctcnnctcgggagccgacacgcacgctcacttgtacgaacggtgttggtggccagattttctcncatgtc

SEQ ID NO: 667313 - DNA, 171 bp, Homo sapiens
ggcacgagaatccactgtccacagcatcttcctttaaaccaatagtcccagaaggagaccctctgtaaattctaggactggatattaaaatggccggaacctgttatctaaatcccttttaaggaacctaatggtccagctcttggactcacatgtgggacagaatttgtg

SEQ ID NO: 667314 - DNA, 153 bp, Homo sapiens
ccctttttttggggggggggaggggggaaaccccttaaaacccccccaatttttgggggtgggggggggggggcccccccctttttaaggggggggttttccccggtttttggggtttttttttttgggaaaaagggttttttttttccccca

SEQ ID NO: 667315 - DNA, 676 bp, Homo sapiens
ggcgcaactccgctccgcactgtgcgccagcatcccggggcacggagggcgctgcggccgcccggagaccccccacccaggctggatccgggccctggggcccaggagcgggtgggtgtgagtgtgggtgggtgtgagcgagtcagggcgtgggcctgggagcgtccgcgggactgtgcgactgtcgctgccctgccttccccgcccccgtctcccttccgcaccttctccacccccagtttgtcacactccttagacgagggactgggcgacctagaacgaggttcccatatcgtgttcccacaaaagcaaaacttagtctctgttttgctatgcggtattcattgtttgtacgctttaaacgagtaacgagcagccgcacccggcatccctacctgctaatcacgactttcacgattccccatctggcctcagtgctcattccggggaagacaccctgctgagatgtctttttccccctcccccaagcaaaccactcaggtcctacctgcctctttcccggcttgatgcgggcgtgtttacctgtatgtatttctctcgtgcggccaccaaaaaagcatcagctggggttcccgaaggtcagaaaatggctatcgattaatctactagaatagttgccgggagacataaaaacgacgtaaaatagcagggaacc

SEQ ID NO: 667316 - DNA, 957 bp, Homo sapiens
cggtgacgcgctggggcaatgcttctggatcggagaccttgcatcctggttgtgaagcctttgaccttcttttagcaaagagaaaaggtaggctgcttctaccttcaaacagtcaagagcaagttctgtggagttcaccttgctgctgacccagaagtgtggctgcaggggccaagtctaagggtggtgcagaaagggtaaacagtgacttgctgtgaaaaagaagtcatcttcagtcatccctggggagcattccctgtgcccctctctcaacttgagtgcttatcagcttcatgcaggacaagattttagttgccatcttggattaacatttcaatctcgttatagagaagcatacaagctagcgagtcctgagcaactgagtatgacattgtgctgaatacggctagacacgaacacgcgtttcgtaaaacgtagtcctggtttctttgtttctttctacacgggtgtgtctgtacgaaatattcttcagttacagcagtgactatatgcggtatgtcaggaagacacaaggtagtctgtagaactggggaagtgatgaccatactttttagttagagcacctaagtttccatgactggttctaaatctggccagatatttgctaagtaccaaatgacgaggagttcatgggcaatttgtgagtggtcttgagtccccaagttaccagtgcgaaggggtacaaggccgtcatgggtcagtggcggagctttcacatatgagtatgttgatatttcccgtttgagtgcttcgaagaaagcctatgggggcatctgttgcgtcactgtaattctccaatttgacttgggaagcctgagaacttactgaattaggatggaaacggctttgaacctgaagaatgacgaggaaagatgtagtaatatttggaaggcgaggtatggggtgaatagcaataaccaatttaaacaaaaagaa

SEQ ID NO: 667317 - DNA, 398 bp, Homo sapiens
ggatcgttagaggtcaggggttcaagaccatcctggccaacatggtgacatcccatctctactaaaaatacaataagttagctgggtttggtgttgggtgcctgtaatctcagcctcctgagtagctgggataacaggcatgcctggctaatttttgtattgttagtataaatgaggtttcgctatattggtctggttggtctcgaacaactgacctcaagtgatccacccatctcagcctcccaaagtaatgggattacaggcatgagctaccacacctggccttcgtttttcttttgacacagggttttgctctgtcacccaggctggagtgcagtgagctatgaccacaccactgcaccccagtctccgtgacagcacaagaccccaactccaaa

SEQ ID NO: 667318 - DNA, 269 bp, Homo sapiens
aggaagtagctattagcatgatgcgttatcatcaggagactagatttaagcagcgggtgagcaaataccagataaatgtaaaataaggatagatctagtgcccaattattaatagaacaggcttaaatttaatacaaatgtactaaacactccaatttagagacatagggacattagaataaactgtagggcagagaagaccaactatatgctgtttacaagagacatgctttacaaaagaacacagatcagaagttaacagaaactct

SEQ ID NO: 667319 - DNA, 971 bp, Homo sapiens
ggcgtgctcgacgcacgcgtatcttcgttcagtcattatcctccatcagtctatcgcactgtcgtcgcgtcgacacattgtcgagtcctacgggctcgctagcatgcgcagtaacagggaggaggcctagtcgtgggtaagacttgtgcagcatttcggcacgtcgcttctgttgcataggatcactattacagaagcaagatctcagtgaaggaagtctgtgcggactgttggatccgaacggtgcagagcgctctggctgaaagcggagtcacccaaggcttttacgcgcagcataaatcgactagaagctcactgtgccggtcactggtgctagaacccgggtcgcgcttgcgaactccgcagagcatgtcccctgggatgggtgggagaactggtaacctgaccactgggggcaggggcctgtcaattgttaaaactgttgcctactgcgtcgccaggcacggcagttccggtccagaggaccccgtcccaagaaaagcattcaaagacgcgtctcggtgggtgtacggaacagatggtctgacacgagacaattcctggacctacatctgcaagtgcgcggccggatccctggttactaggggctcttgcgccttggtgcgcctacaagccctttggaacaacagcagattgggatccaatgggtaatcaatcccgatgattcccgatcatttgcctggaaaaggtgccgttagcaaaccttttaaatctcgcggcacatggctgaaaggcagaaccaaaggccctgggagagggaataccgggggagaccttcggcaccggtgagaagtcggggcaagaggttctacccgtctaacggaggaggaataatccaagggccttgggcaatttcgcagtcttcgacagatcgggtgtacataggtaggggcgtttggccccaaccggaacgtgaagggatgccttgggaaattcgctgggatggttcc

SEQ ID NO: 667320 - DNA, 1993 bp, Homo sapiens
cctggactggccctgccaccccacccccgtggagcctgatgagctgggcccggtgagatgtcctgatggtgccctggtggtgtgtgtcttggatgagctgctgtgcccctgtgtgcccagcgaggctgcccccgtccaggtggcgccgttctgccgcagctcggagatgcgtggcgcctcgtgtgtgatgctggggacagtgtgctgcttcggtggcggactcacgcgggtcgctggcaatgccgcgcagttacatgcgctactactacagcgtgagacagatttgggatccactatagactagcttataagaatgagaccatacgcattacacagtgcaacacggcactgacataccacgaacgacaaaaaccctgaggtgtggtctcagggaataggtgaacgagaagtagcgacgaggccttaggggagagacccaacatagcgctgggaaacccgacggaatcccgttgacagatacaaggtgagaaatatccagcaatcacaatagaaccatacagtggaagggcccagaaaaccgtagaatataccccgatgacattacaaagttgagaaaccaactatggcttcacatcgacaaccactcggggagctcgagaacctgcaggccacagcagaccccgtcggcggcgacccaaaacagggcaacccaaagaacaaaacacagattgagcagagaacagagcagaaccaaaggcaccacagagcggcaaagcacacacccacagacaagacaccaagaccagcacaaatagaagagaaagacaggaaccagtcacccatagagagcaagacacacgaagcgcagacggacaaagacacccgacagccgagacagaggcaagcgaaacacaggagacgacacaacatagaccacagcagaacaccccacacaccccccagggagcgacagacatccgcagcaacaagcagaccaaagacgacgagtatggacgagagccacaaccgacgactaacaccgaaacagggacagcacagacactaaccacgagagagtgcgacacaacacgcgaaaggagccagccggtggcacacgaaacgcagcagaagcaggcagacagacaaagaaagcacgacaccagaagcgcgaccgaatacacaacaacacatatgcggagacaccacccaaccaccaatcggcgaggcacagcgatcagatctgcgcaacattgacaaaaatgcctcttgacgcatatcgaccacgacctgacattccgacgacaggatgatgaggaagagaccagcacacggccacgaccagagacgggacactatacaaagaccgtatgactagcaatcacacaagcagcagatcacataggaatcgaacagagacgaagtgactggatatcaaacacgagcatgaagctacaagctattacactcagttgcaaccaatgagctctgatgctaccatcacaacgggacagaggaacacaaacacaagagagatgatgacacaccatacatgagaaggagcacggcaaagaagaagcaggaccccggccaataagcaagacaccgccgacacacagaacgacccaaccagacgcagaacaaccgaccgaccacgcgacgcagacagatgagacacacacacgagagacgcgacgagagaggcgcactccgaacgacggactcgacgccgggcgagatgaagcagggggaggaggacgagagacgagagggagaacgcgaggaacagcgagaaaccactgacgtagaaagcgaccgaggcgacaaccacgcagacccgctcaggcacgacctgactgaaggacgtcacgagcaccgcgaccacgatcgatagcgagacgcgaaccgccaataactggacacgcagcagacgcaacgtcagccacgacacgacagatgctcctgacgacaggagcgactcccaacaccacagggcacaccagaacacaagcagacacgaacagggacaacgaaa

SEQ ID NO: 667321 - DNA, 381 bp, Homo sapiens
agatatgagctcggtaccgacgctctctctgtggggcactctggcccagatactgcctttcccatggtctttgcaatccgcagaccaggagattcactaaggtgtccatgccaccagggccctgggtttccagctaccaaactgggcagcctgtttgggcagacactgggctagccgcaggagttttttttccatatcccagtgtctggactggaagtgcgatggagccaggaaccttcagcaagccagggtgtgcgagggccaggctgtggggcctgcgagtcgggtcagcgtgggccggtggctgcgtgatggtcagagtggtcctgtttgatctgatgagcctgcagagcagcctgggcccccccacagagagagcgt

SEQ ID NO: 667322 - DNA, 1114 bp, Homo sapiens
ggaaatataaacgagatcctagtgccaagggggcggcaaaccgcctcggggcatgcttcgcccacaccgcgccttagcgccgtgcaagcctctccaaagaactggacccgcgtgcgggaacccgttattgggttctaaagtatgagacgggtgtgttccttagacgactaaccgtgggaaaacctgcctctaatgccgccaggccggggactcttcggcggggcggtataggagacatctctaactggggggcgaactacggcacggcattggaaatagctggcaaggagaacgaattcccgcttgtgtgtgtgccgcgcacaccaatggtaaatctggggagcgtaccgtgtgcttggtctcttgagccgttggttgggacgcctcccccgtttgtacaggggaccccttggtgctagtcaagctccaagagcgaagggaccggtggagtcccacgcttttgagtaccctcggctgtccagcagcggcagatctggccggttggaccaagtcccgtgagtgacagcaggcaccatcagcgagagtgcctaagccaggcgcttcctggggcttcaacaataacgtgggcgccgtcctggtccatggatcaagcaatgaaagagagggcttgctcgcttcgcagcccaagcctggcgctcacctccaggcgcgcatcgatcagtagcgcctccggggctcccgcgggtcagcctcccgtcaaggttctcccctatgttgaggggtttaccggcgccagcccaacagcctgcacggagaccacagcggagctacgcgtctaccgtccacgtcctgccacgcgccgccggccctcgacgcaccgccccgtcgtccgccatcacgtccaccccgtcagggaccaagaagtcacaagaggggccgtgaggcgtccagggcgctaggaagccggggtgggggtgagggtagcccattgagccctgtcccatgcaggctgtgagagcagactaggagcctgggccacgttcacagagactctgggggtgtgtctgggggtggggtgtgagtgcgtatgaaaagtgtgtgtctgctggggcagctgtgccctgaatattaaccaccggaggccgcccagcac

SEQ ID NO: 667323 - DNA, 671 bp, Homo sapiens
acctatcgccatgcccttgttaaggtaagctaaatggtgtgtaaaggcattgccttaagtacgactgtatggataccttgaccaaagctagcctcctctccagtgatacacatctcacatcgctgaatgccatcagcgtccatcatctggactcagtgtccatcagagcatttctgctacatagtcatcagagttcatgcaatcatccaatgttgcaggtgtatgtcatcgactatatccctaatcatacagtcggtgttaactcacatacagtgtcagccttgaatcttgcagcacacgtggagctctcaggatctatagacatgtcgaactatgcgtcttgaggtcgtttccagccacgactatatgtagtctgactgcagcatagcatgataccagcattagcagtctctatcgtagcatctgtccagttagtcttgcagcaagtgctgctatcggtcgtgtagaccctgagactggtatctcacctatgactacgtccatctgctcagtgtacacagatcgctatgtgatggcggccttcatgcagccgcacctgcatctatatattcatgtatcatcggtttatcaagctctgtcagagcccaggagcgctagtaagacactctagtggtgtaatctaggcagcatgtcatctcagctcctgaaat

SEQ ID NO: 667324 - DNA, 272 bp, Homo sapiens
aagttgccatctaccaagctctgtggatattcaccacatagatactgctagcttacaacactgatgcacacagtcaaggtaggaattatatggcctactacagagggtaccagacccagaaagttttaggtgtaaatagtaaactacaaataccctcttggtaaacgttacttcatcaagttaataaaggtcatattatctatcttctgcaggtgacaacttgtagactacagtatagtctggctcaagaaagaactggttcagatatgcgg

SEQ ID NO: 667325 - DNA, 189 bp, Homo sapiens
ttggtttaaaagggccttttggggttttttttgtaaatgttataaaatttttttttgattttggaaatttttattaaaattcttttccttcccttgttccccaaacctggtgttttaaatttgccttttttttggaaatttttttttcaaattaaatttcccttaagccattttttaaaattgggccca

SEQ ID NO: 667326 - DNA, 123 bp, Homo sapiens
ttgtggtggtggcttgaatatatgaaaacacacgcactctctttctttctatggaagaataagagagattgaggtttctagagaaacattatcttagagtcttggtcaggtggtcaggagtat

SEQ ID NO: 667327 - DNA, 1098 bp, Homo sapiens
aagtttctgagcacttgaaatgtggctagtgtgactgagaaactgaatttttaattttgtttgagactgggcacagtggctcacgcctgtaatcctgacactttgggaggtcgaagcaggaggattgcttgaatccaggagtacgagaccaccctgggcaacatggtgaaatcctgcctctaaaaaaaaaacaaagtaacgagcccagcgaggttgtgcatacctgtgatcccagctacttgggaggctgaggcaggagaatcgattaaacccaggaggcagaggttgcagtgagctgagatcacaccattgcactccagcctgggcgacagagtaaggctctgtctccaaaaaaaaaaaaaaaaaaacaaaaaaaaacccgtttggcttttttttccttggccgtgggctcaatccccaattttggcccccaatttatcccaagtctctctataatctcaagctttcatctaagtggcaacctggtattatttttctaaggttggaaaaaaaaaaaaaaaacaaaaaacaagaaaaacgcaacgaacacacagaaggaagcacaagaaccgaacgccgacgagaatgacaaaaggcgcgcgcccagcgcaaggaaacaaagcgagggacggggcgcgcagcagacgaaaggagacgactacgccagcagcaccacgactggccgcagcccacatcgagacatacagacagaccgcgcaaagacgacacatagaagacaagaagacgacgaaagaaggaccctctccagagaggcgaacaccgacatagcaagacgcccaaagaacaagaacaggcgcagacaaacacacgaaccaacaagccacaccgcctgaggacgcaagcacacagccgcggcagagccgcccaccagcatcccgggtgccacgatcacccgcgaacaacagtattacgagcacgacgcgacacacgatacagcgcaacgagagagcaggagggaataggaacatgaggaggggggaccgcgacgcagcgacgcgcggcaggcaggggcggcggaaggcaatacgcgacagcaagccgatgacacgggcacatgcacgcaccacgccggtcatg

SEQ ID NO: 667328 - DNA, 814 bp, Homo sapiens
agcggggtgtccggtgttcgcggaggagtcgaggcacggagaggctacgaggggagggacggaaagaagggtggcccgccaggagggcggggtccatggattcggggtgagggccgtccgcggcctcgctttcgcctccttccgagccagggccggcgataggccgcagctgtgaggcgaggtcgggtcccgtagcggcgcgcagcctccctgggggactcggggtcctgtatatttgtgaagtacatctgtcttcataacatacaccatgtccaaaatctaacagggccaatgtccaaattattccaccagctttgaagggacttgaagcaagaataacaagacagaagaactagaacggacaggtgataggcatgtgcatgactcacgaactctgtgatagccaagcgaacaacctatttgcctaagttcggcatgttaagaaaactaacgggtcactcactctaggaacagataacttggcagctcaatgcagttgctctgtacaagatcacatctaacatgatcttcaacttcgaacatctttcagattgcagatcattctaagacacaagtacaaaagcacagcgagcaagcaaatctctaaaccacgagatcacgaaggcaataatagatacctggacttacaaaaactacacagtgacccaaactagaagaactcagaaacacgaactctgttcttgatcccaaaccgccgccgttgacttaggcacagaagttgggcctcattgggactccaccagctccagtgtcctcagatgactgggagaaggtgaaacgagcgctctgctca

SEQ ID NO: 667329 - DNA, 307 bp, Homo sapiens
tgctgtggagtatttgagtacagcatcaccaccatccatcttcagcaagctcttttcgggattaagtgcttttaatgtgcacgtgttgtgtgttataggtaccaggacggtcactgagtagaataggtatagcatatagcagggtatacggctcttaaaaatgtccatgttttctgtcttaatatagtcttgctttcttctcttaggcaaggcccagggaaggggactcccctctccaagacgagtacctgaattatccaaggtatcacatcatccgacgaataagtatgatgagaagacatatatc

SEQ ID NO: 667330 - DNA, 97 bp, Homo sapiens
  misc_feature (36)..(36): n is a, c, g, or t
  misc_feature (49)..(49): n is a, c, g, or t
ggggggcaggattcggcacgaggacaaaggttagtnctccagtagttanggaaggcaccagtgtcacagtcagacacacaggagtctgtatctgctg

SEQ ID NO: 667331 - DNA, 363 bp, Homo sapiens
ccaccataaaaacagttactgaccacgtactacggtgccagcgtctagtattcagcgcatgggaggtgttatgcgcgacttcctctgattggggcatgtggggacactccgtataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaagtctggttgttgcaccatctgcttgg

SEQ ID NO: 667332 - DNA, 1279 bp, Homo sapiens
  misc_feature (851)..(851): n is a, c, g, or t
  misc_feature (856)..(856): n is a, c, g, or t
  misc_feature (870)..(870): n is a, c, g, or t
  misc_feature (900)..(900): n is a, c, g, or t
gccttgcaagagccggcgccggaggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggatttgggggaacatggcgactcaagtgtggctgtgtggagtggtgtgaatgtggcaggtgtatctctccaggaattgaatccagaaatgggaactgacaatgatagtgaaaattggaaggaagtgcataagatggtggttgaaagtgcctatgaagtcatcaagctaaaaggatataccaantgggntattggattaagtngtggctgatcttattgaatccatgttgaanaatctatccaggatcattcccgtgtcacaccaactggtatacacggggatgctactggcagttgagacactgaagtcttcctcgagaccttccatgtagtccgtcgaagtgcccggggattaacacagcgttatcaaccagaaggtaaaggatgatgaggttgctcagctcaagaaaagtgcagtatatccctgtgggacatccagaaggacctaagaagacctgtgactagtgagctctaggctgtagaaatttaaaaactacaatgtgattaactcgagcctttagttttcaggccactgtacatggatcacagtttgcttggatcttcttcaatactgtgaatttgggctcacagaataacagccaggtgcttggt

SEQ ID NO: 667333 - DNA, 357 bp, Homo sapiens
tggctttccctgtgagcagcgcggagctctctttcaatccggaaggggatgtctgtctcactaatttccatcaagaaatctgttttctgggacaggcacagtggctcacgcttgcaatcgaagcatcctgggaggccgaggtgggcggatcacctgaggtcaggagttcgagaccagcctggccaacattggtgaaaccccgtctccactgaacatacaaaaacttcgccgagcatggtggcgcatgcctgtaaccccagcagcttgggatgggcaagcaggagactcgcttgaacttgggaggcggcggttgcagtgagtcaaaatggcaccatgtgcactccagccggggcaata

SEQ ID NO: 667334 - DNA, 167 bp, Homo sapiens
cctttgaaatttaaaggttttaaatttctgtaaagtagattttgtagaatgtaatgtgttccccgcctttgtgaaacgggaaaaaaatggataatttctgtgtgtaaactgaaagcttgggccttcaaaacagtattcatataaagccataaatattaatgttatga

SEQ ID NO: 667335 - DNA, 666 bp, Homo sapiens
  misc_feature (381)..(381): n is a, c, g, or t
tggttgtgggcttccaaggggctgtcggggctacccccaatattagggccccgcctttttgcccccttgcgggcgcaacgccccttcatccgccccttggtttggtccccccccgggccttggcctgggcaaggttcccccaggggccattcccccgcagcaggtttatgcaaggcagatgcccccctggccagcctctttttggggatcccccgaatcactttttgttcctctcccccccgccagaggggaccacagaggtcattctgtccctgcttttcaatcagttccctgggttcaaggagggccgtttgggccccgggcggcataaccttccctttgtggggttttccaattagggcacggcaggggccgctcccnattcccccgaggggttttagattccccagaacaacccccttaagttttcctttgccaaaaaggaggccctttttcccccaaggcgggccctttccctgttttgggggccccccttttccccttgggtcagcccccttaaggttagtccccccctgggggcctttttggaaccgggtgtgggtggggggttcccccccccccttggtccccaggtttgtcccccccccttgcccccggggctgtttggccgggatttaagtggcttttttgggtttggttttttca

SEQ ID NO: 667336 - DNA, 775 bp, Homo sapiens
gccttgcaagagccggcgccggaggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacaccctaacacattgtggcagcactacacacgcacttacttcctgtgaccgcccaattcctaacgacttgctagctgcgtacacctgcaggcagctcccctccagccacacgcacagggcgcgagacgctccggcctcaaaatcatggctggcagagcaacactgtcaactgctcctctcacacactccactctacttccctcagactcgctcaacgctacagctcctgaatctgccctcatccacttcgctgcgtcttccaaccccacgctggcacacttccctaccgtactgctctacccctgcgaacacctaacgctgcgacttaccccaacaccacccgacgctgcactttggccacctgggcctcctcattcctggcatccctgcctacactcctcgcttaccctctactgggctgacccaaccttgggccttccttcccacgcag

SEQ ID NO: 667337 - DNA, 1827 bp, Homo sapiens
gccttgcaagagccggcgccggaggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggatttgggggaacatggcgactcaagtgtggctgtgtggagtggtgtgaatgtggcaggtgtatctctccaggaattgaatccagaaatgggaactgacaatgataacgtgatacagattggacaggcatgtgcgactatacgatcgcgtggtttgcaatacgtgcctgagtgagatgtccatcaaagtcgtacaaacggatgatcaccatactgggacgtactggggcttaacgtgtgcgtatgagtcttattgaaactccatcgtttgcagaacatattctaatccaaggaatgtcattccctggggtccatagatactgggttgaacatgggggattgtatgtggcgattgcacgaaactgtaagcttcctctcctttgaagcaccttgcgaggatatcccttctaatgggccctgcgtggaattttatatccacggctgatagggttgaaagtcgaaaaagactcagaaggggatgttacagaggatttggctccagaattccatagctaactaggttgaccgatatttaagcgctgctggggggaaacattcccaactatagtgcgactcttcattcacatggaccctgttgggacatcaaagtgaagccttgcttaacgcactgtggtgcacacaatttgtttaccttaaaacttagtcaaactcggtttgaatttagagccgtaccgaagccactgacggagggatttccctcaccttcctcacgtttgttaaccacattggggaatacacccaaggagatttctagcagtcttagaaataccattgcgcccccaagagtattggctcgaacatcttctggcggccttctctcaaggagaaatgccaacaagggaccttatttgggcttcaggggcacaaaatgtcgctttagccaagatccctttgaggtcttcctttctggaagcaccactttgacttcagtgggactttcaacttatgcgtcacgctggtgccaagaggacaaccagcccctgtgggccacaaagggctcggggcagctctcttaacacgataaccacaggccaacagcgggtgtgccaaacctgcactttgaccacgagcaaaaaggcgccggacagagcggacccccttagcagccatgttccacccttggacccgcacaagcactc

SEQ ID NO: 667338 - DNA, 282 bp, Homo sapiens
  misc_feature (207)..(207): n is a, c, g, or t
  misc_feature (223)..(223): n is a, c, g, or t
  misc_feature (241)..(241): n is a, c, g, or t
gtttccatagaaatgtatggaactgtcttgatagtttattaaaaacacccgcacaaaaatcctcatcatttttcgaaccgctttgaccctgctgggtgaactggagcttggggactcagtgacaaaggccgctctagcaccaggcctgggcccacctcagttggagaaggaggcagggaccagaggggcagaactggcagcacacgnttcttcctgatttctngaagcatcccagccaggncctcacaaaattgcccttttgaggaggtgatgccccctttt

SEQ ID NO: 667339 - DNA, 1439 bp, Homo sapiens
  misc_feature (1011)..(1011): n is a, c, g, or t
  misc_feature (1016)..(1016): n is a, c, g, or t
  misc_feature (1030)..(1030): n is a, c, g, or t
  misc_feature (1060)..(1060): n is a, c, g, or t
gccttgcaagagccggcgccggaggagacgcacgcagctgactttgtcttctccgcacgactgttacagaggtctccagagccttctctctcctgccttgggggctccgagtaaggaaggcctagacttgtgcccacagaccttactcggggagatctctagcttctgcatggcctcgagatctagctgtatctttgctgccggttgcccgtgaggaaaagatggtggtgcgcaccgggagcagtacaagctgcatgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggatttgggggaacatggcgactcaagtgtggctgtgtggagtggtgtgaatgtggcaggtgtatctctccaggaattgaatccagaaatgggaactgacaatgatagtgaaaattggaaggaagtgcataagatggtggttgaaagtgcctatgaagtcatcaagctaaaaggatataccaantgggntattggattaagtngtggctgatcttattgaatccatgttgaanaatctatccaggatcattcccgtgtcacaccaactggtatacacggggatgctactggcagttgagacactgaagtcttcctcgagaccttccatgtagtccgtcgaagtgcccggggattaacacagcgttatcaaccagaaggtaaaggatgatgaggttgctcagctcaagaaaagtgcagtatatccctgtgggacatccagaaggacctaagaagacctgtgactagtgagctctaggctgtagaaatttaaaaactacaatgtgattaactcgagcctttagttttcaggccactgtacatggatcacagtttgcttggatcttcttcaatactgtgaatttgggctcacagaataacagccaggtgcttggt

SEQ ID NO: 667340 - DNA, 619 bp, Homo sapiens
  misc_feature (188)..(188): n is a, c, g, or t
  misc_feature (233)..(233): n is a, c, g, or t
  misc_feature (247)..(248): n is a, c, g, or t
  misc_feature (464)..(464): n is a, c, g, or t
  misc_feature (469)..(469): n is a, c, g, or t
  misc_feature (522)..(523): n is a, c, g, or t
  misc_feature (526)..(526): n is a, c, g, or t
  misc_feature (568)..(568): n is a, c, g, or t
  misc_feature (571)..(571): n is a, c, g, or t
agcggctaggggaaatgaaggaagctgaagactgactaccaaaacatgcaatatacttattcactgtctaagtctgtagtataacatgaactggagtctctatccttttctaaaatcgcatttgtaagaaaagaaagaaaaaaaaaaagatgttcccaatcctgattgaagaaccttgtttttatatnctctcttatccacggtgacttttctttaaacggggctcggtgatncaagagtttagaanngtagaaatgaaatgcttagcttaccttttctgggggggtgtggaccctgccagaaatgtaattacgtatgctcaagtgctttaatggaaggcacggtgcacaccatgggacttgctgaccacagttaaacattcccagtaaaatttcgtaacgggtcacagctcattcataatcacggtatttttggaccctgataaagacaattatttggatggngtccnggtactggaatggtatcctttaaattatttaaacctttgggtgtggggcaggnnganagggatggtgtccagagatacatcacatttacatcctatctnacngtcctctgttttctaaccctccttacatcctttcggtcaacacattaa

SEQ ID NO: 667341 - DNA, 1419 bp, Homo sapiens
  misc_feature (1419)..(1419): n is a, c, g, or t
ggggcatgtcctgaagctgacagcattcgggtcgagaggtactcgtctccgtggtccttagactgttgcctcgacgcttactcgtcatctttgctggacctgtgaagtgctatccagactgatactcctaaagattcacggctttactctacgtctatccagtcagagtaatggaaagttctaaatttcctggatattgctatgtgatctgggctgatcatccgatccgatcattagaacgtatgacctgactggtaatgaaatggagacgagaattcgatctcaacgttgcgtagctattcacgactttgtcctgtgcagggacggactcggtcttacgtaatcgtcttgtactacaacgtagaagttgcgagctcgcgcgactgaccacagattgagtattgcctagttcctgtggtggaaaacccgactggttggatcgtatatggtccatcaaggactcgctaaagactagttaatacgctagagtgaacttcagaatgaaccagtgttaacgcctatggcgattctatcgggatgtgtctcgagataaggagtgtccccgtccattattggggcatttgggattcgaaactcttcccagatattttactagggtcctgcttgtgacttttttgttgaacttcagtatcggacttagttgtcctataattaaacagcgttcaaccaacattttaggtggcgaccctgaaaacaattggttagggggctcggaattacttgagattgttttgacatccactggggggacacattggactccgtttccttcttcagtttgaattccttgacctttctggggggtggccttgggttcttcctcgatggttctcttgagccttgctcatgcatactcggcgatgtgctctgatggcgtgagtcgggccgcgacctagatgagggatagggcctacctagaggtcggacgataggccggtgggcgccgagcgttaatacagaaacgacagaaacgcgtagatggcaccgcatgacataaccacacaaaaagaccacagcatgacgcaagcgcagcactaaaagggtcgcgcgaataataagaccacccaacataccatatagctaactaaaattgcatcgcatatcaacacgaatcaataagcgaaaaacttaagaaagttgaaaaatcatagaacaaaaaaagtaatatagcctaatgcccaagttagatatacaataacctagccaatgcataataaacaaaaatctcatacaacccctgatataaaattagatagttccaaatccgtagagattatacgtatgggacagtatcgtatggtctaatgctcagttagcaatagatcgctatattatagatctaataatatcgttgtaccatgattagtagattcacctataaaagctttgatagatagn

SEQ ID NO: 667342 - DNA, 119 bp, Homo sapiens
  misc_feature (8)..(8): n is a, c, g, or t
tagctgantgtagagatatgtgaaattgattggctgtatgtttggtctagtggtgtagcctgagaataggggaaatcagtgaatgaatgcctcctactatgtgcaaatactgtgtggac

SEQ ID NO: 667343 - DNA, 135 bp, Homo sapiens
actgcatcaaacgcgctggtgccttgcagggaaaaggatggagcttgtgttgtgagaattcactgtgctcagatgctatcttgggatggtgttttacatgtggtgtgtgccaagtagagtggggatgattggcca

SEQ ID NO: 667344 - DNA, 352 bp, Homo sapiens
  misc_feature (327)..(327): n is a, c, g, or t
atgctgagtgccagctgcagctgcacaacttccccatggacgaacactcctgcccgctgattttctccagctccaccatcttggccttcagattgtctcttcatgcatatcgctgacgtttaaaagtttcaagcttgatggtgtcttacagatcacctcctcggagactcgcttccattcgtggggaaatgaaggctcagagaggttgcatttgcctccatggggcccacagagctggctggtggttgctgtgaattgggaaatcacattttctgacttctcatcgcgtgttctcactactcaacactgggaggaaccattgaattnaaagttcaaaatcaaaaaaaaaaaa

SEQ ID NO: 667345 - DNA, 280 bp, Homo sapiens
agcttaagcgggtaaactgagatggtgttgacttctcagcccattttcagggatctcccccagccaagagtctgtgtgcggaatgttccagaggcctcagtgccccctccctgtcggagagtgcagttgggcccgtggaggcatgctgcctggtcatcctggctgcagagagcaaggtgagactttctcgccccacttactcagaactggctcctcccagaccctgctcatggccagccccaccctggccacacccagcacagtgctgggcactgctggg

SEQ ID NO: 667346 - DNA, 821 bp, Homo sapiens
  misc_feature (118)..(118): n is a, c, g, or t
  misc_feature (552)..(552): n is a, c, g, or t
  misc_feature (558)..(558): n is a, c, g, or t
  misc_feature (570)..(570): n is a, c, g, or t
  misc_feature (587)..(587): n is a, c, g, or t
  misc_feature (590)..(591): n is a, c, g, or t
aggcgtagcgctgcgacccccgcacccctgcgaacatggcgctgcgagtggtgcggagcgtgcgggccctgctctgcaccctgcgcgcggtcccgttacccgccgcgccctgcccgcngaggccctggcagctgggggtgggcgccgtccgtacgctgcgcactggacccgctctgctctcggtgcgtaaattcacagagaaacacggaatgggtaacaacagaaaatgtgcattggaacagtgggaatcagcaatttttgcacaggaagcgttgggagatgttgtttattcgtagtctccctgaagtttgggacaaaattgaacaaacaagatgagttgggtgcctttggacaaggtgtgaaaagctgctagtgaactctattctcctttatcaggagaagtaactgaaattaatgaagctcttgcacgaaaatccaggacttgtaaacaaatcttgtcatgaagatggttggctgatcaagatgacactgagtaacccttcagaactagatgaacttatgagtgaagaagcatatgagaaatacctaaantctatngaggagtgaaantggactcctaaataaantanntatgaaataacgcaagccagagagttgtctaaataaggggtggatagaaaaattagaatagaagtttagtattaccgatggggacaaaaaaatactgttacttgtaattgagggaaattgcccttactttcaagtgattatagatacatataatatgggttttaaaaaaatcctatggaaaaagaaagggtccaatgtcagaatctgaattattccttggaaaacaagta

SEQ ID NO: 667347 - DNA, 304 bp, Homo sapiens
  misc_feature (76)..(76): n is a, c, g, or t
gcggagaaaacaagaagaaccgggctgtgatccgggaaagcaggaagggtgtcactgaccccaaagaactgaaatnctgcgttcaagacctcagtgaccagctccttgaagtggtggggctagaacgcctctgtgcatggattttaagatggtgatctttagcagtgtgactaggacgcctctgtgcatggattttaagatggcgaccttcagcagtgtgactaagatgcctctgtgcatggattttaagatggtgatcttcagcagtgtgactaagatgcctctgtgcagtgacacaccatcg

SEQ ID NO: 667348 - DNA, 288 bp, Homo sapiens
tcctctctcctgtttatgtcagttccatttcatgtctattttattttaataggtaataagtgtcttcaacaggccaagaaacatgtatttatgggtgaattaaaagcatttagtctgctgaggaacattattgaatcattaaatcattataactctcctacaaatggcttgctaggggtatgtagacaggctttggtaacctagaggaggaggtgcataatcttgcctagaagtgagggcatgcccttttcaggtctctgtgctgtggacttgtcataaagtataata

SEQ ID NO: 667349 - DNA, 247 bp, Homo sapiens
  misc_feature (76)..(76): n is a, c, g, or t
gcggagaaaacaagaagaaccgggctgtgatccgggaaagcaggaagggtgtcactgaccccaaagaactgaaatnctgcgttcaagacctcagtgaccagctccttgaagtggtggggctagaaggagtcatcgagtatggatgtagatctttacctgcctgatgattgcaggcagaaggtttcttccagttatgtcttctttcattcatcaggtacaatacatgctgtttcgtcacatgcatact

SEQ ID NO: 667350 - DNA, 343 bp, Homo sapiens
gtagtccttagtttattagtactgtacttcaaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaaaattagccgggcgtggtggcaggcgcctgtaatcccagctactcgggaggctgaggcaggagaatcacttgaacccaaggggcagaagctgcagttagccaagatcgcatcattgcactccagcctaggggacaagagcgcgagacttcatctcaaaaaaaaaa

SEQ ID NO: 667351 - DNA, 463 bp, Homo sapiens
aacatccaatcgcttccttccttctgtctgggtttcgttcagcattccctccctccattagccatgcacagcaaggtgcatctccagagggtagacattgcttgctccaagtcaattatgctgtttctgtaccccttcctgaccagctagggcacagcaatgtgctgcaattctagccaataacacacaagggagggcttcttaggagcttgaaggagtaaattttttactcttacaaaagagacactgagaaagtggcctttcggtattgtcacgtctggatgtggtattcagagctgttgcattcatcttgtgagcctgaggtgagccagacaaaatgacagagggcagacagagcccagataatctccgagaagtggagcccggatcacactacaccttatattttcttttggaaacatctttaaaagataaaatcaacataaaataaatataaagtaaa

SEQ ID NO: 667352 - DNA, 349 bp, Homo sapiens
  misc_feature (2)..(2): n is a, c, g, or t
  misc_feature (5)..(5): n is a, c, g, or t
  misc_feature (8)..(8): n is a, c, g, or t
  misc_feature (92)..(92): n is a, c, g, or t
  misc_feature (122)..(122): n is a, c, g, or t
  misc_feature (124)..(124): n is a, c, g, or t
  misc_feature (131)..(131): n is a, c, g, or t
  misc_feature (155)..(155): n is a, c, g, or t
  misc_feature (161)..(161): n is a, c, g, or t
  misc_feature (168)..(168): n is a, c, g, or t
  misc_feature (170)..(170): n is a, c, g, or t
  misc_feature (195)..(195): n is a, c, g, or t
  misc_feature (197)..(197): n is a, c, g, or t
  misc_feature (209)..(209): n is a, c, g, or t
  misc_feature (215)..(215): n is a, c, g, or t
  misc_feature (240)..(240): n is a, c, g, or t
  misc_feature (280)..(280): n is a, c, g, or t
  misc_feature (308)..(308): n is a, c, g, or t
  misc_feature (330)..(330): n is a, c, g, or t
  misc_feature (349)..(349): n is a, c, g, or t
cnacnccntcattccatttcttggaatgtggccatgcctccagtgcctccattcaaccccctctaactgattccttccatcctctgcgacgngagacgccgcccgcctcctgcccaccaccncnagaagcncctggctggggtggactgccgtcncctccnactcccnanattgccatgcctggcgacgcccacncnaccgactcaccnaccccnagtgtccgttgtgtgacctagtgcnccatgtattagcttccatggcccccaccccagcccccacnacaccccctttccccacccctttccccncggcgacttcccttttttgccncgataaacgccatctcagn

SEQ ID NO: 667353 - DNA, 113 bp, Homo sapiens
tttgatgaaccatgtgctgatgtgcaatgaatgatcacgtttaccctagtgagtttgaggctgcagtgatgccatgatcacaccactgcactccattgagccttggtctccat

SEQ ID NO: 667354 - DNA, 834 bp, Homo sapiens
gcaattgatacccaaaataaacccactcacctctgagaaaatcaaatgagcttgtcgtgctacgctaggctgggctatgacacacgtgtgaccagtcctcgggcacgtgcagagaggagggacccctatcggcgtttgacaggatcttggccagcctgcatgggagtggaggcacgtcactcgaccttgctagaggccaccccggatcacctccagtttgcgtcgtgtcactgaacgggaaccacgccgtgcgcctgccgctgatggagctgcagtgctcgatgactctaggtatgtgcagcaaggcgattggacgacaggagatttcaagtatgcggttcgactcctgagggaggagctattgcgggcaagctgaatcacctacaagcgacttgccatcataggctgccggatgatcagatcccaatagaccatattgttaaccgtagtctgtcattcaactgtggtgggcacctcgcggtcgtgggatgaacgcggccgtacgctcagcttgtgcgctgtgggcattgtccgacaggcctacaggatgctctgccgatctatgatggctttgacggcattcgcctaagggccagatcaagatgaagatcgtgctggacagcatgtcgaggggctggacgcggcaagtgaagctcccattctttgtggacaaacacgcgttctcccgggggaagttacttggacagagatcggcacagagatgcgcatgcaaagcatcaaggcgctgctgatcatcggtggattcgaaggtctacctgggactcctggagctgtacagtcgcccgggagagcacgaggagttctgtgtcccca

SEQ ID NO: 667355 - DNA, 560 bp, Homo sapiens
ctcaagttctggctggcacagctgtagtcacagacttaaaacagccaactcattcgttttgtgcagttttacagttgtttatggcagaggtgtgatttgggtccctgttatctcatcatggctagaagcagaagttttggcaaattattcttgtatctttacatttgaaaattaagggaaagtttcacccatggaatattagcattgtgacaatgctaatgagagtttctccagaaactatgatcctggtcagcagccagtcatttcatagaagataaacttcaagaatattctctgaagagcaatgaaactgagataagatctaaccactgttaccaacaaccaagaaaaatagagccgcctggacagcttccgtgtggacgtctgaaacggagagagctcagtcactcagtgctcagctgaggtcccagaggccaagctgcaccctcctctctgtccctgcagcacagttcatccaccttctgaaactcaccaacagatgggtgggcgaggaaagaaaatcagtgtttacaattccagtaaagacattaaaattcaaa

SEQ ID NO: 667356 - DNA, 339 bp, Homo sapiens
ctcctcattggagtttgcatcctcagaagattgaggaaatatgtataagaaataatcatggccgggcacagtgtctcatatctgtaatcccggcactttgggaggctgaggcagacggatcacttgaggtcgggagttcgagagcagcctggccaacatggtgaaaccccaactctgctagaaatacaaaaattagccgggcgtggtggcggcacctgtagtcccagctactccagaggctgaggcaggagaatcgcttgaaccagggaggtggaggtttcagtgagccaagattgtgccaccacgctccagtatgtacgacagagtaagaccctatct

SEQ ID NO: 667357 - DNA, 1626 bp, Homo sapiens
gggacactcccgagctctcctccgcgttcgcagccgccgtcatcccgcggaggagcgcgcagccccggggaggccggaggacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaaggaggccccggccgagaagcagcagccgccagcagcccccaccacggcacctgccaagaagacctcggccaaggccgaccctgcccttctcaacaaccacagcaacctgaagccagcccccacggtccccagcagtcccgatgcaaccccggagcccaagggtcctggggacggggcggaggaagatgaggctgccagtggggggcctgggggccgaggtccctggtcctgtgagaacttcaaccccctgctggtggctgggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatacgcccccaacacacgcgcacggtgaagaggacgcccgagcccacccctgctgacccaggacttccccaacctccagggcagaaagagcccaggctccggggtccacagcacaggatgtggggcgagggcacagctggggaacggcaagaaaggaatggaccctgtgtgtggcccccccacccctggcggctgggtgatcctgggcccccagggctggtctgagtgcaggtgggggtgccgggatgggttgggcctgggcccggccctcgtggggacattaaagggcgcggtggctccactcgccccatttctgctctttgcgtaccccccgggggtctgcctgggcgaatgcagtgggacggacctggggtgggcactcacctcagcagagcctcaatgccacctccccacaccacccaagcctagctgggtgggaagacggagccctgaagcctgcgtgtggagggggtgctgcccaagggtcgccttccccagcttgtgctccaggggagccccgacgccggcggggaggcagggatgtcgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactggccagtggccacaggaaccccgggcctgagtggaggctgagtctgaaataaactctgtcgtctga

SEQ ID NO: 667358 - DNA, 118 bp, Homo sapiens
taccgtgtactggcgtgtgtcgcgctcggggtgacggtgctacgggctcggtggtcctcgggctggtgctcgtcgtgctcgtggggctgctgctcgggcggctgcgggtgttcgggga

SEQ ID NO: 667359 - DNA, 1289 bp, Homo sapiens
gggacactcccgagctctcctccgcgttcgcagccgccgtcatcccgcggaggagcgcgcagccccggggaggccggaggacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaaggaggccccggccgagaagcagcagccgccagcagcccccaccacggcacctgccaagaagacctcggccaaggccgaccctgcccttctcaacaaccacagcaacctgaagccagcccccacggtccccagcagtcccgatgcaaccccggagcccaagggtcctggggacggggcggaggaagatgaggctgccagtggggggcctgggggccgaggtccctggtcctgtgagaacttcaaccccctgctggtggctgggggtgtggccgtggcagccatagccctgattctcggtgtggccttcctggtccggaaaaaataatacctgggggccaggcggggggcacggagccacttcctgtacagacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactggccagtggccacaggaaccccgggcctgagtggaggctgagtctgaaataaactctgtcgtctgaagaaaaaaaaaaaaaaaaacaacacaaagaaaaaacaaaacaaaaaaacaacaagaggggggcgcgcgagcaaaaaactccccaggggggccgcccacagattagtagcggcgcacctgccgattgttttttttttgaacaaacaaggcgggccccccaataggtagcggcgtcgttttgtaactccactttgcacccgggcgcgcctgctgtttataacaacgctgtgtcacgagtcgtcgtagaaacaatcttcacaggtagaagcgttatggggcgacaaagcaccccatcatctgggggggccggacgaacattggtggcgaactcactctg

SEQ ID NO: 667360 - DNA, 472 bp, Homo sapiens
ttagggacgtggactttcctagggagttgacttttaacagaggcggtattggacacttttggaaaagtgccagtggtataagagttcataagccagctcgtgcatttttgtctccctggagaagtccatggtgtagaccacgtactcttccaagggtggcccgggttcagcgaagagccccaatctaacgttcaagggactttttgaggaggatgcctgtgttaggagccaaactggttaacggtgtgcatccagctcctatgatgaagcttttaactaagcgacccattgtgcatcggaagaagctcaagattcaccatctcccggccctggtaaaacctttggatgcagctatgcccagagcgtttactgagaaactggggaaagttgcatcgtttgtgcgaaaaattcaggggatggtaaaggctgatgaacttagtgccgccttgaagtgccattgtgacagataaag

SEQ ID NO: 667361 - DNA, 381 bp, Homo sapiens
agctcggtacccgccgttgtcagtgggacggacctggggtgggcactcacctcagcagagcctcaatgccacctccccacaccacccaagcctagctgggtgggaagacggagccctgaagcctgcgtgtggagggggtgctgcccaagggtcgccttccccagcttgtgctccaggggagccccgacgccggcggggaggcagggatgtcgagggcccctcacagctgtgcccgccctgccccgctagactgcccctccagcttgcacccagcaccacctgagtctaaccagcgtataatgcaataacaggtagagtagaactgcttttggcggcgaccgtcacacactaacactgacaccggcggggttcctcaagagc

SEQ ID NO: 667362 - DNA, 295 bp, Homo sapiens
taatggacccaatgtgggatatgggatctgcctgtattactgtcaagactggcatcagcacagtgtagagccctggtgcttcatcttcatcagctctgcatgaaaaatattcttccgaaatgcgttcgtccactcgatgctatactgtaatcatcgccatggattgtacccatcagctcatttaaacagcatccgtatgattaggatccggttctctggagtcctaagcatagtgtttatcacttcctggtctgtatcagtttccccattttcttctagtgttgccaagggtttg

SEQ ID NO: 667363 - DNA, 1962 bp, Homo sapiens
gggacactcccgagctctcctccgcgttcgcagccgccgtcatcccgcggaggagcgcgcagccccggggaggccggaggacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaaggaggccccggccgagaagcagcagccgccagcagcccccaccacggcacctgccaagaagacctcggccaaggccgaccctgcccttctcaacaaccacagcaacctgaagccagcccccacggtccccagcagtcccgatgcaaccccggagcccaagggtcctggggacggggcggaggaagatgaggctgccagtggggggcctgggggccgaggtccctggtcctgtgagaacttcaaccccctgctggtggctgggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatacgcccccaacacacgcgcacggtgaagaggacgcccgagcccacccctgctgacccaggacttccccaacctccagggcagaaagagcccaggctccggggtccacagcacaggatgtggggcgagggcacagctggggaacggcaagaaaggaatggaccctgtgtgtggcccccccacccctggcggctgggtgatcctgggcccccagggctggtctgagtgcaggtgggggtgccgggatgggttgggcctgggcccggccctcgtggggacattaaagggcgcggtggctccactcgccccatttctgctctttgcgtaccccccgggggtctgcctgggcgaatgcagtgggacggacctggggtgggcactcacctcagcagagcctcaatgccacctccccacaccacccaagcctagctgggtgggaagacggagccctgaagcctgcgtgtggagggggtgctgcccaagggtcgccttccccagcttgtgctccaggggagccccgacgccggcggggaggcagggatgtcgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactggccagtggccacaggaaccccgggcctgagtggaggctgagtctgaaataaactctgtcgtctgaagaaaaaaaaaaaaaaaaacaacacaaagaaaaaacaaaacaaaaaaacaacaagaggggggcgcgcgagcaaaaaactccccaggggggccgcccacagattagtagcggcgcacctgccgattgttttttttttgaacaaacaaggcgggccccccaataggtagcggcgtcgttttgtaactccactttgcacccgggcgcgcctgctgtttataacaacgctgtgtcacgagtcgtcgtagaaacaatcttcacaggtagaagcgttatggggcgacaaagcaccccatcatctgggggggccggacgaacattggtggcgaactcactctg

SEQ ID NO: 667364 - DNA, 178 bp, Homo sapiens
  misc_feature (168)..(168): n is a, c, g, or t
accatgttgtccccctgtataacctctgttctgtattccgccacaatattagtttacattttcacatgcatttcacatggatagtctcttgtaacatgctgtgacattaaacttatcattttgcaggcattaaaatgaggttatcatagggggcgatatcagcctaanggggcaatat

SEQ ID NO: 667365 - DNA, 103 bp, Homo sapiens
ccccttggggggattaaaaaccttttttttttaaaaaaaaaaacctttaggggcccctttttgtgggctctttaaataaaaaaaaaaaatggggaaaaaaaaa

SEQ ID NO: 667366 - DNA, 1214 bp, Homo sapiens
gggacactcccgagctctcctccgcgttcgcagccgccgtcatcccgcggaggagcgcgcagccccggggaggccggaggacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaaggaggccccggccgagaagcagcagccgccagcagcccccaccacggcacctgccaagaagacctcggccaaggccgaccctgcccttctcaacaaccacagcaacctgaagccagcccccacggtccccagcagtcccgatgcaaccccggagcccaagggtcctggggacggggcggaggaagatgaggctgccagtggggggcctgggggccgaggtccctggtcctgtgagaacttcaaccccctgctggtggctgggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatacgcccccaacacacgcgcacggtgaagaggacgcccgagcccacccctgctgacccaggacttccccaacctccagggcagaaagagcccaggctccggggtccacagcacaggatgtggggcgagggccgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactggccagtggccacaggaaccccgggcctgagtggaggctgagtctgaaataaactctgtcgtctga

SEQ ID NO: 667367 - DNA, 1504 bp, Homo sapiens
  misc_feature (71)..(71): n is a, c, g, or t
  misc_feature (73)..(74): n is a, c, g, or t
  misc_feature (79)..(80): n is a, c, g, or t
ttaactttaaccttcttaaatatttggagatgaatgataattgtaatatttgtttgcattaccttgctctncnncaccnncagccaccagcagggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatacgcccccaacacacgcgcacggtgaagaggacgcccgagcccacccctgctgacccaggacttccccaacctccagggcagaaagagcccaggctccggggtccacagcacaggatgtggggcgagggcacagctggggaacggcaagaaaggaatggaccctgtgtgtggcccccccacccctggcggctgggtgatcctgggcccccagggctggtctgagtgcaggtgggggtgccgggatgggttgggcctgggcccggccctcgtggggacattaaagggcgcggtggctccactcgccccatttctgctctttgcgtaccccccgggggtctgcctgggcgaatgcagtgggacggacctggggtgggcactcacctcagcagagcctcaatgccacctccccacaccacccaagcctagctgggtgggaagacggagccctgaagcctgcgtgtggagggggtgctgcccaagggtcgccttccccagcttgtgctccaggggagccccgacgccggcggggaggcagggatgtcgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactggccagtggccacaggaaccccgggcctgagtggaggctgagtctgaaataaactctgtcgtctgaagaaaaaaaaaaaaaaaaacaacacaaagaaaaaacaaaacaaaaaaacaacaagaggggggcgcgcgagcaaaaaactccccaggggggccgcccacagattagtagcggcgcacctgccgattgttttttttttgaacaaacaaggcgggccccccaataggtagcggcgtcgttttgtaactccactttgcacccgggcgcgcctgctgtttataacaacgctgtgtcacgagtcgtcgtagaaacaatcttcacaggtagaagcgttatggggcgacaaagcaccccatcatctgggggggccggacgaacattggtggcgaactcactctg

SEQ ID NO: 667368 - DNA, 1275 bp, Homo sapiens
  misc_feature (234)..(234): n is a, c, g, or t
gcaacagttccaaacaataacgatcactgtagctgggtgctcgcgacaacgcttgcctactgcgcgctgctgcctatcagcacttcctgcggaaagctctcctggcctgcactgaaccttgctcctcgctgcgcactgcttctcgcgacacgataacgccttaccacggacgaaactgactgcgactcctgccacgccactgcgcgcacgccctctacttctcctctcagcacnacccctacaccacacttgctgcgccacgactacacacgactctatctcctgctgcacccgcccaaattctcctcacacgcactctgctacgctgcgctacaccttgccacgcgcacgctcccgctccacgcccaaacgcacacggcgcgcacgcacgcctcgcggccctccaacactccttgggctgcccacgcacgccacacacctgctctcacactcgctcctttccacacactctccaccttccactctccccctccaccaaactccggctccacacgggctaaccaagtgtccactttgcacctgtggccactccacctacaactctgcctggcgcctctcttcccaaaagcccccacgcctgcgcaaccactttttcctccttaccgcctaactgctgtaccccctggcgcacacaacctaaacgccctgcgccacctttaccccgctaaaacacacaccccggccgcttgccactctggcgccaacgcctgcgcaccttgctaacacttccttgggcgccacttctcccttcgacccttcacgcgcaactctctcccggcccttactcccccttctccactggcggcgccctttgtcacacaacagccaccctctctggcgggcgccaccttctcccagttctcccccccatggcgccaggcccgttgggctcccccttggcgcccaacgtggcgcgcactcctccctcggcgccgcgcgcgccaacaccccacatcttggcgcgccccgcaaccccctttcctcaacgccgcccttggcgctcggcgcccctcttcggccctcgccttggccgccaccgtgcttgtgcggcgcctgctggcatttgcgacacaccgcttgggcctgtgcggccccagcccgccgcgcctttggcgcttctccctctcccctttccccccttcccccccacaggtcccggcacccaccctttctccgcccgcgccttttctccccgccgtcaacacacgatctctgcgccgcgcggaacaccccccttcggccgcccccacacac

SEQ ID NO: 667369 - DNA, 327 bp, Homo sapiens
gatcggctcggtaccagtctcaaaggctagctgcgagcatggtagagtcaggctgaggtctccaggaagagctagtcctattgttttcacgcgaacattcgcggcctcctcagtgggcacttcccgggcctggctgaggtcacttttgttacccagcgagcatgacgacgatcgtggcttcagcatggtcatagagctccttcagtccatcgctccaccacagcataggtctggtgcttggttaggtcaaacaccaggagggcccccactgcaccacgatagtacctgggtgggaatgagaaggatggacagagatgcgatcagagg

SEQ ID NO: 667370 - DNA, 729 bp, Homo sapiens
  misc_feature (128)..(128): n is a, c, g, or t
  misc_feature (142)..(142): n is a, c, g, or t
  misc_feature (154)..(154): n is a, c, g, or t
  misc_feature (192)..(192): n is a, c, g, or t
  misc_feature (239)..(239): n is a, c, g, or t
  misc_feature (244)..(244): n is a, c, g, or t
  misc_feature (499)..(499): n is a, c, g, or t
taggcgtttatatcatatccgctatttgagacatctcgctgcacgtacaattacccatcgatgcggggctcgacatgtgctttataggagtcgtgagtggagtccagtatagaggtatctttactatnacagctattgtgtnagctactcatantcaagttgttggctcaggagtttgatagattcttgggncagtgcagagtgagtcagtagacatgtttagtcgagcctagggtgtngtgantgtaaataccctgcgatgagtaggggaagggagcctactagggtgtagaataggaagtatgtgcctgcgttcaggcgttctgactggttgcctcatcgggtgatgatagccaaggtggggataagtgtggtttcgaagaagatataaaatatgattagttctgtggctgtgaatgttataattaaggagatttgtagggagattagtatcagcagcaggtagcagttttttcgtgcatagtggttcactggcatnagtggcgttggcttgcccttgcattgtgcacgggtcaggcagtccaggtcagttagtcattcaggcaggggggttgttcagggggtcggcaggcaaaaggttggggcacagctaaatcaggttgttgttgcatttggttaaaccaatcagtagacgggcatgcatgctaatacattcaggctgtgggtggtagtgttgcaatcaaattctgtgtccttaggccagtcatg

SEQ ID NO: 667371 - DNA, 677 bp, Homo sapiens
  misc_feature (76)..(76): n is a, c, g, or t
  misc_feature (90)..(90): n is a, c, g, or t
  misc_feature (102)..(102): n is a, c, g, or t
  misc_feature (140)..(140): n is a, c, g, or t
  misc_feature (187)..(187): n is a, c, g, or t
  misc_feature (192)..(192): n is a, c, g, or t
  misc_feature (447)..(447): n is a, c, g, or t
tattatgggggctgctgaacatgggcatgctagtggtgtcataagatggatttcgtcgggaggtatctttactatnacagctattgtgtnagctactcatantcaagttgttggctcaggagtttgatagattcttgggncagtgcagagtgagtcagtagacatgtttagtcgagcctagggtgtngtgantgtaaataccctgcgatgagtaggggaagggagcctactagggtgtagaataggaagtatgtgcctgcgttcaggcgttctgactggttgcctcatcgggtgatgatagccaaggtggggataagtgtggtttcgaagaagatataaaatatgattagttctgtggctgtgaatgttataattaaggagatttgtagggagattagtatcagcagcaggtagcagttttttcgtgcatagtggttcactggcatnagtggcgttggcttgcccttgcattgtgcacgggtcaggcagtccaggtcagttagtcattcaggcaggggggttgttcagggggtcggcaggcaaaaggttggggcacagctaaatcaggttgttgttgcatttggttaaaccaatcagtagacgggcatgcatgctaatacattcaggctgtgggtggtagtgttgcaatcaaattctgtgtccttaggccagtcatg

SEQ ID NO: 667372 - DNA, 1136 bp, Homo sapiens
tggaggctgagatgtgtgttctgcgcgtgtgcttggacggctgtctgtaaactccgcggtcagttcccggactggtggctggtctgcagtgattgacctgcgcaatgcagagtgctgcaggtagtgctggtgccacctgaggggtcctggcctgattcctggctggatgcctgcaggcctgcgccttgccttgatgctgtgtgcccctgcatggcctctgtgcctgctggacggtggtaggttggttgcactgtggctgtgctgcactggcccatcttgcctggtgctggtgcctgcggtgctgtgctttcaatgtgagcaccgacccccttgacgatgctttctcttcgtgcatgtcagttgacctgctggtttctcgaagggaacgtgaaatactgagtgcctgtgaaacatgcttggggggaccatcttgtggctcgcgacacatgttgcttgccagcccttgggggcccgtggggccaaatccttgggcccctgagagtctgccccactgtttctcttgaacgttgaccattcccctgtgagagaacttgttgccatttttggttccaacttgggtcaactgtaatagaaccgatgtaggtttacgtggtccggtgggggctttaccagtggtggcaaacagttgggtgccccaaatgcccaagataaagctcagtatgggttgtagcaattttcaagcgaacagccacttggcgcgagttcctttaacgttcagacggcgctttgggcggcacgttagtagccccatatggttaggccggcgcgatcgcgcgaagcggtccccaacgctgaggtatcaccccctgttgtcgcgcgctttacgaaccccacagcaaacggggggggaagagcccccccccccttgtgggggagaacgccaacgtttaacgtttataacccctttaatcgcgggcggccgtggcccttctgtggcaactgtgggtggtgtgcgcaacaaccgtggtcggtgcctgtaacaagcgtgtgtgccccacagggaaaggcaagaagctttgggagccccgccttgtgcaactcctttgtcccgcctaacaattggggcgcggggacaacttatgagacccacccctaccctgttggtaactgtgaac

SEQ ID NO: 667373 - DNA, 94 bp, Homo sapiens
aatgtgggaaatggcttggggaggatggcccctagcttaggaaaactgttgtgttatttgttcaatttcaaaaaaatgatttgtaggtcccgca

SEQ ID NO: 667374 - DNA, 886 bp, Homo sapiens
  misc_feature (455)..(455): n is a, c, g, or t
gcactcgtcagttcggtatgggcgcggagacgcttctggaaagaacgccgcagatggctgcgcagggagagccccaggtccatgttcaaacttgtattgggttggtgatggtggtccctggaatagcccgaccttcgttgaaatcgtcattagactggtgaatttgagaagagagtatgtaagccatccgttgtgggtgctgcgagagttcaatccccttatgtgtttccacagctcatagcatgatgagaacctattgaaccttcaatgggattggtgacatcgagtcgcgtggcaggacgacaatttctggtgggatctagagaagaatggcttattcactccaaggccccatatgctgccatcatatagtgttctgatgtatacattcgaagagattacattacaagtaatgtgcctataactgtgtcgatagagattcttggtacgatggngttgttgataaacattccccattgtgtttgtagttggacatactaaagtgtgatagttaacgcgacagggagcggtgaagtgctgagtactgccatcttgtctgtccatccgaacatgtaaatgcaattcttacagctacttactagctttcttcttgtgcttaacgtgacatcttagcaaccttatggagtaaggccgctatcacatcgtggactgtggctacggtaatgctgcatctgggaggacgctcgtgacactttggagattgtgttcgcccattgtcctgtcatcttgcagcgcctcagacatcaagtgggtgatgagatcctcagacgtttggcaagcacaccgtattgaggcacggaacttaaaaggttgctccggacaaagtgcttctcccgggatgagcgctggatgacctgggagacag

SEQ ID NO: 667375 - DNA, 434 bp, Homo sapiens
tcatcttctgaatccaccaaaaaaaaaaaaaataaaaaaaggcaaaaagcccacgcttgggggcccatgcctgtggccccaccttatttgtaaggctgaggcaggaggtttgcttgaaaacgggatttaaaaattgcagggacctatgatggccctacttgccccccacccggggttgacagagtgacactcttattcttctttttaaaaatttaaaaaccaaagtatatttagtgtgaacattcatggaaagaaagagaacgcaagacaaaccttcagggagaggaaaatcgaagtgggttgatttcacccgtggacttaagtggacacagcttattcttgttacgttactaggcgtttacaaagttgttttcaaaagcagttgtctttaacccaacactttttttgaggctctcctctgtgtcctgtgatag

SEQ ID NO: 667376 - DNA, 220 bp, Homo sapiens
gtacagatctagtgcatagactctctcatccactagctaggtgaccagactgactccatgggagctgtgatatgactgaaccatctctgtggtatccgctagatctcactaagtaagacggaccctacaccagaatagatagcaactgtagcgatctattaagattagatctatagtcgctatcatcctatgaggtataagattgggaaagaaaggggcc

SEQ ID NO: 667377 - DNA, 412 bp, Homo sapiens
ggagccccattcataacacatcagatctcatgagactaagtcactaccgcgagaacagtatgtggggaaccatccccatgattcagttatctgcacccggacccacccttaacacgtggtaattattacaatgcaaggtgcgatttgggtgggacccatccaaagtatgtcagtatgttttgacttcttgcttgattgctaggttgcatagaggacaaacatggaaattagtgaagtaccttaatatctggcttcagatcttagacaggatcagagggccagctcaaatttgcaaggaggggaggtagatcccaccattttatgagtgaatggcaaaatcaaacagaaattatgtgggatgggagatactgatgcagccatctttggaaacattctacggcttcgtcggtca

SEQ ID NO: 667378 - DNA, 119 bp, Homo sapiens
aggtagatgagctggtccgtttagttgtgcaggtgagtgagtgggcaatcaaagcttgctgagcttgaactctgggctcaagcaatcctcttacctcaggaactaggactccaggagaa

SEQ ID NO: 667379 - DNA, 774 bp, Homo sapiens
agaaaaaaaaatgccaaaattcatttggaactaaaaaagagtctgcaaagccaaagcaaaactaagcaaaaagaaccaatctagaggcatcacattacccaacttcaaactatattacaaggctatagtcaccaaaacagcatggttctcgtataaaaataggcacatgaccaatgggacagagtagagaagctagaaataaagccaaatacttaaaagccaactgatcttcaacaaagtaaacaaaaacaaagtaagaaaattacaccctatacaacaaatagtgctgggataattggcaagccacatgtagaagaataaaactggatccttatctctcaccttatacaaaaatcaacacaagatggatcaaagacttaaatctaaggtctgaaaccataaacattctagaagataacattggaaaatgcttctacacattggcttaggcaaagagtttatgaccaagaacccaaaagcaaatgcaacagaaacaaagataaatagacgggacttaattaaactaaaggcctcctgcacagcatagggaataatcagcagagtaaacagatcacccacagagtggggagaaaaattttcacaaactgcatctgacaaaaggactaatgtccccgaatctacgggaactctgatcaggcagaaaaaataatctcatccaaaagtgtggccagggctgaatagaccattctccaaagagatttaccaatggcacaaaccttgaaaatgccactcctattccgggatggacaaacc

SEQ ID NO: 667380 - DNA, 687 bp, Homo sapiens
  misc_feature (510)..(510): n is a, c, g, or t
  misc_feature (513)..(513): n is a, c, g, or t
  misc_feature (601)..(601): n is a, c, g, or t
gcctatcataatattggcaatttatagagatttttatgagcaaggtaatgaccatctgaaatgatcaccttgacttctcctgatccttcaattcttttagcttattgttatgaggcaaaagctatgaaatatcttatcctgagaggcacataaatcatcagtagagagatcatagcagagttctgactgaagcagcactgccatccacgttcagtggtgacagatcctgtgggggcatcatgaagacacaccctctctgctggtcatgtggacagaacttgtgcctttgctccgccatgcatttgactgcctctagcatcctcggatggcatgatgcccaccattccatcatctctgctgatcttatgctgtgctccacagcacaagcacctgtggttggaacatgtctgcctgctagatgcactccttgttgtacataataattacccaatgaattcagatttctggccccagcagttctctttcaaatagtttctgtctgtcccacantanataagattgacgcccacccaccatatttgattttccatcagaatccaggtttaagttgctcgtcatcagcaggacccctcacacttgnttaggtatattcttggcctgggcactgttgacttacacctacaattcccagcacttttggaaggcttacgtgggcatattcggtcg

SEQ ID NO: 667381 - DNA, 260 bp, Homo sapiens
gaggaagaagaagggagagagagaggggagggaaggaaggcgaagaagggggaggagggaagggggagagaaggagggaaagggaggggaagagagagaaggaagagaagaggaaaaggaggaaggaagggcagggagagagggggggaggagaggggagaggaggaggggaacgcgaggtggatgtagagatagctatatatatatatatatatatatatatatatatatatatatatatataactccgcgtggagaag

SEQ ID NO: 667382 - DNA, 356 bp, Homo sapiens
  misc_feature (179)..(179): n is a, c, g, or t
catcagtttctcaggatgatccccaagaacgttatggggtccctgttgccataggttctctttggggcctaatgactccttttcccaaaatccgcttttacttttgggacccggttgcttcggtgaaatgaaggtgccccgcatccagaaaaacgcccttctgggccccaaccgggggnttcctcagccccccggctttgcaggatcagggctcgggcaggccccccggaaattaaaaatttgcagggagcccccctgccttccgtcggctgtgaatccttgtctgtcagggggggatcccccaaatccccgaattcatacagatcgttttaataaatggccctccttaaagtcca

SEQ ID NO: 667383 - DNA, 379 bp, Homo sapiens
tgtgtgactagaacacctgcatgaaactgagctgcgtctattgaatagagatacagtactagcaatgagctataacatcatattcctatctacccttaaagtaacacttgaaatatcaaaaatcatgattatctatatcgttgggatctttctgtcttctgggtaccatttatttaaatgtttaacaatatgttagacatggatagtacagttcataaccaatgacttggggcatgctgcaaacacttactgtcgttgggatttcgagtgtattagtcacgcatgtatggggaagtcgtctcgggtatgctgttgtgaaatcgcaactgtcaacgtcgctggttagtgtgttggttagtaggcctagtatgcggcgcgt

SEQ ID NO: 667384 - DNA, 775 bp, Homo sapiens
  misc_feature (10)..(10): n is a, c, g, or t
  misc_feature (248)..(248): n is a, c, g, or t
  misc_feature (260)..(261): n is a, c, g, or t
  misc_feature (263)..(263): n is a, c, g, or t
  misc_feature (270)..(273): n is a, c, g, or t
  misc_feature (279)..(279): n is a, c, g, or t
  misc_feature (283)..(284): n is a, c, g, or t
  misc_feature (289)..(290): n is a, c, g, or t
  misc_feature (330)..(330): n is a, c, g, or t
  misc_feature (333)..(335): n is a, c, g, or t
  misc_feature (354)..(354): n is a, c, g, or t
  misc_feature (358)..(358): n is a, c, g, or t
  misc_feature (365)..(365): n is a, c, g, or t
  misc_feature (379)..(379): n is a, c, g, or t
  misc_feature (388)..(389): n is a, c, g, or t
  misc_feature (432)..(432): n is a, c, g, or t
  misc_feature (440)..(440): n is a, c, g, or t
  misc_feature (450)..(450): n is a, c, g, or t
  misc_feature (459)..(459): n is a, c, g, or t
  misc_feature (476)..(476): n is a, c, g, or t
  misc_feature (557)..(557): n is a, c, g, or t
  misc_feature (621)..(621): n is a, c, g, or t
  misc_feature (676)..(676): n is a, c, g, or t
  misc_feature (693)..(693): n is a, c, g, or t
  misc_feature (698)..(698): n is a, c, g, or t
  misc_feature (715)..(715): n is a, c, g, or t
  misc_feature (769)..(769): n is a, c, g, or t
tctccagggngtccctgcagggatctcactacctctcagctgtgttgcttcactatttgagaatcaagttctttcccaggcgaatgagaatcccaattggcctaaactgtttccagatcccccgaggctcctgggtctccacgcagcttgggtgcgacttccctggatcccgtcacttgcccacacagaagtcctggaagatgatgtccaggatctcctcggtaccccctccacctgggagcgggggnaggggagccggnngnatttgtnnnntttttnttgnnagggnnaggtcttttgactgcttgtagtggccgagggcatccaggnaannntggaggtggtgctggtgcnttgntcgggtnagcagggggggatntgtggacgnnttcccacacactgcagctagctccttcctcagcgcctccaggngggcgtcnagcccctctnccgtcaganaggacagaagcaggtgngggggcaggtcagggccgggacctgggcctccggggacagcaggtccgacttgttcagcaccaggtggaggcgctggctgntgttactggggctctgggctcccaaagaggctacgacggtggccaggaagttgcaacttgttgnagaggccaggtcagaagcatccagcatggccagaatgaggtcagcctgctctagnctctcccgggcgcgcgnatgcnctcctgctccacgggcnccacgcctcccgcaaccagccgtgtcgctcagcagcacaggaaatccggcgagntcgact

SEQ ID NO: 667385 - DNA, 186 bp, Homo sapiens
ttgtccggaggccagccttttcctttttgttgcttttccggatttttaaattgtgactcggtttttgttatggttgtaaaaaaaattccttggccttgttagcctttggcctttttattttgtttaaattttgcttggatttttttgttttttcccaacctttcccattaattaattgaattttta

SEQ ID NO: 667386 - DNA, 1050 bp, Homo sapiens
  misc_feature (585)..(585): n is a, c, g, or t
tatttggggtgacaaaatctaggggactgaacgttgtttaaacccagaggtatggtatatgtttaggttattggtatatattcccgttaaaggtcgtccaaccattgtctcaccattcaattttggaagttgctggtctacggaacggtatgttaactgcaattattattatcgatgtaaaagatagttggagagaagtttttaagaatttaagacacttttcacgagttaagcttctattgaaaagttgcacgttggtttgtcacgacgtaaaaaaggagggattcatacgcgttattgagtaaccttggataactcgggctcatatcatgatctagagaggacttatagtgggtttccaggctcacactgtgtgtaatataattgttctcccttgtataaaccttatcactgagttataaatttctcatatgggaatagaatctcttgtaagcattacccacagatgtttcacaataggttgaaaagagtattgaaagtgtcaaggttgtaatatactttattctgtgaaaccactctcgagtgcacgagaatattcacttgtactcgtgataagaagatgtngctcttgtcctcgattcacacgtgtctcgagaacttgtcagccttagattgccttagaagaaactatttttctaatgagacttaaactctttataccacagtgtttaattttataagctgtgtttctttgaatagacaagggcacactgagaaaatatgagagtaaatgaatatatgtaaggaagataaaggggagattggtgtgtggtgcttttctccaataaaagagtagcaagcttgcctagaaattttcttgagatctcaaaaatagagcttaagattgtggacctctttacgagttccggtggttgaggctctgggttggtgattactgtgccataaaagataatggcttaaacattaagcattagtcgtgctcttcatgattaatatggcagagattttgttaactataattaaaacttaccgatatattggactttgcaataaaaaaaataatataaa

SEQ ID NO: 667387 - DNA, 330 bp, Homo sapiens
aggaaggaagcacgtggaggagggacggaggaggttcccttgctgggcatgcttcgtagagggccagccgcagcaggtcatgtgcacattccgttgcagcacagtttgtgcttccggtagccgtggcttttcattgtgcacagtcccaggtcccagctcccctcttatggtttctgtcataatgtgcttcatctgattgcctccaatcatccggatatgtcacccgcagctttctcgtgggaaccaatatgtacatgtttgcaattatgctgtgagcctttaaatgtgttaggtggttaatgctattggcagggaataataataaaaaaa

SEQ ID NO: 667388 - DNA, 132 bp, Homo sapiens
  misc_feature (51)..(51): n is a, c, g, or t
  misc_feature (76)..(76): n is a, c, g, or t
  misc_feature (110)..(110): n is a, c, g, or t
agccgggtcccaagcctgtgcctgagcctgagcctgagcctgagcccgagncggagccggtcgcgggggctccggnatgtgggaccgctgggcccaggactggcgacccntgtgggaggccttcttcggctt

SEQ ID NO: 667389 - DNA, 156 bp, Homo sapiens
ggtaccccaaggcaacggcgaattcacgccgtatgccggcacggtggtggacctgaacgacaatttctcggcctatgcgagctacacccgcatcttcattccgcgatcggaacgcgattcgtcgaacgcgctgttgccgccgcagaccggcaagaa

SEQ ID NO: 667390 - DNA, 414 bp, Homo sapiens
atttaatgcaatatgagtgttgaaaataatacagaaacagtctgcagagtcacgcgatttaccaaattcacactagcatgagtgcacattttcccttctgtgtatcaccttctgctcagtttaccctaacgcagtttataaagtttatgaccattttggaagactggctgataacattttactgacttgggctttgaggaaattattttcaagagaaattaaatcacgactcatagtacaccaataccaaacaaaagcttttttttttttcactttgttccacagttgtcttaaatggcaaaaattgcgggaaagtctattcacacttgaccatgagtgtagagttgcttttccttcctctgaggccaagatttacttatatccgtgaccgtgaagaactcttttggacctgtt

SEQ ID NO: 667391 - DNA, 238 bp, Homo sapiens
gtgggttgaccgtggcttgtgcgttgaccgtggcttggctcgagacatactctccagacaaggatcgtacatggcttgcagcatcctgcctagatagaggcgctctccatgggctgggttgctgcacttggcaggcagtgagtgccagcaggttcttagctcttgaaagctcttccgggaggaggaggtggtggagacaaattagaggctggagctgatacccccgccactgccaaag

SEQ ID NO: 667392 - DNA, 483 bp, Homo sapiens
  misc_feature (211)..(211): n is a, c, g, or t
ctgcaaacaattgtccagcaccacttagaaccaacaacatttgaagattttgcagcacaggttttttctccagctccctaccaccatttaccatctgatgccgatcattaaatatcagttctgtttatctgaaggctcctacccagagattctacccagtgaaactcccacagcaacgcaaaaggggggggggtttaaaaaaaattggggnctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttat

SEQ ID NO: 667393 - DNA, 110 bp, Homo sapiens
ctacagagacctcctacacttatgacagaaacaagtgctacacacctgtggtcccactcgtttattggaaggggggcccaaatgggggaaacaggcttaaccccagatcg

SEQ ID NO: 667394 - DNA, 240 bp, Homo sapiens
  misc_feature (129)..(130): n is a, c, g, or t
cttggcgatccacgtttattgaagtggatgtaggaggccgtcacaaatcaaatgtgagcatagaagatatggccaaacataaaatctatcaaattccatagaaacatttccctccacttataaataagnnactttgtgaaaaaaaaccccccaccaaaaaacccccttctttttttttctccccccccaccccacacctttttttttaaaaggggcgcccataagggggggggggggggg

SEQ ID NO: 667395 - DNA, 320 bp, Homo sapiens
cacatctcaaagaacatggaatagcaggtgcaaaggccctgagatgggagtgtgcctgagctgtgagagaagtgttgagcagaccagtgtgcctggtgtgagagggtgcaggagactggcaggagattaggtcaaagcagaagtaacctgctgaaatgactttggctttaaccctggggatgatgagaagcccgtggagtgttttcaacagaggaaggatatgatttgacttatgtttactagaatttctctggctgacagggtatgtgaggggcagcggaagaagtggctagaccagagaggaggtccttgtgataatc

SEQ ID NO: 667396 - DNA, 162 bp, Homo sapiens
  misc_feature (66)..(66): n is a, c, g, or t
  misc_feature (108)..(108): n is a, c, g, or t
  misc_feature (139)..(139): n is a, c, g, or t
  misc_feature (152)..(152): n is a, c, g, or t
tcacaggaacacctgcaaactggaagagaactcagtggtacttatgggccagggcaatggcgacanagacaccactgagttctcttccagtttgcaggtgttcctgtnaccctgaacaccctccttctgcacatggggncttgggcttgggncctttgaggg

SEQ ID NO: 667397 - DNA, 180 bp, Homo sapiens
atgtggcaacgtgcggctcgtggtgtgagtgccactagctgcctccgtggtttggtcacgtgtgcatcgcacgtgctgtaaatgtggcagcgcagcctgcgccaggctttttatttatgtaaatagtttttgtacccaacgagggagttctggtctcctatgcaatattactcagctttt

SEQ ID NO: 667398 - DNA, 259 bp, Homo sapiens
aaaagaagtttttcttgggaaaatcccaaaaggccaaaaaaaatgggttttttttcttgctgctgaaccaaagtagggggatggataggaaaagggaactaaaagttggtccaagtagaaggccgtcttttaatggggttttttatcccaggttgccatccctattatttggttgagaaaacccaaaaatggatattgggtactccccttttaaaaaaaaggtaataattttagctttttaataaaaaaaaggcttgga

SEQ ID NO: 667399 - DNA, 821 bp, Homo sapiens
gttagccaggtggcaatgaaaggatgttttaaaagttgaacttgaaaaggcaaaccggaacccggaaaccccaaaaaaggcaaaaacccatcatccaaaccagagtatagccagcatggtggctcaaaactgtaatcccagcaattcgggaagttcaagttggaagattgcttgagcacagggatttggaaccagcctgggcaacatagcagaccctatctgtaccaaaaaaaaagaaaaaaacaccagttgggagagtgtctccccctcatcattttcctgggggacagagcttaagtatgccctgacagggggattgagttaaggagatttgcatgcagcggttcattaaaatcggtggcaaggtccgaactggtataacccaccctgcgtggattcatggatgtcatcagggttttgacaacacgggagagatttccggtctgatctgtgacaccaggggtcgttttggtgtacatcgttttacacctggggagcccatgtacattttgtgcaatgtgagaaagatctttgtgggcaaaagggactccctcatggggtgactcatgatgcccgcaatatccgttaccggtgatccctcatggaggtgaatgacacccttcgagttgtttaggacactggcagattgctgttttcaagatgttcgacactggaaacctgttttatggtgactggaggtgccacctcaggaataattgttgtgatcacaagcagggagggccaccgggatctatgaggtgattccctgaaagctgcattggaacattgttgccagcggtcttccaaatttttggtattgg

SEQ ID NO: 667400 - DNA, 1007 bp, Homo sapiens
cataactctctataagcgattcctggtcttcacaaccgatctgtcctcctgacgtcgagacgtagatttattgcctagcttcagtccagcttaactgtcactgccatctagtgctcatcacatatcctaatagctgccttccaccgtagcatatacaggcgacggagagacctgtcaatagttgaatcgtgcatcagtgatacatctaactacccaaatacctgatcgcgatctggcaatactgcatcctgtgttgaggaccatgtagttagctgcgaaaaatagagctttcatcgtcgcgctcgatgtggtacatactcccttgtggaggttgagttgacaagatgatatactgacatttagaatctcgcacagtaacaccgaatagacttgggagataatatctgatggtcgaatgaaagtactggagccggataaaggcacgtgtactgtcccctgcctggctcgtcttcttgtgcttctcagttacgttatatgggccttcccatggatcagggagctccatatgcttcgctctgcgcactcttcacttatgtcttgtcgactgggtgtgggcttgcctatcacggtataggagattactgcccattccgataaaaatcccttccacccttactaattcgtcagacgcccctcggattacttttcttccttcttctcctggagtgacattaccctattctcaccagacctcctagggacccgacaagtatcctaggccaacccttaagtgccctccaataagccgacggtgttcctattcgctacgcaaactcagatcgtccctagaaaatagagggtctgcccgatactatcatctcatctaatacccggcgcggttgatttatcaaaagttatggcccagacacttgtactcgggaccccttaccggagggaacagaccttcactggagacggataacctcatatctcttgaatgggcaaaaaaaggcccgcttgcggtgtattgttcgtctgcctccatc

SEQ ID NO: 667401 - DNA, 773 bp, Homo sapiens
tccggggaacttccagtattatcttcacaatttttatgtaaatctaaaactattctaaataaaagactatttcaaaaatataatatcaagcatataaaaaaatgaacaaaaaactttgagctgcctttccaaatgtcatctccccttttggggtttatgatatttcttttgtacgaagtacatgtttactttaatgacttggaatataataaataataacagcaaaagttagcatttactgagtacctgctgtatgctatttatatctgttaactctactagcacagctctaatataaccctgatgataacaacagttgaggcaacaaggaacggacaacaagggttcacccatatctggttttcctctccttcctggacacatgggccatgactagttctaatgacatgttaggcaaaatggaatgtgtcatgtacaggccaagacaataagagctgatataacccatccacatgttttgtctcctttggaagtgaacatggaagctataaattgaggtgtcagaaccacaagatggaagtacgttggatttttgagtcaccacctggaggagagcttccctgcagcattgctggaatttgatgtgaactagatattcattttgatcgtgttgacttgaacctaattcaggcctaagacataatatatactgcataatatatgccgtataatgataatatatttatgcagcctttattgatatgagtagtggtttatctcagttttataataaaaatctttcaaagaaaaaa

SEQ ID NO: 667402 - DNA, 140 bp, Homo sapiens
atctattcattgcaccgcagtcattgagcacaggtgcagtacacacacacaagcacacacatcacagagcacacacacaggcacagacacgcacgcaggtcacacacacgcacactgcaactacgtatgtatggttcccc

SEQ ID NO: 667403 - DNA, 913 bp, Homo sapiens
agcggcgtcacctttcctccccaccagctcctgctccccacgacactaaatctttcctactaaacttgtctctttttatccactattttatcttttgttttattctttgtattatttacttagattgtaccgggtgacatgtcgtcaagaggtcggctctggttctcgtatggtttattatccgcgcgcctctgcgggggtggggtctcggcccgttgccatgtcattgccctctgctttatacgttgtgttcttctgaaaggcgcttgtcgccgtcttcctattagtcctgccagctcctgacttgcgcccgcgatgaggcgtgaggtccgctgctccgtgcattgcgtgtcttggtactgtcgtgttagcccctcacttatgagcttgacacccacggaaggtgctttcgagtgttccggctggcaccctgaggtaatgatccagggaagaagccatccatgggggtcgcaagctttctctccttgggtgttgcccctgaaccggtgctataacttgcaccccctctcttgtcttctaggcatagcgattaagaactcccgcacgcctggtgatcgtagtgaggtacctaactttctgattaggatgacactgcagacgggatagaaggcacattcaggctttcttcgagaggacatgcgtcctgggaatagtgagaataaacgggaccacaaaaagacgtaggatagtcgcacaataagttgcgttggacgagacacggaggtaggacgatacccatgcattgatgccgcgatcattggccaagagctgctctacatttatttaagcctgttggggcaccagtgagaatgggggggggccgcatggccagtttctgcaccatgaaagccaggggggatgaatttatcgggcattgatcaatggaagggct

SEQ ID NO: 667404 - DNA, 406 bp, Homo sapiens
ccacttggaatgggtgtatttaccaaaacaatgggactataggcctcatgcaagtcggaaacgatagggcaattattaaatcttaaagtcccaaaatgatctcctttgattccacgtctcacattcaggtcatgctgatgcaagaggtgggctcccatggccttgggtagtcctgcctctgcagctttgcagggtacagtccccgtcccagctgctttcacaggctggcactgaatgtctgccgctcttccagacgcacagtgcaagctgtcagtggatctaccattctggggtctggaggatggtgggcctcttctcacagctccactaagtagtgcccagtggggactctgtgtggagactccaaccccacgtttcctttccacactgccctagcagaggttcg

SEQ ID NO: 667405 - DNA, 1003 bp, Homo sapiens
agcgggctgaggcgcgggcgcccaggcccgaggcacggcgggcgctgcctggaaggcccgtctcgcaggcccccggatccggccgttggggccttcttccttctcagggagccccagcatggagctttgggccttggttcgggaaactgggactgggccctggctgctaggctggtccctgctgctgctttttggagcatgagagttgctcttccatttatcctccagttaccgcgcgcttttggtgccccgggactcaaaactgtggactccttttgcttagtttgtgaacatgagaagcctagactcttgccttccgataatacatgttcattttaatgaaccacttggtcgatacgcgtgaaagacaccacagaagtcttcatgggcatatacgttgatacatttaatcatttaattcctactgaacacttagatgatgccctaatttctaggatccaacctggacgaaatgaagtctggtgaggatttcagtgcaagtcacacaatggtcttagaggactcgttgaagaacattgcttcagcgataaggatcctattgctaggatctggcagtaaccagttctggtttgcctggttgggatagcaatgatcccaatttccaggatgccttgttcaaccagttgttgggtcttgacgatataatggatgaacggacgtggtcacaacgaacacgtggccaatgaatacccatttgattgccggaagcaactggactattgaccttaaacagcgaactttaaaggaccacagctacgcaacgacaccttcagctgaagatttctccaagaaaaaactcaccctcgtttacaggggcgaccacgcacacccagtaacgaaacgttttgggaacacgagcgcactacttgggccacggtttcaaaatgccggcaccattaagatacacccaaaaaggctttggcgaagccgggatctaatggtaaacgcacggtgaccaccacacaaggctccgttaagcacg

SEQ ID NO: 667406 - DNA, 146 bp, Homo sapiens
gccaaacggcgccagggtaataggaatctgcagaataacggcttagaggagggtgggcaggattggagaggaatggagagacatgtcacctcatatagaaacgcgtccaaatgtacaagctaagcagtggggaaaggaggaggggc

SEQ ID NO: 667407 - DNA, 678 bp, Homo sapiens
taaggtttgagggggaatgctggaaattgtaatggggtttggaaacttgtcatataagtaatgctagggtgatgtggtaggaagtttttccataggaggttgtatgatgttgggccgtagccggaaccgggggtatgctggtccagaattcataaaaaccaggggagtgttaaaatgtaaggtgtcctgggtggacacaaattattgttggtgtgtagatgtccacggggaggatgtggcgtcattattgttggtgccctcaggaagtattggtaatgtggggtggaggtgtgtgttaattatatatataaatgcgtgtgggggttatcccggtcttatgaaagaaataaggggcgaagggggcctcgcgggggtaaatccgatggttggaaaccctggagaactaagttcggaacttcccccttcggacagaggcctcccaagggggggctctcggggtgggctcctcggccctagcggtggtgggaagatttaaacttcacgtcttttatgtgcgccccgggggtctcctagtgtagtgcgcaggggaggtcatctccagaaggggtggtcccctgtgagtggtgtgggcacaacccggggggtggcaaacggttttacagggggcgccccccttactttcgcaaatggtgcgactagttaccacatgactggcca

SEQ ID NO: 667408 - DNA, 125 bp, Homo sapiens
ccaagattgtgccactgcactccagcctggggaaaagagcgggactctgtctcaaacaaacaaaaattaaaaagaaaagaaaaaaaggctgtttaagtgcaaaatgcggcaatgacttgtctagg

SEQ ID NO: 667409 - DNA, 222 bp, Homo sapiens
gtaacaggtacattataagcacattaacataactacactgtgctataaaacagtaatgcccttagggactaaggtatacatgctatcaacttacagtcaaaactcccagagcacgaggagtggtggctcacgcctgtaatcccagcactttgaggaggcctaggcaggctagatcatcatgaggtcagcgagttcacagaccggccatggacaatactggca

SEQ ID NO: 667410 - DNA, 430 bp, Homo sapiens
  misc_feature (12)..(12): n is a, c, g, or t
tgaaatttattnatccattttccctgtgaaaaaagaaaaagaggttttgccctaacccctttcagagcatttgggaacaccagcccagaagtgcattaaatgtatatattaaacttgggcaatgttgacactttaggatgctgaagcccaggtgtagtggcacacgcctgtaatcctagcactttgagaggccaagctgggaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagattaggccactgcactccagcctgggcaatagagtgagctctgtcttaaaaat

SEQ ID NO: 667411 - DNA, 133 bp, Homo sapiens
agtactatggtccttagtataaccttgctgcttcgaatcacctagatcttcaagcctagaatctgcctcagctgcttacattttgagtgaaatatgtcgagataaacatgatgcctacggtatccttattata

SEQ ID NO: 667412 - DNA, 283 bp, Homo sapiens
  misc_feature (15)..(15): n is a, c, g, or t
  misc_feature (21)..(21): n is a, c, g, or t
  misc_feature (36)..(36): n is a, c, g, or t
  misc_feature (124)..(124): n is a, c, g, or t
  misc_feature (180)..(180): n is a, c, g, or t
  misc_feature (213)..(213): n is a, c, g, or t
  misc_feature (267)..(267): n is a, c, g, or t
  misc_feature (277)..(277): n is a, c, g, or t
attcccacataaaangaacangttttcccggaaagntttctattactttagcaacagtccttcaagagactgagagaattaatagtatgatacgacagagaactcctactaaaaagagaggatnttttggaagatggagtgatccctgcaaaagatttgccagaaatcattctgcttatncggcgctccaagatgtagctatgacctggtccnctgaggtagtctttgtattaactttcacaaatctgttagcagcagcttatgcantagatatggngttttc

SEQ ID NO: 667413 - DNA, 423 bp, Homo sapiens
  misc_feature (6)..(6): n is a, c, g, or t
  misc_feature (51)..(51): n is a, c, g, or t
  misc_feature (85)..(85): n is a, c, g, or t
  misc_feature (99)..(99): n is a, c, g, or t
aggagnaggtgtctttggttctttatcccaggacttcttccccccttggtncgaggcgattcttgggacggacaggaatagaatntatgcccacccacntagggaagggaaaagcccctcagcccatgttcagaaaatcaggccgggtgcatggctcacggcctatagtcccagcactttgggaggccgaggcaggaggatcacttcaggtcaggagttagagaccagcctggccaacatggcaaaaccccatctctactaaaaatacagattagtggagagtggaggtgggtgcctgtaatcccagctaactgggaggccgaggcaggagaatcacttgaacctgggaggtggaggttgcagtgagccgagactgcaccactgcactccagcctgggcgacagagtgagactctgtctcaga

SEQ ID NO: 667414 - DNA, 300 bp, Homo sapiens
tgctgcaccacagcaaccgtgtatgtacccactacccctctgatcatttcggggatgataccacaccgtccctaaaacatctaggcttccctgttccccgcagagcctttgtcacattcctgatataacccccccaacactaatcctctggctcattccaggatgatatcatccccccacacttcaacccttcctgttttcccccactactacccaggtgtctcattactggaagacaccatctctctaaacccaatgtaccctgtctcccccactactacccaggtgtctcattcctgg

SEQ ID NO: 667415 - DNA, 266 bp, Homo sapiens
ctcccgcctcagcctgctgagtagctggaattgctggcgtggtggcgggtgcctgtaatcccagctacttgggaggctgaggcgggagaatcgcttgaacccggaaggtggttttattgttttcgaggcatgaccctgggggcttgtggcaagggctgaggtgtttggggagcagcagtgcaggaaaggccttactcagctgggcttgcaggtatgctcactcctgtctgaggctgcttccttgtttctagcctccgtttagaatt

SEQ ID NO: 667416 - DNA, 954 bp, Homo sapiens
gaactgggccgcgttgaaaaatgaaggcctggatttcagccacacgcagcagctgccgggaacagattacacgattgcgggcatggtggcttctcagtgcggcataccgctgtttgccccctttgaaggcaacgcctccgcctctgtctccagcttcttcccgcagaacatctgtctgggagatatcctgaaaaactcgggttatcagaactatttcgtgcagggcgcgaatctgcgttttgccggtaaagatgtgttcctgaagtcgcatggcttcgaccacttatacggctcagaagagctgaaaagcgtggtagccgacccgcactatcgcaacgactggggattctacgacgataccgttctcgatgaagcgtggaaaaagtttgaagagctttcccgctcaggtcagcgattctcactgtttaccctgacagtcgatacccatcacccggatggttttatctctcgtacctgtaaccgcaaaaaatatgattttgacggtaaaccgaatcagtcattcagcgcggtaagttgcagccaggagaacatcgcgacgtttatcaacaaaatcaaagcgtcaccgtggtttaaagataccgtcatcgtcgtctcttctgaccattagcgatgaacaacacggcgtggaaaatacctcaataagcaggatccgcaaataaacctggttttttggtcatttccgtggcgacaaagccgcagcaaagagacggctggcaggtgaaagctgtaaccacgatgggaataaccggcgccgacggtgctcgggacattctccggggggcaataactatctctcggacttggtcgtaccacggtttctccgggcaagtcgatgtcgggaatcttcctccatatccaagagcaaaacctgtgggttggagccatatttttccgcctgtgggaaattccctcaaagattagagtttccctcgc

SEQ ID NO: 667417 - DNA, 752 bp, Homo sapiens
  misc_feature (620)..(621): n is a, c, g, or t
  misc_feature (631)..(632): n is a, c, g, or t
  misc_feature (646)..(646): n is a, c, g, or t
  misc_feature (695)..(696): n is a, c, g, or t
  misc_feature (725)..(725): n is a, c, g, or t
gaagtccgccaagtacgcaagtggtggccccacgatttatcatctatatcacacttacattcacttcattcgaaactacacaccaggcacgctgtgccagatagttcatgctcgtctttgaatagaaaagtcatgtacctggcctcaactccacttgagaagagtctggccactgaagaccatcgcgaggattcatcatcatagatgtataaccaaaggacccatgtctacgtgacatgcacgccagttagtcacctcaaaactggtgctatctacacttaaaatccgaccacgaagactcttatatcagtagccctgtaaagactgactgagttggaatatcaagtcctcggacatatggcatacaaactacgcaagagagtcggtcgcttcaatatatatgtgtctttgtgagacatgtctcatcactatctcatatctcatcactcccgtgtctccacgcgagcctaatcactataactgaggaatcatattgtacatcttagcatacaagaattcaacgcctaggaggaaaatcaattgcggaggacacatttctattgcaccgtcacattctgaccatatgtccaaacctctaatacagcgagagctacgtaccnnttcaaactanngtgtcatatataangtacctatctacccggatcgccagtagacccataagttactcaattatnnttctccttgcaagagtgttggcccacaanttgtcaaagcttttaaagcatccagtc

SEQ ID NO: 667418 - DNA, 168 bp, Homo sapiens
gctgcctggttctggctgcggcgatgggcttgaatggcctggcgggcagcacgcttggtttccgaggatgagagcagcttgcggatcttcctggtctcctctgtggccattcaacgcctccgggccattcaacgcctccgggccattcaacgcctccgggccattcaa

SEQ ID NO: 667419 - DNA, 401 bp, Homo sapiens
taggtggttttatggcccccttaacaggggggatgcaaaaagcctcctgtccctttgcaaggaaggcagctacctagttggggtcagttagaccaacccccagggctggtccttgtttttcaggagcaaccagggcttcctgcattttaagtttgcgcggacccgttaaaaccaggtggtgttgggccaacccaacgggccctttcccaggggggccgagcttgtcctcccctacagtttacgccccctgccggggcagggggccgagcatttgggttttttgtaccccgtggttacgcaaaccccctgacagtgaccctcggccccctttttagtcctcggggccaaaattgttttccaaagccctcccatggcctaaaaaataaataagtttttgttta

SEQ ID NO: 667420 - DNA, 583 bp, Homo sapiens
gcacgagagatagagagagagagagagagagagagagagagagagagagagagagagagagagagagagagagtgcgagatagagccagagctatatatagacctatactctgttctgcactagcccttttcttgcccattccccatatttcaaataattttcttcttgcctcttttgctgttttctctattaattctcggaatcttttaaacctggagctccatttttttttttttttatgccttcacccacgtttttttttttttttttggacgcagcacctcattttttttttttctgttctccctgtctaaaccttcttttacccccccttggctcctgcctttttttttcttggtctctcctagcgggcctccccctcgcacggcgtttttgtgctgctgccctttctccccatggcccctttttttcccctccccttttttcccccctttttttttctccccttccagtttttcccggctctttttttccccccccttgttttgggcccggttttttttttccctctcccccttattgggtttcccctttttcctttccccccttctttgaggtggc

SEQ ID NO: 667421 - DNA, 401 bp, Homo sapiens
aggatcccctgtaggagcgctctgtgttgatgcatgtatgcccgatagggcacgtgtcactgatactcaaacactcattgatatgaggacagttgcctagagcatcttgtatacacgccactcttgcactgtagcttgggtcggcagcggaaggatcccagtgtattctgacagataaaatcggggaggcagttatgaataccactctcacactcgtcaatatctttgcagctattgtcctctgtgagctcatagccagtcccgcagctgctgtcccgctggcagcggaaagagcccactgtgttgatgcaggattctccaagccggcagctgtggctgcccgtgatgcattcattgacatcttcacaggagacaccatcagacagcagctggtagcccac

SEQ ID NO: 667422 - DNA, 116 bp, Homo sapiens
agcgacgtctgtgcgaggcgcacacgctatctgtgagcgtctagaatactacctgggactacttgtgacaggaaatgagcatcctgagaaatcacttagggtcctgtggactcagg

SEQ ID NO: 667423 - DNA, 1007 bp, Homo sapiens
acacaaacggtggagttgacatgggtggggtcggtgggtcaggagtgtagcaataggtactcagcgtggtgtgtccgtgaccgttggacatatcttgcctcgtcacactgtttttgagaccttggcatcctgtggtaggatgcccacttcttgtcgtgacgaccctcatgggtcagtgtcgaacagactcgtgttgcgaaacggtaatgtgggcagtgcgcccgtttaacgaagaacctagcgtgctgtctatcatatggtggacaggcaaagtatgagcgacgtagtttgctagcgtctattcagatgaagcgaactgaagtgaactctactcaccaatccctgagaactggagagtgcaccaccgtaggtactacatacctgggacggtctgtatccggtcgggtggcgtgttcaccgggagtgcatttgttgcactgccgacatatacttgatactcgtcgcggtagaataagctaacacaatcagtacaccatgttaaattgtgtgtccccaacagtgattcaacaaagggtttaatttgcccaattccctaagttttatccaaaacacaacgcgttgagagataattccaggcatggcggcctaggcgcccaatcggagcatagctccgtatgccaacaaggtaacttctccagttttaacactatgtggagagcaagggaataaagaaaacctgagaaaacattgggggaataacgcaggcgattaatttggggaaagaaagttcccccatatttagagcgttcgcccaccataatttctttcttaccccggcgaaaagattgtgtccaaaagcaaaattagttcacttaccccggattggagagacgacccgaggtataattatccaggggccccagttttaataacagaggggacgctggaccttattcaacacgaagaaataggttcgggcggataaacgatatggcgcatatggctttacacacactgggtatacccagaaatagcaaagatattat

SEQ ID NO: 667424 - DNA, 1092 bp, Homo sapiens
tggagttttcccaaagatttattggaagcagaaccaagtgggtgggatactgttgcgggaaaaaaaaaagcagtttaaatagtttccaaaatacctttataaaaggttttctagccacaagatttttcggtaacctagcattatgtggtaaacctttttcctaaatctggtaggagtgtcggtggctaagaactagagcttatcctatgccaaatctatctggcgctcctgaaaaacggcagaagggcacttgaaagcggttctcttaaaggatagggattcctttttaatcctggcgggtaatatatggctgcacggagtgtgtgcaatttttatccagggtcatcgtgatgctgagaagttccgtggataaccgtgtccatctctagttcacccgtctaaatcagaagtgtccttttggagtggggtatcacccagaagggagtgaatccagataagttacccctacaggttcggggcaggaacaagttgggaagaggcagagaactcctggatctcctcgccttccagagagtttccgtgtagggggaaatctcaagtgtcaggggccatattaaacattgagcaggtctgggaaatacacgaaagggtgacagagccaatttcctcctcacaatattcggaatctacatcctgaaggcggaccaaaagtagactggggaagtaaaggagtatacaaagggacaaagtactctctacacaatttcacacgcattatggggagttcaccaagggacttcaatggagttcaccatataagggggcatcccacttatcacacggtgacgagaacatgcaccggtgaactccccgggaaatcacaagagggggaacaccccgtagtatgacctgtgaggcgcagggaggcacacatgtccccgggaaggaggaacagcgcatcaagaaaggggtcaagcacacgttgagactatgggcaccaaaactatctaggcgacaccaggcaaagacgtattagagaacgaacccaaacagattgaaatatgtcagacaacgacaagacacggagcaggcggcacaccgtaatagtgacaacgatgtggaacaaatcct

SEQ ID NO: 667425 - DNA, 162 bp, Homo sapiens
cagaataagttagccacagagattcataataaaatacagcaattattgccatatactgtaataagatgcatgtgaactctcaatacatcttatagtactgtactaaaccttctagtgattatatgagcataaaatagctaaataaagtgattgttccccgct

SEQ ID NO: 667426 - DNA, 85 bp, Homo sapiens
cctgaaagaggaacgtgtggatgaagagatgcgcgaataaaggataaagaggatatgaattaaattaaaaataaaattgaagaaa

SEQ ID NO: 667427 - DNA, 277 bp, Homo sapiens
tcgctgggggctgaactgggcagatctcaatgcagagctatagcaagatttgatacaaacgtcgcacaagcagtgaggcactggtcaagaactactgggctgctctactgcttcagtgaaggacatggacaaggtcgagacattcctgcgcatggtgcagtgccgctctgtggagggcagctgtggcatctaggtgcccgaggtagcatccgtgtgatgcctcgctacagtgccctctcctggccctgaaggtggcagtccagttcgcccccagcga

SEQ ID NO: 667428 - DNA, 399 bp, Homo sapiens
cacaagggccaacacccatacctttcctagacacgccaggtgtgacagttaccttttctgactttcaggactctgagctcattgcgactatgatgcgctcctatatcaccagagttcacacagagtgatgaccaatggatccctgatattcagatatgacccaaatgggctttcatttaacccaatatcagatttttcagacacgagcttcccaaaatgtgctggacgcccctggaagtcagttagtgagaattaatccaaccacacaaatgagagaatcttattatttcgatctcactgagggcctttcttaatttaagtggctatgggtatttctttcataccttattggatcaatatccctctcttcattgtgcagatgtatcctgagattgcacc

SEQ ID NO: 667429 - DNA, 249 bp, Homo sapiens
agggtcctggagggaaggatgtggaactaccagcctctgctctcaagaagctcagatctgggcagggaacatccacataccagggctgtctgtcgggggggtggagggctgggggagggataagcattaggggaaatacctaatgtaaatgacaagttgatgggtgcagcaaaccaacatggcacatgtatacctatgtaacaaatctgcatgttgtgcacgtgtaccctagaacttaaagtataatta

SEQ ID NO: 667430 - DNA, 317 bp, Homo sapiens
catctgtttcttcgtgtgtacttggtaattagtgtctttcaaggggttttctattttctccaaggtgtcaaatgtattaacatgaagttttttagaatagtcctgcattatccttttgctgtcaatactgacgtcacctctctttcacagtatatgtaatctgtgccattataaaatgatgccttttccctggtagtatgcttggctccaaagtctatgttattttttcccccttatatttaaaatttttttggagatgaggtcttgctgcactccagcctgggccatagagccagaccttgtctcaaaaaaaaaaa

SEQ ID NO: 667431 - DNA, 759 bp, Homo sapiens
tgaccgaagctgcacttgcgcccgctccgccgcatgccgtgcccgcgccccgtgcgctctggcgggcgcgcgcccgcgtcgggaaggcaagctgacgcacccggggaaggcgatccttgcaggcggctggcgggtggcatcgagatctgcatcagcttccccaccgagtacgtgaagacgcagctgcagctgtgacgagcgctctgcacccgccgctggtaccggggcatccggggactgcgtgcggcagacggttcgcaaccatggcagtcctgggcctgtaccgcggacttagctccctgctctacggttccatccccaagtgcggcgtcacgtgttttggaatgttctgagttccatcagcaagcacatgcgggatgcccagggtacggctggacgagcacgcgtgtggcctgctgtgcggcctgggcgctggcgtgtgccgagtgccgtggtggtcgtgttgccccatggagaccatcacagtgaagttcatccaccgaacatgaactctcgcaaagcccaagtacacgaggattcttccacgggggttagggagattgtgccgggaaccaggggcttgaaggggacgtaccaggggctcacagccactgtcctgaagcagggctcgaacaggccatccgcttctatcgtcatgacgccctgtgcaactggtaccgaggggacaacgccaaaagtccatgaatcctctgatcactggggacctcggagctattgcaggcgcacccaggtctttga

SEQ ID NO: 667432 - DNA, 560 bp, Homo sapiens
  misc_feature (43)..(44): n is a, c, g, or t
  misc_feature (541)..(541): n is a, c, g, or t
ttctccaacccaggggggggggggcgccccccccccccccaannttttttatataaaaaaacacgcggggggggtgggtttttgggcccccccccggggggggggggtgtataaaaaaaataaggggtgggagggagccccccccccacaaaaaaaagggggtgggggtccccccccggggaaacacccaggggggggtttttttttttaaaaaaaaaactttgggaaaaaggggggcgccacatttttctcccccgcccggggggggaaaaaggcgccccccaagtgtttataaaagggaccaccaaagggggggccccccagggggtttttaaggcccccatcccttccccggggaaaaaaaggcccccccccccttgggggagggcctcctgaccctttcgggtccggggggggcccaatcaagaaatggtcttttgtcaaaaaaccctggcaaggttaattggctaaagtttttctttaccaggcaaaaagtaaggatgagaactgggccaaggttcagagcacgtcaagacctttnccacctcccagtgtagacc

SEQ ID NO: 667433 - DNA, 152 bp, Homo sapiens
gacccgtaattcagagggtagatctcaatgatatctcaccactaggcctggccactgtcattgcatatgcctacactggaagctcactctctccttgtatacaataggaagcattatttctgctactattatatcagatccactactctaat

SEQ ID NO: 667434 - DNA, 239 bp, Homo sapiens
cactgctgcagatagtggtgttaactgctccaactcttgtctagcttagtaactacaaatattatagcttcttgtcatatgaaggattacgaaacaaaaacaatccagaaattgatcggtttcattaggccaatcccatcccttctggctaaccagatgttacatcatgcagcatcagagatgctgttcatcagtcccacacacagatggcctagaaatcgccttctccacctcgcctt

SEQ ID NO: 667435 - DNA, 226 bp, Homo sapiens
ggtctgacagggaccagacgacatgtcgggcactggatgtctcgctgcggtttggatcacggtggacgtctggggagcagggtcgtgggtcgcccccagcctcaggcacctcgtgctcctccttgagcatctcatagttggggggctggccactgttgacaggagagaagaaggtttggacagtgtgattcatggtgtccagcgaagaccagcggcggtcgggtta

SEQ ID NO: 667436 - DNA, 388 bp, Homo sapiens
cgtaggggagatggatctggatgagagaaagtgagggagacagggtgaagaggagtgagggatgagagaaagggtgaggggatgaagaaagagcagagagagaaaaggtagggggagagagaggagaaaaagagggggagaaggcaggagggaggagataggcattagggcgagagccccctgcccgctttctgaagcgcatctctacctcgggggttaactcgtcaggcggtggctgttttttacactgtctacatctcttcctccatttaaaaacccggtgggcaccctaaagctgacttgactgtcaaactgagtggccccctgtgaaaacagaacccctcaacttctgccggcctctggagcccacaatcgaagggtaaccgga

SEQ ID NO: 667437 - DNA, 170 bp, Homo sapiens
tatcgcaagtatctaatattgtgacgatttgcggggctcgaagagaggcagagaatctccttgggagctcttgggtggcgctggtgcattctgtttcctcttgatctcaaagcacaatgtggcatttgagggaccaaaaggatccagggcacaccattccccctatagga

SEQ ID NO: 667438 - DNA, 314 bp, Homo sapiens
cacagacaagaaataagaaagaacaacaaacaaaaaaaaatccctcctttctagctggaacaaaatggtgcagttaatactgggcgctggaaaatgcagtagtgaatggtggaaccaagccggtcggtatatctgggtagctcttttctggcttggttttttcttaccagtattctgcctaacgttggcttctggtgagggttatatcgcctagcaagcacacccgggggtggtgaaaatagtatagcaaaaaagaaaaatcccgggttatggatgtactagattggtgtatgtcttttaaacagttctagttg

SEQ ID NO: 667439 - DNA, 158 bp, Homo sapiens
gctcgtggccagtggcagtgaagatagatcctccatgtcttcgtgcttcctgtggagatgctacagctagaggaggctgtgggagaggcctggactggtaccccacctccgtgttcctagaggattactctttcccctgttccacatgctgcccatgt

SEQ ID NO: 667440 - DNA, 103 bp, Homo sapiens
tccctggatctggaagccttggttagtgtctggaaagcagtgaacgagggccgtaggctgaggggcacgccagggcggcgtcatcagcctttgactgctccct

SEQ ID NO: 667441 - DNA, 110 bp, Homo sapiens
ccgcgctatcgtcttacgtacccaacgcatctgggcccaggccgaataccttgcgggtcgctgacccttgctgcccaaccatgtcgaagccgtgcatgcaactgcctact

SEQ ID NO: 667442 - DNA, 564 bp, Homo sapiens
  misc_feature (153)..(153): n is a, c, g, or t
  misc_feature (348)..(349): n is a, c, g, or t
  misc_feature (389)..(389): n is a, c, g, or t
  misc_feature (398)..(399): n is a, c, g, or t
  misc_feature (506)..(506): n is a, c, g, or t
ataagagcttgaccaatgactggtgaagatcacttggcagtgaagcatttttcagttgaaggacagttggaattcagagcccttctatttgtcccacgacgtgctccttttttttttttgaaaacagaaagaaaatgatctgtggggggggtntgtacgcagagttttcatcatgggttactgtgaggagctaatccctgaatatctgaacttcattagaggggtggttgactcggaggatctccctctaaacatatcccgtgagatgttgcaccaaagcataattttgaaagttatcaggaagaatttggtcaaaaaatgcttagaactctttactgaactggcggnngataaagagaactacaagaaattctatgagcagttctctnaaaacattnngcttggaatgcacgaagactctcaaaatcggtagaagctttcagagctgttaaggtcctacacatctgcctctggtgatgagatggtttctctcaaggtctactgcncccgaatgaaggagtacccggaacctgtcttttatatcacaggtgaaaccaaagacca

SEQ ID NO: 667443 - DNA, 233 bp, Homo sapiens
tttttccccgggggggggggggggggggcctcccatccccccccccccccgtttccccccggggccggtggcccccccccccctttggaagggccccggttttcccgggggttttggggggggaaattttttttttcgggggtgcccaaaccccggaccccccccttctaagccccaggttttttaagggggggggttccgtttttttaaaaaaaaccttttttttaggggga

SEQ ID NO: 667444 - DNA, 83 bp, Homo sapiens
gattaaaaggatgggacacttctccctcagcagaaaatgattcagtttatagaaaacctcccctcctctctcacaccccaatt

SEQ ID NO: 667445 - DNA, 508 bp, Homo sapiens
  misc_feature (392)..(392): n is a, c, g, or t
  misc_feature (395)..(395): n is a, c, g, or t
acattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaagatggtctctatctcctgaccttgtgatctgcctgcctcagcttcccaaagtgctgaaatgacaggtgtgagccatcagacccaacatttttttttttaatttaaatttaaatttttttcattttttttgagaggttttttttgttttggtttgttggtggtggttggtggttggtgctcnccnccacacaacaacctcgagattttttcaccccctgctgggatgattaattgtattattcttttcaacttattaaatctcccatgtattataatatgttttgtgggttataacat

SEQ ID NO: 667446 - DNA, 1227 bp, Homo sapiens
  misc_feature (362)..(362): n is a, c, g, or t
  misc_feature (369)..(369): n is a, c, g, or t
  misc_feature (395)..(395): n is a, c, g, or t
  misc_feature (405)..(405): n is a, c, g, or t
  misc_feature (412)..(412): n is a, c, g, or t
  misc_feature (414)..(414): n is a, c, g, or t
  misc_feature (416)..(416): n is a, c, g, or t
  misc_feature (420)..(420): n is a, c, g, or t
  misc_feature (426)..(426): n is a, c, g, or t
  misc_feature (460)..(461): n is a, c, g, or t
  misc_feature (464)..(464): n is a, c, g, or t
  misc_feature (483)..(483): n is a, c, g, or t
  misc_feature (499)..(499): n is a, c, g, or t
  misc_feature (506)..(506): n is a, c, g, or t
  misc_feature (517)..(517): n is a, c, g, or t
  misc_feature (519)..(519): n is a, c, g, or t
  misc_feature (526)..(526): n is a, c, g, or t
  misc_feature (559)..(559): n is a, c, g, or t
gcagagctccgtggagctgcacgcggcgggaggggctacaaatgcttgactgcagtgatgcatgaaccttgcacacgttcagctggaagtcacggccctgccgcttgatgcggcctggatcccgcacggggtcgaacgaaggctgaccccgttccacttcatatgtggagggattcttgagaatccatgatgtttcttacgcctttatgctaagaacatctacatctagggatatcctaggacattgaacgagacgtcccgtcatggtgccaaggggtatttttgtacagatgtgacatcgcaagtaaaacgaggtatgatgtcttgggaactgtcattggagtgagagaaagagatgcttnctacgtnatggagtggatgacagcactggagtnataaactgcntctgctngnancaangttgantactgagtctgtatcagctgctccaagtgcagcnnganagctcagcttaacctcacnacttaagaagctacangagaccnttgagcagaananaaagatngagatcggggacacgatccgagtcagaggcagnatccgcacatacagagaagagcgagagattcatgccaccggttactataaagtggacgacccagtgtggaacattcacaattgcaaggatgcttgagctgcccactatctacaggaaagtttatgagcagccttttcacatgctcagccctagagaaagaagaggcactatagcaatccaggcgccctggacctccccagtctcacgagttctgctgagtgaaaaacgccaagagaagttcctcatggagaacagagtgcagagcttttaccagcaggagctggaaatggtcgagtctttgctgtcccttgccaatcagcctgtgattcacagtgcctgctccgaccaagtgaatcttaagaaggacaccagcttccaaggcaattcatagtatattaagaagtgctatacaactgctgcgaggaaaaaggactgtgtctttccacgaaccgctgatggttctggataacctatactatgtacccggagcagaccatgctgcacgaatgatccccgggatcttcagcaggactgccgaagccatccctggggaagggctgcccctttcggccctcttgggctgtgttcgcctgggctccgcccggcttgcgacggtttctcagcagtcttgggcccggggcccgggtcctgtcgcctcgggctttcag

SEQ ID NO: 667447 - DNA, 381 bp, Homo sapiens
attgggctgtagccacttgattaaaatatatctttgtttatttatcttacatgcttgtatcttcagttgcgacggtgtagtacttcaaagagacggggaatgaaggctggatagggaggctggagataaatcagattcacaagttgacatgtcagacagtataaattatacatttgtcaatcatgtcaatcattagtatacaattaatactttaccataataagtactcatttctaatcctacgatatgcaacatgatgcattcagttatctgtaacgttgagaaatgtatctgtgaaatcagctcaccagttcaagtcactatgttggctacttggaccgtcttggtttcagcgagcatcgcgagtggctttcagacatt

SEQ ID NO: 667448 - DNA, 260 bp, Homo sapiens
atagtagactagaggtcccgccatagcaaataaactctttataatcacctagtctcaggtattctttatggtaatgcaagaacaacctaagtacagtccattataagtcatacttcttaaaaccatatacgaaacatttatgtaatgatcgtaagcagaagaagacacaaaattgatttttaaaataaacatgcatatcgataagtgcctggaatataaactgggaaaaacgtgaaaattactcagtgctgttgaacgta

SEQ ID NO: 667449 - DNA, 317 bp, Homo sapiens
ggtgatgttatcccaacacgcacacattagcacatagtagatgttccttttttaaaattttttatttttttttgacaggatctcactttgtctcccaggctggagcgcagtggcacaatcatggctcagtccaacctcaacttcttgggttcaagcaatccttacatctcagcctcctgagtagctgggaccatatgtgcgcaccaccatgcctagctaattaaaaaaaaatttttgtagggatagggtctcctatgttgcccaggctgatctcaaatgcctggcctcaagtgatccttgcaacttggcttcccaaa

SEQ ID NO: 667450 - DNA, 710 bp, Homo sapiens
ctagtagcattcgtttggcgcgcgagatcagtgtgtcagtgaacatggtcatagctcgttacctaggagatcctggtcaatgattagtgcttggatgctcgaccatatcgacaaaacgccctggtgagtagccgagctgtgtacatgatagcaaagaatcggcatatattggaggttcgtcgaggtgagtacactgggttctagtcaagcgaggagtccagagacggagctcggtagtatccatggttatcgcctccgcctctgagtaagaatgtggtcaccattagtagccgcagaatgctcctccggcagaaagatgggtgaacgaaaatagtatgaccggaatacgataagtgccagtgtgaatggctgcgagtggcccggtgagtcaataagccaggtgatagagcaagagagtgggacaagagagtacatattttcgcttcctcggtgtgatacgcctaatcacggaggcgtaagcacgctcgtacatggactgatcccaatagcatctaaatttattggaacgtcatgtgcacaagacccagcccaggagaaagggtaccaaaagcgatactcacacgcaaacttcacactccctcacgcttgagcaatcattccaatgacttctgtccttctgaaagttcaaagcacacaccctctgtaagcttccatggttcacacgtttctctgcaattcacatagtccac

SEQ ID NO: 667451 - DNA, 295 bp, Homo sapiens
  misc_feature (37)..(37): n is a, c, g, or t
  misc_feature (60)..(60): n is a, c, g, or t
  misc_feature (70)..(70): n is a, c, g, or t
  misc_feature (76)..(76): n is a, c, g, or t
  misc_feature (82)..(82): n is a, c, g, or t
  misc_feature (86)..(86): n is a, c, g, or t
  misc_feature (102)..(102): n is a, c, g, or t
  misc_feature (115)..(115): n is a, c, g, or t
  misc_feature (130)..(130): n is a, c, g, or t
  misc_feature (156)..(156): n is a, c, g, or t
  misc_feature (159)..(160): n is a, c, g, or t
  misc_feature (165)..(165): n is a, c, g, or t
  misc_feature (205)..(205): n is a, c, g, or t
  misc_feature (209)..(209): n is a, c, g, or t
  misc_feature (216)..(216): n is a, c, g, or t
  misc_feature (231)..(231): n is a, c, g, or t
  misc_feature (239)..(239): n is a, c, g, or t
  misc_feature (250)..(250): n is a, c, g, or t
  misc_feature (252)..(252): n is a, c, g, or t
  misc_feature (258)..(258): n is a, c, g, or t
  misc_feature (277)..(277): n is a, c, g, or t
aactctagcatccccctcccctttgaccctgggggcnagggttttttttgcatgtggggnttataccccncccctnatgaanacanagtgggagctaggggntgggtttcctcanaaggtggtttccccnccggcctgggggataaggacgtgggnccnnccccntgcccactcatgtcccatactgctttgcctggggtggggnaggnttgggtnttgtccccccacccngcttttgnggctggctgtnanactggnccactgtttttggcccttnaatgctgttggtctttta

SEQ ID NO: 667452 - DNA, 371 bp, Homo sapiens
ctggcattggagtctggatatctgaaacttggttcataggcagaagagacttgccttgtctcagatgagactttggactgtggacttctgagttaatgctgaaatgagttaagactttggggggctgttgggaagccatgattggtttcaaaatgtgaggacatgagatttgggagggttcaggggtggaatgacatggtttggctgtgtccccacccaaatttcatcttgaattgtagctcccacaattcccacatcatgggagggacccagtgggaggtaattgaaattatggggttggatctttctcgtgatgttctcatggtagtaaataaggggtttcccctttcacttggctctcataaaaaaaa

SEQ ID NO: 667453 - DNA, 164 bp, Homo sapiens
  misc_feature (88)..(88): n is a, c, g, or t
  misc_feature (119)..(119): n is a, c, g, or t
caaaaagtacaaaaattagccaggcgtggtggtatgccctggtagtcccagctgctcgggaggctgaggcaggaggatcacctgattntaagaattcgagactgcagtgagccgtgatnttgccactgtagtccaggctgggctacggagagaccctgcctcca

SEQ ID NO: 667454 - DNA, 788 bp, Homo sapiens
  misc_feature (120)..(120): n is a, c, g, or t
ccatctgctgtcgccgcgctctcaggctgaagagggaacagcaaatctttgccccctgactttggaaatctcgtttaaccttcaaagctggcgatgtcgagggttccaatggtcctccancctccgtgccagaaatgtcagagctggccccgtatctgagagttggtgctacacacagatcaaggtagtgaaattctcctacatgtggaccagtcgaataacttttatgcttttgcctgggaggaaatgggtgaagtcatttaatagagttctacatttgtcactcgagtgagcaaattgataaactgatagatggtgtttgctgagtaaaccccaaagggttaggagtgaagatagcatagagattaccgtgtcactttacctgttactggtcagcgtgtccaagagagatgagaggttcgggcaagaattcacattctccagtcctgaaatgccatgggagaagaaagcctacaggctaatggagagttcaatcggtgcatatagtggtttgctgcataggcaaacgactgggcgattcacagaaatttcactccgtcagagcattattgctttggaatgcaggcctaacgggacttctccctggatgacaaggcttaccctcttcttgcgaggctgagtagtagtgcaagattctgtcgaacattatctggtccagcaatatgcatgaacatggtaaaaggttcctgatgtgcccggctggcagatgagttaggaagactgttgggaataatccccgggttcaccgaacttgctgcttgcggtgc

SEQ ID NO: 667455 - DNA, 654 bp, Homo sapiens
  misc_feature (18)..(18): n is a, c, g, or t
  misc_feature (72)..(72): n is a, c, g, or t
  misc_feature (77)..(77): n is a, c, g, or t
  misc_feature (85)..(85): n is a, c, g, or t
  misc_feature (204)..(204): n is a, c, g, or t
  misc_feature (277)..(277): n is a, c, g, or t
  misc_feature (297)..(297): n is a, c, g, or t
  misc_feature (301)..(301): n is a, c, g, or t
  misc_feature (304)..(304): n is a, c, g, or t
  misc_feature (309)..(309): n is a, c, g, or t
  misc_feature (390)..(390): n is a, c, g, or t
  misc_feature (408)..(408): n is a, c, g, or t
  misc_feature (477)..(477): n is a, c, g, or t
  misc_feature (644)..(644): n is a, c, g, or t
ggagggggagggtctcanggcaaagtcgcaatgttagtggttagggcccctggttaaataagactgtaatangtacncgagtggngattgctgggcccgcgtggccaggtgttacgatgtggtaacttggaagttccgcgacgatggcatagcctatgagaaatacgaggatgaaagatgtacatctcagaccctttaagggcnaatatttaacatgggaagctggatgtaaatatctaaagagtgagttcctaaaaagcctatttttagctttacntacacacctgttacctggcntgcntgnacacntctttgacctgttcaaattaggactgggaaaagaggaaaaaatactttgttgaatcaactgtcctagccccactgcaaagnggaaaaaaaaaaaaaatngggccggggggtatttccccctgaaattatgtccccaagtagcatgctagacttcttccagcaggtacnccacacaatggtgacacagcctaatgtgtggtcagtgtgtgccacgttttctgcactatacccaggtttgatggcttgatgttaacttctgaaaatgtagctacagtgttcttcattataaacagaaacagaaaagaattactcaaaaaaaaatccttaaacaaaanttaactttat

SEQ ID NO: 667456 - DNA, 164 bp, Homo sapiens
ggttgaaacacagattggaggtatgggacatgttaccaaagcgcgtcatagacaatgctactctcacgttgactgatccagaaacaggggactgtggcacacccagaaagaacagtccagagatggaaaactatgatcctttgcactatgaaataagctaaagc

SEQ ID NO: 667457 - DNA, 112 bp, Homo sapiens
tcgtaagtctgggctcatattaccctcctgcctcggcctcccaaggtgctgggattacaggcgttagccacctatgcctggccaaatgcccccccctacggtataagttggg

SEQ ID NO: 667458 - DNA, 907 bp, Homo sapiens
catgttcgtgcgctgcgcgccctcgagccgtacacgctgtcttctcgcacggaaacgccgtgacctgggccagatgtgcagttctacattggctcggctcccgaatcattgcaagaatcttctcttacgatactcgggatagggcgtcagttcgggcaaagcccttcggagaaagaacttctaggcggaatcgagcgccgggtgcaaggcggttggggcaacccgggttatggggtgaggtccggagaactttatctttctaatggccagagctttggggaaactgtccccaaagggtacaatttgggccttccgaagggtatgaaattgtggcaggggtaaattttctcaatttcccctcttctgaagtggcctggttagggggggtgtggattttcgggtattaccgaggggaaaacatctttacgtggtttgggaatgggttttacccacgagcttgtggaccaaggttttctttaaagggtcacacctctctccttggtggtgggggccaattcacatgggaaccacgaggagatggaggtcaatcgagaattttcttcccaatgggctattaggggattgtacggaggcgtgtgttccccggagcgcggtggagccccctttggggttagcaggggggctgggcaattaagtgaaataagagctttagtgcaacaataccgtaagaagggactaaagacgaagtcatatatcttcaagaaacgtttccttaagtccgtgaagaacaacaagtttgttcttcacctcattatgtggggacgcagaagaacgcctctgtttgggcaagtgatctaacggacatgtaaagggttgactaccatgtaagagtggccaccttggggggtttaacaaaggggcgaagaattacgctttgttgtacagg

SEQ ID NO: 667459 - DNA, 548 bp, Homo sapiens
aggatccctggatggggtctgtactctctgttcccaagagggtgacctgggcttctcagcattggtgcctctgccctttgctctttcccctaagcctcttagtggtacctcctcagcctggatggggaggaggtgtgttcagtccgctgcacacggattgaaaacctgctgtgtgccaggccccaggtggggtgttggcactcccactgtgctgtcatcctgcgcaaatgatggcaactaaacccaactggctgaaactgaggtgcccaagcggtgagacagctctgacacaaccggatcggggcctcacctgatgatggtcaggatgccacctgtatgtgcatgctggcgttactctccatcagcttctgtctcaggtggctgtaccttgggctgccaggacagtgtccggcagaaaggatggccccctccctgagccaggtggcatgattctgacaggccatctggggatggggttggggtcacttcaatgggaccgcgtgaatgaagaggttgggtgggtcctcaggttgattgcctgacttaca

SEQ ID NO: 667460 - DNA, 211 bp, Homo sapiens
ataattttcatgatttgagaagccttcgcttcgaagcgaaaagtccatatagtcactccaggtttatggagggttcttttactattaggatgcccccccccctaccacacattcgaagaacccgtatacataaaatttagacaaaaaaggaaggaatcgaaccccccaaagctggtttcaagccaaccccatggcctccatgactttttca

SEQ ID NO: 667461 - DNA, 168 bp, Homo sapiens
acaagaatgccatagtcggaataaggataaatgccaaaggtttacctggatcaggattaagtttaaaataatacctaagattctttagccaataaattagagaaggcatgctgatgtaatacaactccatgtatagtaacgttaatcacatgtactgtcgcatgcgaa

SEQ ID NO: 667462 - DNA, 1539 bp, Homo sapiens
gtcgtcgtggtgatcagagagacggagtactaatcgcatttactcccatgtcgcttttcactgctgcaggtctagttgtccaccttctgttctccctttgttgtgggcgtcccgtgttagctacttggggtgcccctcctctcctctgcttcttgttgcaccccatctgggggtcccgtgttgttttttgtcgctttgggtcttcgccgaccacacattttttgtggcagttgtgtgtcccgtgaccatttggttctccctggtttttacagaccacagtggtgtttgggggactcactgttcgtggaccttcttcctccttagtggaccctgatgttggtggcaattgtgtgttgtggtatatgggtggtgccactccttgagacgcacctccggttgtgatgtctcggcgttgtatgttttgctcggtgcctccctgatatatggcgaccgtcctccgtcacgcggagatttccgtgtctgtcacgggcgtcttccgctgtttagctgttgtcccgtgggtcgcgtacaaaattatatggggccgcctgttgttcttgaaaccacccccccccccccgagtgatgagtgggatgggggcccgtggcacaccccacggggctgtgagatgtgacccccggggggctctttcttggggccgttctgtgtgttcttgttatccccctatactcccgtctctcttcccccctatgttaggaggccacctctggagcccctgataggggtcgtgggtctgtgggtcctgttgggcctgagagccccccccgggtggtttccgtgtacacagtgttcacccacgagggtttcttttcacagccgtccacattttgaattcccccccgggtatattgaagggcccctccccaaagcttatagataaatttggagaaaaattgaaacctcttttttgggagcccccaaatatgtctatatagagaattacccccacagagaagcccccacactggggtgggaaggaaataagtggccgtttgttgtccccccagcgtctctggccgctcccctcggtgttgtctggccctctcttcatacggcccctctcccaggggagaaatatgactcttgatgttgctttaatattgtctggcctcttgcgccccctgcaccaccacaggcacctctgttgggcctctgtttttataatagctggagaataaacccacaattgcccaccctacccaacctcgtgaattttaaaaagaaaccacgagaatgagccaccctggagaattgtggcctctcttggtgcccaaccttttcatccctgtggtatgtgtgatagtgtgtgagtgtgtgaagccccccgtttcattctctgtttataatggggtttgttgttcttccttttggtgtctcgttttaggtgcccctgcccctctcgctgggcttgtgtctcgggatccaacccttttggcccgttatgattttgaacctttgacttgaacccccaatgaatctttctcctggtgactccaattaaagtataatttttacccg

SEQ ID NO: 667463 - DNA, 624 bp, Homo sapiens
agcggggcgcggaggagcgtgcggaaccgaggctgcgcgcgcgcgcgcgcctctggccgcggcgtggggacagcgaggcgcactggggctcccagcgcggggcggcgcgccgccagcccgaggtctacggctgcgcccgacccaaggaagatgctgccgcacgaccgggctgcggggctgaacgcctgtcttccaggcgcagcggcagcactgccctcggcggtgtcggtagcggcactcggcgtgccccgggcggacgaagagcgcaggctgggtacaccttgtccgaatcggcggagttcgcagctagtgagggcggccggcggcccggatgggcgcgggttgcggccccgacgggtgctccggagcggccgggcaccgggggcactcttgagtgccggaaccgcggccgcagagagaacttggggcggtggccatgccccggtgcggagtctagagccgagtcggagcgcccgagggtgcccggccggtctgcggcgtcggggtctcacagtcccagacgccgtagttcgagtgcgctccagacaaagatggcgcggcggtccgggaagggctccgaggcccgatgcgttcgcttgccttctcctcttctggttggaaagg

SEQ ID NO: 667464 - DNA, 1458 bp, Homo sapiens
ggtcattggcgacggtcttgagacgagtaaggtcgcggaattgaagacgtgatgaaggtaatggagagttttctggcggttctggctctgggggggtctagatctgttgaagtatcctggtgattcaatagttgcacaatggagatgggatagaaagaaagatcaaatgagacatgtcatgagttggtcatagaatatacaggtttgtatagctagaagagcaccacatagattctcaataaattgaatggtagtgcagatgtttgattaacactacgtcgttaattctccgaggtcaattgaatttgtgatatcaagtactcgattcactcagtgtgtagttacaactaccctaggaggagatcagaaaaactaggccgagtcaatagtgatgtagaacatggactgtataaaatggaaatggtgggtctccgactacaatgggtgtacgggatgtaaatgattatgaaagtatgtaacttttatgtacaagttgaattaggtgtatgtattccatagatagaagcatgttcggtgcgtcatggtgggcaacatgagccatttggggttcggcttgtgggtaacaatttggatgctttggagtgtatgcaccattcacagacaattgggattacaaaaggaggttaaggttttccaatcgatgtggaattttccttatggcatgcaaaggcgcaacaattgagggaaaagtcccatggacattgaacctagtatgtgcaaatggccaagagcaggacggttcgaaagggtggcacatgttacacatttttataagggcaaaaaaacagagtgcccgtgcgtccaattttgttccaatacccattcgaataggaaattttacagaaagcgacttggtatttttgggcgaaaagggaaaaaggcacggtttacttaaaacttaattttgtggggacacccattgggacaattatccacgggaagaaggaaaggaaccttgtgttactttaacaatagcacgttggtggtccgtacctaactaaataagggggtttaagagggttgtggaaatcacagggtttatttgaaaaataggacttcgaaacgcgtcttgagggattatgaggacaacgggaacaaattggttgggaacaacaggttatttatttttggaaatctctcggaggtgagtactttacggaaggaagtccatggagtggggtggataattgtggaaaggccaaattcactcaatgagggggtaaagtggggaacttttatgcgcatggggggacagcgggcaccaggtttgggaaagagccaccacagcgttacattgactttggcacataggaatgttcccgggataacattaggattatcaacatccaagattggtgttcattgcagacagatatagaggacttgggaattgatattgatgtaaacaaaccataatgtcaaatagtagtacaagtg

SEQ ID NO: 667465 - DNA, 901 bp, Homo sapiens
  misc_feature (16)..(16): n is a, c, g, or t
  misc_feature (203)..(203): n is a, c, g, or t
  misc_feature (275)..(275): n is a, c, g, or t
  misc_feature (304)..(304): n is a, c, g, or t
  misc_feature (309)..(309): n is a, c, g, or t
  misc_feature (315)..(315): n is a, c, g, or t
  misc_feature (317)..(317): n is a, c, g, or t
  misc_feature (346)..(346): n is a, c, g, or t
  misc_feature (387)..(387): n is a, c, g, or t
  misc_feature (431)..(431): n is a, c, g, or t
  misc_feature (440)..(440): n is a, c, g, or t
  misc_feature (443)..(443): n is a, c, g, or t
  misc_feature (457)..(457): n is a, c, g, or t
gctctgcggggctacncctacgcctacccgcccatgccagccatggtgccacaccatggcttcgaggactggtcccagatccgctaccccgctcgcatggcatggagcgccgtccgaatcggcctcatctgggataactgggttactgtaggggtgaaatccaaatcagagctcccaagtgatggaccctccccacagccagnctacagaaccagagtctccaaaaaatgaccgtgaggggctcagtgagaccagattgtgtcatttggctccancttcatcttgcagagccagctgatctcanattgncaaganantagaagccacttgcacggtgtggcagagnctcagctggatgagaggctgagatgggtggccagcttgtanaccagtccctgaactgagctgtttacaggactggggaggtccanccagaaggnttncatttgtactctgnggggagtgactgggaaaaactccttccctgctgctgagtggaggagaggcctcatcccggtttgaacccagcatccgttgaagaagcgtccaggagcaagaatcataagagtggagggcagcaaggaaccccttccttccacagctccggaacgtggcttccgggccctctagttgacatgaccaactcgtgtgcgtgtcaataggggctgacaagcctgcagccgggaaccggccaagacaccctaccctctgtgaggacctcgggaagggggtctggccacagagcaacagaacgatgagattccggctgagagcgtcgcacacaaacagaaggtcaggagccacacgaaaggccgcccctcgcagggcacaagacccgacggataacgtaccaccggagagccacaagaggcacccgcgaggagacacgaggacaaaccag

SEQ ID NO: 667466 - DNA, 909 bp, Homo sapiens
  misc_feature (16)..(16): n is a, c, g, or t
  misc_feature (211)..(211): n is a, c, g, or t
  misc_feature (283)..(283): n is a, c, g, or t
  misc_feature (312)..(312): n is a, c, g, or t
  misc_feature (317)..(317): n is a, c, g, or t
  misc_feature (323)..(323): n is a, c, g, or t
  misc_feature (325)..(325): n is a, c, g, or t
  misc_feature (354)..(354): n is a, c, g, or t
  misc_feature (395)..(395): n is a, c, g, or t
  misc_feature (439)..(439): n is a, c, g, or t
  misc_feature (448)..(448): n is a, c, g, or t
  misc_feature (451)..(451): n is a, c, g, or t
  misc_feature (465)..(465): n is a, c, g, or t
gctctgcggggctacncctacgcctacccgcccatgccagccatggtgccacaccatggcttcgaggactggtcccagatccgctaccccccctccgattggcatgggaggcatcgccagtccccaaatcgcgcctcttccatctgccggaatacactggcgtctaccctgtgaggggtcgatccaatcagacccagtgatgacccacagnctacagaaccagagtctccaaaaaatgaccgtgaggggctcagtgagaccagattgtgtcatttggctccancttcatcttgcagagccagctgatctcanattgncaaganantagaagccacttgcacggtgtggcagagnctcagctggatgagaggctgagatgggtggccagcttgtanaccagtccctgaactgagctgtttacaggactggggaggtccanccagaaggnttncatttgtactctgnggggagtgactgggaaaaactccttccctgctgctgagtggaggagaggcctcatcccggtttgaacccagcatccgttgaagaagcgtccaggagcaagaatcataagagtggagggcagcaaggaaccccttccttccacagctccggaacgtggcttccgggccctctagttgacatgaccaactcgtgtgcgtgtcaataggggctgacaagcctgcagccgggaaccggccaagacaccctaccctctgtgaggacctcgggaagggggtctggccacagagcaacagaacgatgagattccggctgagagcgtcgcacacaaacagaaggtcaggagccacacgaaaggccgcccctcgcagggcacaagacccgacggataacgtaccaccggagagccacaagaggcacccgcgaggagacacgaggacaaaccag

SEQ ID NO: 667467 - DNA, 333 bp, Homo sapiens
  misc_feature (233)..(233): n is a, c, g, or t
  misc_feature (253)..(253): n is a, c, g, or t
  misc_feature (282)..(282): n is a, c, g, or t
  misc_feature (287)..(287): n is a, c, g, or t
aaacaaggtccttcaaatgttcctttggcccaaagctgaagggagtttctgagaaaatagttaccaattactgtcaggggtcatccctgttcaaaaggtaagcccctttagaattttgtttttgatagttaactgactaatcttacttcccccaaatatgtgaatttgctgcttttgaaaggcaatgtgaaaaagggagtattacttttatggccaaagttatttatttatanaaattttgggccagtgtccnttgaaaaccctgtaaaatatttaagtgtntaacnaatggccttgaagtgtctttaataaaggttcctttataaatgtcca

SEQ ID NO: 667468 - DNA, 319 bp, Homo sapiens
  misc_feature (17)..(17): n is a, c, g, or t
  misc_feature (150)..(150): n is a, c, g, or t
  misc_feature (153)..(153): n is a, c, g, or t
  misc_feature (263)..(263): n is a, c, g, or t
acataaggccgcattancccgaaattaatcccccctgggtgagattgtgaagaaatacatatatgtgtgtgtgtgtgtgtgtgtgtgtgtgtatatgtatatatatacacatatatatatgttttcttgtttttttcttgcgactgggtnctngctctgctgcccaggctggagtgcagtggcaggatcacggctttctgcagcctcgaacttctgggctcaagggatcctcctgcctcacccttccaaagtgttgggattanctggcatgagccaccacacccagctttcctttataatctgttgtatactttctagt

SEQ ID NO: 667469 - DNA, 184 bp, Homo sapiens
cttaagtcaacatagacgttacgttcaaaccatcagtccattcgtcactagccggtatgtgttcgggcaaattattttacctctcagcctaactgtaataactgcaggtaacactgcctcacgcgagtgtgttgcacactagcaacacacttggcgaacagcttagctattcactcgtggctac

SEQ ID NO: 667470 - DNA, 1007 bp, Homo sapiens
gacagaggctgatgcatggagtggccagtagaggtggtggagcagagcagaacatcttttaagtggggctgtatcaggctgggtttatttaaaagcaacaaaatgttctggttaagaaaattatctatgctttcagtgtaaatcttcgcagtgttctaaacaaagttcagtcttctgctcgcccctttccctcactgcatgtctagcactatggtatagaggtctcctggagcctcacaggctctgctgtatctccacttctcacctagccatcacacgccctgcaagctcatgcaaacacccttatcttcctacctgcggcagagttgttacaggttgcctgggcaggggcttaaacagtgccagccactgaccatcccaaagctatcgttaagcccacaccaggcgtcctaccacccacagcccactagacctgacatgtacacagtatccttgggctgctgcaggggctagtagcagtggtcctgaactctcttatcaagagcacacttctatgctggttgaatccctacaatgacagcatatgcgctgctgactctacttcgagacaacacgattacgcacattgccaccgctaggggtccagaaaagacaattgtccctacctaagacggacctggtgtccttaccaacgcctagccatcggcggcactggaaacaagcaggcggcgcgcgctcacccagaaagaaaacacaaagcaaactcaaccaccaaccaaccaccacacacccacacacccaccacacaccacagccaaccacgacaccacccaaccctgcaacacaaccaagaaaggcgaacgagaaccacccggaccactaacgaacacactacactctcaaaccagagatcacacaaacaacgaagctgcgcgactaaccaaaagagcacagaaacatgactgacacacgcaacaaacacaaaccagaaaaccacacaccacaccacaacaacaaaccaacaaggcaagaaaaaagaagtaacc

SEQ ID NO: 667471 - DNA, 200 bp, Homo sapiens
cactgaccacctgaacccacccaaactgatgcaaatccaaaccccaacaccctagttcctccggtagctattcagatgctgaccttgcggatggtgtctcaggtggagacggaacaggaggcagatgatggtggaggcagccacatgaacatgaaggggaatattttgacgccccatgtataatccccgggataagttgg

SEQ ID NO: 667472 - DNA, 346 bp, Homo sapiens
aggatctaacggcatgggtctgtacatagctattgtagcactactgtggagacacggacctgaaaaggaggtgagcggctctggagctgttggagcgcattgaacagaagtatgtggctatcagtgacttgtatgagcccattgatgatggttgtgagagccacgtgttctgttcctgctcctacgatgccaccacacactttgagacaacctgcaacgagctccaagacatctaccaacgcatgggtagcacggcctttgactttgagaacatgaagcgcaaacagaacgacgtctttggagaagctgagcagtgattgtgggcccctacagaacccttgcgggc

SEQ ID NO: 667473 - DNA, 131 bp, Homo sapiens
ctgctaggaggtatccctcgctattcatcggcaccaccacactccagcctgggcgacagagctagactcatctcaaaaaaaattaataagattctcaatcccaccatttccagggtgccgatgaatagcga

SEQ ID NO: 667474 - DNA, 570 bp, Homo sapiens
gacgagctggctcgggagaccgcgaggagctagacaaggtacgggtctcagaagagtgaggagagcacgacagtggtcatcatacagtctgttgaggttggagctgagtgaaaggacgctcagagagctgatacgtacagtccagtccgttggagatcgagctggactcgatgataaatctgaaggccagattggagaacagcctgagggaggtggaggtccgctacgccctacagatggagcagctcaatcgggatcctgcttgtgacacttggagtcacgagctggcacagagccgggcagagggagagcgccaggcccagagagtatgatgcctctgtctgaacatcaaggtcaggctggaggctgagatcgccacctagcgtcggctggtggaagatggcagaggacttaaatctgggtgatgcctagaacagcggtgactccatgcaaaccatccaaaggaccaccacccgccggcattagtggatggcaaagtggtgtctgagaccaatgacaccaaagttctgaggcattaagccagcagaagcagggtaccctttggggagc

SEQ ID NO: 667475 - DNA, 499 bp, Homo sapiens
  misc_feature (22)..(22): n is a, c, g, or t
  misc_feature (26)..(26): n is a, c, g, or t
ctgtatgtatggctgcctggancgcncgaattgtttggtggccactagggctgtagtccctgttcctactcctgcagctatgccgcccatagtaagtcctcccaacagcagggccagagttaatgacaccggctctcttttatatttggtttttctctcaaactggtcataaacataaccaggggagtggtaggtcacctttggccagagctcaaccaggacacagtaatcggtggtgaggttgagtacagtggtagataggcagggagtgagcccggtgttgcaagcccagatggtcccggcgggagcagccagatagtaggacccgtcgctcgccttctgggtggtattacacagggcctgatgggttttgggaactgctcctacgcagagtccctgcccggtcacttcggacagggtcagcttgtgttgggaggccacggagcagtagctggggcagaggtatggttggagtagtacctagcgcctataggtactg

SEQ ID NO: 667476 - DNA, 596 bp, Homo sapiens
  misc_feature (68)..(68): n is a, c, g, or t
  misc_feature (83)..(83): n is a, c, g, or t
  misc_feature (86)..(86): n is a, c, g, or t
  misc_feature (186)..(186): n is a, c, g, or t
  misc_feature (203)..(204): n is a, c, g, or t
  misc_feature (219)..(219): n is a, c, g, or t
ccctgcggctgcagtgaacttcgtgcactgatgcccccgggtcgctggggcccctgctccctggtggngcccttcccgccccntgngcctgtgtgtcctgcccctgtgtgtggtgtgtgctgggccccccgctagtccctccagcgccggggcgcttcccctgaccctttcggccctccccctcangtgccctcgcgccccanncgcgccccgcccggngtccccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctatcactactcctatatataccgccctaaacattgccccgcctcgcctctatgcgctggcaatcagggcactgtgctccttgtgcacgtctggtgccc

SEQ ID NO: 667477 - DNA, 171 bp, Homo sapiens
accaccaaaattttcaacctaattctgtaccaagacgccaaatgtttattaggagaggtgggggggggatacaagataccgatacaaactccctccgccacttttgcgaagtgccctggtatatatagagagggagcctgcgtcgccaatacttcgtagcagcgccgggag

SEQ ID NO: 667478 - DNA, 815 bp, Homo sapiens
  misc_feature (68)..(68): n is a, c, g, or t
  misc_feature (83)..(83): n is a, c, g, or t
  misc_feature (86)..(86): n is a, c, g, or t
  misc_feature (186)..(186): n is a, c, g, or t
  misc_feature (203)..(204): n is a, c, g, or t
  misc_feature (219)..(219): n is a, c, g, or t
ccctgcggctgcagtgaacttcgtgcactgatgcccccgggtcgctggggcccctgctccctggtggngcccttcccgccccntgngcctgtgtgtcctgcccctgtgtgtggtgtgtgctgggccccccgctagtccctccagcgccggggcgcttcccctgaccctttcggccctccccctcangtgccctcgcgccccanncgcgccccgcccggngtccccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacgcacctacacatggccacgcgcctagcctctaacgttgggaacatgttccttgtttgatccataggagatcttgtggcccaaataccagataacgctgtcctccgacatcccgctccaaagtgtgccacctccagtgagcctccttgtcatgcccggcctgtggacagccagcccccgccatcccttccaccccctaccaagcatgggggtgctgtgcaggcagccgtgtggcctgacagtttctaacagtcctgctgtccctcggctgagaataaaacccaattatggatgaaaa

SEQ ID NO: 667479 - DNA, 865 bp, Homo sapiens
tgtctcccttatgtttcgtgaccagaaccccgagtcagctggcggggagtagggcagggacgctatagctcagggagcggagtgcagattgttgcagaactggaggtgtcgcgccagtgagagagtggcgcaatagaagactcgagcctccagcgaggccgacaggcattctcgatgggggggctcctatatgtccagggttgaaactccattggggagagggacctcatctttcacaaaggccttcacaactacgaaactacgagttcagattgggaaagcagccgaaaaaggtgcctaaacgtcgccgaggccgccgagagcttgtccattcagcgccgttctgccctcaatgtgaggctcttcctcagagacttctgctctgagttcctggagaactgttacgaccggctcatgggatcagtcaccaggatcacctgcttcgggagaaagctcagagcgtgatgagacctattatatgtggggccttggtttctctcatggcttcaacgagctgctccttccgggcaggcctttttctgagaacctcaggtgtccgtaccttccacttcattgagcagaaagctcagcatctactatgagatgactgctggctgaccgcaatggagctgcttccctgggacgccgatgcgcttggctctgaaggctattccggggctgctggcccgggtgcaatgagcctggctatctccagatgcggtggcgggaagcagccgtcaatcccgaacaatatttctcttctgtggggtccgggacacatccggccttcggacttttggacagtcccccgctcttcttggccgggggaccccccctctctgaatgggcgcctctcgccggcctt

SEQ ID NO: 667480 - DNA, 450 bp, Homo sapiens
ctgactttgacattgtagctatactgtttccatttttgtttttacaaatcctttgggtctaattctgtgagcctacctatagcactggattaaaatgtctgcatcatttctttagttatccagttaacttcaacactgttgtaaaagtgtaaaccagcccatgacaggtttttgtacatgttaaagaccttagccgttcaggtttcatgagtattgtgtaaggcagcctgatgtagatgttctggagctggtcttgacccttgttgtctacactcccgacgtattttagttcctcatcacgatcatttgtccccagtgacccttttatcctttataggcacatttcttgttgtcgttgttgtggcagttccccttggcagtgtattgctttggcatctgtagtttgaatcagatatgaaaaaggtccagaatagaatatattttgatatt

SEQ ID NO: 667481 - DNA, 432 bp, Homo sapiens
tctacttcaccaagaaggaaactgaacactaggcagtaggcgatgccgtgcaggcgcggtggctcacacctgtaatcccagcactttgagaggccaaggtgggcggatcacgaggtcaagaaatctgagaccatcttgtggcaacatggtgaaaccccgtctctactaaaaataaaaaattaggctgggtgcggtggctcacgcctgttatcccagcacttgggaggacaaggcaggtggatcatctgaggtcaggagttcgagaacagcctgaccaacatggggaaaacccgtctctactaaaaatacaaaattaagccaggtgtggtggcgggctcctgtaatcccagctactcaggaggctgagacaggagaatcacttgcacctgggtggtggaggttgcagtgagctgagattgcaccattgcattc

SEQ ID NO: 667482 - DNA, 174 bp, Homo sapiens
tggtatagtggctggggtttgggcaatgatgacttcaggtacattagcggttgaaggggcagtgtcgctcgctcggttatttgtctcaggggtgggctggcaggcggtaagtgccaaacctagccccatagcgctcaaggtgcttatagtgatatgcaatggtctaaaaaaaaa

SEQ ID NO: 667483 - DNA, 116 bp, Homo sapiens
ctccccataggcattggcggcgtccaggacttgctgatccgtggccttcggggagacctctgcaccaaaagcccacaccactcgacggcaaaatgccatgagaacggttaccagag

SEQ ID NO: 667484 - DNA, 179 bp, Homo sapiens
gaaaaacgaggcaggcaaccagccaccaaggaacaacagcctcttgttaacagttggccaaatgagcttgtaaagtaaaccccctagccataaaacccctaagttggcccccccagttaaacggcaaaatcctgacttgcaaataaaccaaaaaaggttgttttaatttgttacatagc

SEQ ID NO: 667485 - DNA, 484 bp, Homo sapiens
acctccacctccctggttcaagcgattgtcctgcctcagcctcccaaagtggtgggattacaggcatgagccactgcactgggcttagaacactttcattacccctcaaagaaaccccatgccctttagcagtcacccaccttttctccctactcccagccctggcaaccactaatctacttatatctctatggatttgcctattttggacacttacgtaaatggaatcacgtttgtggcctttcgtgtctggcttctatcactttgtgtaatgttttcaaggtatgtaacaggatttcattcttttttatggccaaataatattttgctgtatggatagacctctttgtccattcatcagtggatggacatttgggttatttccacttttttggctattatgaatggtgctgccatgtacacgcatgcacatctttttaagatggtgatgttctcagtgcccttgggcacatacctaggagcg

SEQ ID NO: 667486 - DNA, 755 bp, Homo sapiens
tgtcagatatttacctgtcctgttgctttagggctcaagggtgcatcagtctggaagccttgcaataaaccatgtagatgaatgtcttgatggaccttcaatccagtgacacaactttaaacatgttctcgttgttccacatgtttcttgctacccaaagttaacaagcacaagcaaaatgttcctgcttcttccactttgtggagcaagcaagcattcatgaagccccatccaaaacattaaagaaatatcttcaaggtagatatgtcataagcctctttcagctcagcattactcattatgccaatcacaccttccaattccctcaacacagtccaacgccacacaagggcccaattcaaggccaactttgcccctatcctcaacaccgtcttcaaattcaacagcggccccaattcaacgcccgcccacaggggcgccaccacgtaacacttcggttctcccactttaatgcatccgttacacaccgaccaaaaaaggtatcacgagaacaactgggtatcttccgattgttgcgcgcgtaataacatgtttaacgctctcgtgttgggcacagactgccgaaccccgcatggggagttccacaccgtttcccacatggagaacaccatggctttgtccgcgtatccttcggcgttatgtccgactttaaccccgttggggatttatttatcgcacagactttattggggggaaacgaagacaaacacccgggcaaaacaggaacaccgttg

SEQ ID NO: 667487 - DNA, 452 bp, Homo sapiens
cctgcgagctcgtggtgccatctcatgatttgggccgtcttggaagggttcccttcctcctacaagatggtgtgtgaggagccttcaatacgcagcggggtgtcctgtgtccaactcttattcgtggcctgagtgtcatccccgccgttcttccaagagagagatgagaagatcccttcctgtagtcctcggctcccgggaagagacactgctctttgttcctttgcttgggctgtcggatgcagagaatctgagcgcagggagagtcttctgcagccccatttcctcaaaaatccaagctgaccaggtcgcggctcatgatctgtgctcaggaagctggaatctgaccctggtagcgttgggcccagtctctatggctgccgagcatttattacccgggcctccacccatatagtcaaactttagacttgaggctggaggaaagggaactg

SEQ ID NO: 667488 - DNA, 187 bp, Homo sapiens
ggcacgaggcccaaacccacttccaccttaccaccagacaacttagccaaaccatttacccaaataaagtattagcgatagagaattgaaaccttgcgcaattgatattggtaccgcaagggaaaggtggaaaattttaaacccggcttaatttaggcagggctctacccctctttccctcttccat

SEQ ID NO: 667489 - DNA, 1104 bp, Homo sapiens
  misc_feature (721)..(721): n is a, c, g, or t
aggctgcttcgcctggttaacaggaaacctaggaagatgttggtgctaaactgaaaagatttcttacagcaaaacctgcctcggccaggctacagaattccaactttcaacttgattcctagccgtgaacagactgtcctctgctcagactaaaagggaattataaacaagtgggaacttactctccagttgtgacttaacagttctgaacatacctacaaagggaaagtctttattagcaataattgcctgattgacagcacgccagagggaatgaaatgaggccttctctcctacctcccaggagtatgtaactcagatccttagcataaagatccccaggaataccactgctctaacccggtgaacattttttctaatgcagggttaggcttacgtctgaattccacaagacatcctccccctccagtacggaagttccaaggcacttgttttccagcatatcagcctaacctcagtgccttgaaatatggctttaagcctttgagaactgagatttcctgaaaccataggcccttgccccaggggtttctccacatccgggtgttaagacacctgatggcactgttggtttgtcccctataccccagaaaatctatcctgcaaggtagctacttcaatcttgtcattaaaatgtgtcaagtcacagctcgcaatgccaaaggaatgctggggcagtaagtgaggtggataagtgagnagggcctggtggtgaaagcggccaggaccagaatgctccagacctacagagctggtcaaggttaagtgccttaaacttaccaatcgtgggctcagttctcctttgaaaggagaaagtctttgtcctctacttaggcagctgggctagaagtgccttttgacttctaatgttaactaccctccaaagcctcctgggtcaagaaggctctcccaaactccaccctgttcttcctggtcagagaaccagtcagtcattctagtcttctagtccttaaactgatctgatgacttggaaccactaggatttcactgcacagtctggctttttagtctggaaataccctttgaggtctgtttcgcaccagctggatcacctgtttctgg

SEQ ID NO: 667490 - DNA, 841 bp, Homo sapiens
  misc_feature (627)..(627): n is a, c, g, or t
tcgtaaacggctttcaaagcaggacgagccactgttctgacagagctgtgtgccgagcgtgccacagttcgcactaagtaccgacaccaaccacccgtatcactgaaaattcagagggagccatgactgagaccaagtccgcaccacgcaggacgagccgctctaaggggctgcacgttgagcgcatcttcagcactgaaggtgttcatccttatgacgaggtgacctgggaacgccgtgatgtcgtgcaaacgaactggcgtaccggcgatgtggtttttgagcagcgcggggtcgagttccccgacttctggagcgttaacgcctcgaccatcgttaccaataagtatttccgtggtgctctaggtaccccggcccgcgaggatagcctcaagaccctcatcgaccgagtcgtcaatacctatgtgaccactgggcgtaagaacggttatttcgcgtctgatgacgacgccaaggtctttggcgaggaactgacctggttattggtgcaccagtacttcagcttcaactccccggtgtggttcaacgtcggtaccacgagtccccaacaggttagcgcttgcttcattctttcggtggatgactcgatggagtcgatcctcaatnggtaccgagaagaaggattcatctttaaggtggttctggttgctggtctcaatatttctcgtatccgttcctcgaaggaactactgagctccggtggtacggcttctggtccaagtctcctttatgcgtggtgctgatgctttcgacgggaaccatcaattcagcgcgccactcgtcgtgctgcaagaagggtcgtcttgacaatcgatgaacc

SEQ ID NO: 667491 - DNA, 976 bp, Homo sapiens
  misc_feature (292)..(292): n is a, c, g, or t
  misc_feature (390)..(390): n is a, c, g, or t
  misc_feature (529)..(529): n is a, c, g, or t
  misc_feature (542)..(542): n is a, c, g, or t
  misc_feature (577)..(577): n is a, c, g, or t
  misc_feature (612)..(612): n is a, c, g, or t
  misc_feature (655)..(655): n is a, c, g, or t
aaggaggtgcactgaaccctggcggttaccctcccatcatatgttacccagaattccgaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtgtgctgcatcagggctcaacacgatgcttgaaggtaacggccagtacancgcttttggccccgaccaatgaggccttcgatgaagatccctagtgagactttgaaccgtattcctgggcgacccagaagccctgagagacctgctgnaacaaccacagtcttgaagtcagctatgtgtgctgaagccatcgttgcggggctgtctgtggagaccctggtggggcacgacactggaggtgggctgcaactggggacactgtctcactatcaacgggaaggcgatcantctccaactaaangacatcctagccacacaacggggtgatccactacngttgatgagctactcatcccagactcatgccaagnacgactatttgaagttggctgcagagtctgatgtgtccacagncattgacctttgtcagacaagccgggctcggcaatcatctctctggaagtgagcggttgaccctcctggctcccctgaagttctgtattcaagagatggagaccccctccaatttgtatgccccatacaggaatttgcttcggaagccacataattaaagaccaggctggcctctaagtatctgtaccatggacagacctggaactctgggggcacaaactgagagtttgttatcgtattagcttggcttgagactgttgttgcggccacgacagaggggtggcgggacctgtcagatggacggtgctgaccccccaggga

SEQ ID NO: 667492 - DNA, 425 bp, Homo sapiens
ggggaaaaaaaaaaaaaaaaaattaaaaaaaaataaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaacccccttggggccttttggccccctctctttttaacctcggccgtttttttgctgggggccaaattggggctttttgggcccattcccccttttggggggctttttaccattccagggcccggtttttcaaacggcgggtctggggaaaacccgggtgttcccccatttaaacgctttggagtaaatcccctttttccctggggggctttttcggaaagggcccccccccgtcggcctttcctgttgccccctccttttggcgattgggtttgcccgcttttttttgggtc

SEQ ID NO: 667493 - DNA, 383 bp, Homo sapiens
tctgctcattcattcaaaaagtattcattttcgaggcctcctctgagacatctgagcccctctcttatcctactgtcagtgtccaaatccaggcctttggtcactctcgcttattccagaattgggctgtctgcttccacctctgaccttctcctgggcacgcccaacacagccaccagaatgagctgtccctgtgctcccttgctatgaactcaagtcttactaattggggtacgagagattacgattgctccccaagtgtggagtggatctcaggtggcccaggggatcattgtagttgtaacagagaaaactctttttgcctttcaagttctgtatatattttaatgtgtattcaaaaaatatataactaatacatcaaa

SEQ ID NO: 667494 - DNA, 233 bp, Homo sapiens
atactgttgacttgatgccgaatggtatactcaatgtcgctgctgtggatgacagctacggcacgcgagaacaaaattactatcacgaatgacagggccgttggagcaaggaatacattgaacgtctggcccaggaggccgagatgaacaaagctgaagatcacaagcacagggacacgggtgtcatccacgaaattcacttacagttcctatagtcccaactaacatgaaag

SEQ ID NO: 667495 - DNA, 1352 bp, Homo sapiens
  misc_feature (218)..(218): n is a, c, g, or t
  misc_feature (668)..(668): n is a, c, g, or t
  misc_feature (766)..(766): n is a, c, g, or t
  misc_feature (905)..(905): n is a, c, g, or t
  misc_feature (918)..(918): n is a, c, g, or t
  misc_feature (953)..(953): n is a, c, g, or t
  misc_feature (988)..(988): n is a, c, g, or t
  misc_feature (1031)..(1031): n is a, c, g, or t
ggtgctgtcctggatatgaaaaggtccctggggagatagggtttgtccagcagccctaccagtctcaaaactttacgagatcctgggagatcgttaggagtctcaccatcacacgtctagactgtggatcacagagacccgctacggcacgtacaagcatgcacgtgtccctggaggattgagcagagggctcggcggataggactttcacactatcnttgtcggccccgttagcaaaacggacggcgctggcggccatcgctgtgaccagcatagagagtggtcgtgtgagcatcgcctggtcagctaagtgtcaaaccattgagctggtctaagtgcgccgtccgttagcgaatatggtgggcaggcgagtccatgactgatgagctgaaacacggatgagcctcacctctatgtaccaggaatttccaacgagtcgctagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtgtgctgcatcagggctcaacacgatgcttgaaggtaacggccagtacancgcttttggccccgaccaatgaggccttcgatgaagatccctagtgagactttgaaccgtattcctgggcgacccagaagccctgagagacctgctgnaacaaccacagtcttgaagtcagctatgtgtgctgaagccatcgttgcggggctgtctgtggagaccctggtggggcacgacactggaggtgggctgcaactggggacactgtctcactatcaacgggaaggcgatcantctccaactaaangacatcctagccacacaacggggtgatccactacngttgatgagctactcatcccagactcatgccaagnacgactatttgaagttggctgcagagtctgatgtgtccacagncattgacctttgtcagacaagccgggctcggcaatcatctctctggaagtgagcggttgaccctcctggctcccctgaagttctgtattcaagagatggagaccccctccaatttgtatgccccatacaggaatttgcttcggaagccacataattaaagaccaggctggcctctaagtatctgtaccatggacagacctggaactctgggggcacaaactgagagtttgttatcgtattagcttggcttgagactgttgttgcggccacgacagaggggtggcgggacctgtcagatggacggtgctgaccccccaggga

SEQ ID NO: 667496 - DNA, 367 bp, Homo sapiens
ctgctctagaggatccaccggaagcacactgcaacatagtcgcgtgccatatgtgtgcgcgatgtgtatatatatatacatacacacacacacatatagatatatacatacacacacatatatatacacatacacacacacacacatatatatacacgcacacatatacacatacatacacacacacacacacacacacgtattagatgaagtctcgctttgtcacccaggctggagcgcaatggcgccatctcagctcagtgcaacctccgcttcccaggctcgagtgattctcctgcctgagcctcccgaccagccgggattacaggcatgcaccaccacatccagccaacttttgtattattag

SEQ ID NO: 667497 - DNA, 93 bp, Homo sapiens
  misc_feature (47)..(47): n is a, c, g, or t
acggttttgtgcacatgatggttccagtatgccatccagaagaaatngcctctgtacatgagcaccaagaacaccatactgaaagcctacgat

SEQ ID NO: 667498 - DNA, 152 bp, Homo sapiens
tcgttagctacctcccgaatagctagcaatacaggtgcgcacaccatgtctagctatttttgtctattttctgtagagattgggtctcactgtttcccgggctgatcctgaactcctgggctcaaatgatcctcataaagtgcaggcatgag

SEQ ID NO: 667499 - DNA, 330 bp, Homo sapiens
gagaccgtgctcggcgtaggcgccattggcacatatacaccatggaatactattcagccataaaaatgatgagttcatgtcctttgtagggacatggatgaattggaatcatcattctcagtaaactatctcaagaggaaaaaccaaacaccgcatattctcactcataggtgggaattgaacactgagaacacatggacacaggaaggggacatcacactctggggactgttgtggggtggagggaggggggaggatacattaggagatcacctatttatatgacccgtccctaggtattaagccagcatcattactattttaaggagc

SEQ ID NO: 667500 - DNA, 998 bp, Homo sapiens
  misc_feature (143)..(144): n is a, c, g, or t
  misc_feature (164)..(164): n is a, c, g, or t
  misc_feature (220)..(220): n is a, c, g, or t
  misc_feature (222)..(222): n is a, c, g, or t
  misc_feature (238)..(238): n is a, c, g, or t
  misc_feature (246)..(246): n is a, c, g, or t
  misc_feature (249)..(250): n is a, c, g, or t
  misc_feature (320)..(320): n is a, c, g, or t
  misc_feature (331)..(331): n is a, c, g, or t
  misc_feature (351)..(351): n is a, c, g, or t
  misc_feature (356)..(356): n is a, c, g, or t
  misc_feature (360)..(360): n is a, c, g, or t
  misc_feature (374)..(374): n is a, c, g, or t
  misc_feature (394)..(396): n is a, c, g, or t
  misc_feature (432)..(432): n is a, c, g, or t
  misc_feature (995)..(996): n is a, c, g, or t
gagagagtacaaggcgcaccagttgctcatcgatgctctggtggatgggcaggtggtagcactgctggtacagaatctgggagctgcctggcatgagtctgtgaaaggaggaggcaagatggcgtccacaacactctggctanngtggaaaacatggctgagtnccggcctgagatgtgtacagagggtgcccagcagggtcttctacagtggctgttgnangaggctgaaggcaaangatgcctntanngtgccaacaaactgtattgcagtgaagtgctggccatattgctccaggacaatgatgaaaacagggaatngcttggggagnctggatggaatcgatgtgcntatgncagncagttatccgtgtntaaaagacagcaatcccagnnnacggctgaggagcaggagatgatggagaatctgttngattccctctggtcctgtctaatgctttgttccaactcgtgaggctgcttcctgaatgggctgaagggtcttcagcctgatgaatctccatgctccagggcaaaccgaagatctcccggagcagtgcccgtgaaagtgcttggatcatgccaatgattggcccgaaaggcacagacaatggcataagttgttgacattcttggctgacgaacaactttcccctcttgatgaaatctcccagggaagatcaagaaagtgggaaccactggggaaggaccttggggagctgtatgacgaggctggtttctctgggaacttagaagggagctggtcccggtctgattgtgcatgggcatgagtgaaggtgccgccctgtgggggggcatattggggaaggggggggccaacagccagggaaaaatggcgggagaaaacaaggcggggagaaacgcgggggtgtggttcaaacaaagggggaatattcgtggggggcacacaaaagactagtttgtgggggacacgctgaatctttacttatttattttgattgtttgtttgagggnnag

SEQ ID NO: 667501 - DNA, 259 bp, Homo sapiens
  misc_feature (48)..(50): n is a, c, g, or t
  misc_feature (53)..(53): n is a, c, g, or t
  misc_feature (89)..(90): n is a, c, g, or t
  misc_feature (113)..(114): n is a, c, g, or t
  misc_feature (118)..(118): n is a, c, g, or t
  misc_feature (124)..(124): n is a, c, g, or t
  misc_feature (133)..(133): n is a, c, g, or t
  misc_feature (157)..(158): n is a, c, g, or t
  misc_feature (160)..(160): n is a, c, g, or t
  misc_feature (164)..(165): n is a, c, g, or t
  misc_feature (172)..(172): n is a, c, g, or t
gtggagaccccgctcatggtggccgacaccaggtggttgaggtccccnnnggnggggggggcagcttgagggagcggaaacagatgtcnnaaagtgcctcgttgtcgatgcannaggnctcatncgtattctncaccagctggtgcacagacagcgnngngttnnatggctncaccaccgtgtctgacactttgtgcgaggtcaccacgctgaaatgtgacatgatgcgtgatgggaactcctcgcggatactactgat

SEQ ID NO: 667502 - DNA, 1440 bp, Homo sapiens
tcaggagttgagaataacatatcccctaaagagccataatgggaaaggaataggcattcataatcgaagctcgatcgtgggttgagacatagttagactttgagtacaatcattcatcgatctacatgggtaatatcatgtaatctagtaaatgggtgtagaggatggaagaaaaagtaaacgcgaggataaaattctgacgtagatggaggatgtatgtatgcatgggaggaggggctgccttgacagttaatcggcaggggggaacattagtgcttctgaaatgtaacagagtgacatcgctagaagcgtgggtgatactaggatatgaataattcgcttatgttggatacgatagtagaagcactggagtcaaggatatcgtcatctgttagacacctattccaatttaagacttgccacacgcacgtggtacacattatgaacacatgcacgttaatccatatgaggttcccccctggaatatggccacatgcaggtatcactgcatccattgtgacctagtaaacaggcttgggcttgattgccagggaatttaaagaattcggctaagttctagagcaatgtatgagcggtgggaaagcatatatggacaaggctcttgggcataatttggtttcctcataggggaacacctagcgtgcgtaggttaaactcccgggaagaaactgggactttggtacccctttatcctggagcccatttaaaacaacaaaacttgtgggatggagggccaatatacccacaacttaaagattttgggaatctcgtgttggtccttaaaccttacaaaactatgtggggaacttgtcactcacatgaggaagctcacctatcccacattagctagggacgctagttaacaagaacagccacatgattcgaacggcggccaaccactgtcggttagcctgggacgatagtacccatgggaggtatgaaaccctgtgttaagagaacccatttttgagagggcttactgacttcgggccttgtaggaattcaaagggcaaaggacaaatttcagaggttcggctctaccccattggggcactcagggaacattagaggataattcgcggttggaacaaaggggggaatttcgttatagtgggcctttttcggccaaatgtattagggggtttgaacacacctttggcgcctagtaaggcgtccaacttacccgtgggagcacctcggggtagcaaatccgtttggtacacccccaggtctctattaggcgcgtattcggggagcaaaccgtaaccccaacgatggcgaaaaacaccaccttagaccacaagcgcaatttgcacagcgtggacctgcacaggtcccgggttcgaaatattcccctattaccccacctaaaaatattccccgtacacaccaactggggggggagccaaaacaatcccc

SEQ ID NO: 667503 - DNA, 467 bp, Homo sapiens
tcgagatggtgccatggcactccagccggggaaaaaaaaaaacctgcctgccagaaaactactaatgggctaactagggtaattaaaaccccacatttcttaaagtctcaatctttctcccatcaaatagtaaagtcaagtcttatatttcagtggtaaaacatcaaatacacaagctttggatccaatggggttttataagcatccatttaatattatctacaaataacaacggaccaagggttaataaggaggcaccttggaagcagacaaaaagcactctagacggagtcagaaaaagcatcatagggtcccgtcttctccatttcccattggtgatctggctttcatcccaggtgagatccaggggatccgtcataaatcaagtacttccggagtctcatggtggtctactgtgtacccagttccatggacccagttatgggcaaagagtaagggaaagctac

SEQ ID NO: 667504 - DNA, 144 bp, Homo sapiens
aaaaaaccccccccccaattttttggggttggttttttaaggaaatttcccgggggggcttttttttttgacaaaatttccaaaaatttttttttgggccccccccaattttaaaaatttggatttaagggcctggtttttcca

SEQ ID NO: 667505 - DNA, 175 bp, Homo sapiens
ttagtacgatctgagccacatctctgacctataccacagctcacggcaacaacagatccttaacccactgagcaaggccagggatcgaacccatgtccttgtggatgctagtctgattcgttaaccgctgagccacgacacgcgttcacttaagtgccgctacgcgcggtaccga

SEQ ID NO: 667506 - DNA, 112 bp, Homo sapiens
  misc_feature (3)..(3): n is a, c, g, or t
ttntcatcttgacgatcccatcattgctggctgcacatttctttgttctattttttttttttatttggaaacagagtcttgtcctgtccgccagcctgaagtaaagcggtgc

SEQ ID NO: 667507 - DNA, 1392 bp, Homo sapiens
cgaagaaaagtaaaccagcccccagtgaatcagcaggttatggaattccactgcacacagacggagcatgcagcaaaacagatgcaagcacagcagcaggggccatattgcagatacatgcagatgttaacaccacaaagggcttcgaagcatcgcaaagccatgcaacatctgtgcaaacaccaccaacaggccgccaccagcaggtagcggtcacgggtccactcaaacatcacacaagtgcaagaaacagaacacacaaagtgtcatatttctagtccatcatcaccacgtcgaaagtatcccaaagaacagcattcatgcctacaatcaccatcagcacttccatcattctaaaccatgcatcatcattccaggcatattcaccaccattcacacacatgcatctcatcttcacacatctgctggcccagctgcatgcggcgctctctacattatacaatggaactattaagaattggatttatagaatatgtcgtgatacacaaagtggacgtatcgcaaactaatctgcacgttacctaaaagggcaagattcctggcgaagcatgtacgtaacagtccatgctccatcattccacagcacagattcataaagcaacacacatcgaatggatcaggtacagatctgtccccaaacatttccagtctaaacgccaagccactcagccaagtgccctcgcagcattcatcaaggcatgcacacaccaacacaaaatccagacaaggataataacgtatgacaccagggcgacagcccctatcactataacccagggactccaacgcggcaactaccacattcccacgccactttcagatgactgcgtacctaggatgcttactaacaccttcaccattactgggtagcactcaggataatccgtggcgctacaatttacaaaattcgaggggcacatcgaagaaattcacaagacccagctgtgacccacctacacctcacaccgggggaatcaacttacagctgggtacaacagacactcaacacatcgacaacgcaccacgggagtaccacaacatacttacgatcaccagacatacaaacaacatcagtaagccgcaaaaacatacacaaaccaataccacacgacacgaacagaagctaaataaccgaccagaccgaagccacgcagccggcaacagacacagacgcagcggaaccgcaagacgatctacatacgccaacaacaaaccacaacgagagcaacctacacacacacgccgcacaccagccaccaacaacaccatgacacgcggacacaaacaccagaggcacaaccagaccacgaaaacagggaacaacaccaaagcattaaccacaacgaggaatcaaacgagcacgagaacaaa

SEQ ID NO: 667508 - DNA, 187 bp, Homo sapiens
cggtcacacacactgtgacagacaacagcccacgttgccacagacgcctcacaccatcacacgtggccacacgcacgcgttaccgccctgcaacccggcgtcccccgggccccgaggccccagcgtgctggcagacccacacagataaaatgcgcgcacgtggttaataaaattacctacaaatttg

SEQ ID NO: 667509 - DNA, 122 bp, Homo sapiens
cgacacaattactgaggtgcagagcgggtagggaagagtgctgtcagttgcacctgggctgctgtgggaagttgttgattcctgactggggcctgaggtggtggtgctggcaggtaacagtg

SEQ ID NO: 667510 - DNA, 84 bp, Homo sapiens
  misc_feature (80)..(80): n is a, c, g, or t
gaaagaagtcagttaacgtcacccaaaagcacaaaatgggattttagtcaaatatttattggatgatacagtgtttttanggaa

SEQ ID NO: 667511 - DNA, 175 bp, Homo sapiens
  misc_feature (89)..(89): n is a, c, g, or t
cgactaccagactctcttcatgacaccaatctttttgtggtgatcctagaccctggttgtaccagcaactgatgtcactatgacacagncctgccttcataggctcacagtctggtgtgaggggcagaaaaatacacgaatatcaaataatcaggtggtgggagggtaagggctc

SEQ ID NO: 667512 - DNA, 105 bp, Homo sapiens
tcagtacaaatgactaatcaaactaacctcaaacaaatgataaccatacacaacactaaatgtgacgaacctgatctcttatactagtatccttaatcattttta

SEQ ID NO: 667513 - DNA, 257 bp, Homo sapiens
cgcactgggaaactggcagtaggttttggtttttattttttgagacaggttctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagattgcggggggggcgggggtctccctatgttgcccagtgctcagagt

SEQ ID NO: 667514 - DNA, 210 bp, Homo sapiens
gctgattctgacaaggaaaggtatcagcagttggaggaggcatcacccagcctccgtgacgcggactcagcacacctagatgcacatggtcgcattccccagcagaaggaaagtcaagcagaatggtcgaaggagattgactcattaaaggaaaaagttcccaacagacaacagcctcttaactactgcagctttttaagaaaaagatat

SEQ ID NO: 667515 - DNA, 434 bp, Homo sapiens
  misc_feature (84)..(84): n is a, c, g, or t
gtggagcctgagaggtgacagtgctgacactacaaggctcggagctccgggcactcagacatcatgagttggtccttgcacccnccggaatttaattctctaacttctatcctcttatctcttcacatgtgtgcttgtgtacagagaagtgcatctagatgagatcgtatatgcatactgtgatgcagatttccgttacttatcaaaccaaagtagacaaggatctacgtcttggaagacatttactcaagtgaacaaacatcagaagtcaacgctgataagctcaactcacttatattgtatctcaaacatataaagcgtattgagccagaatgtgagaatatgatatagctcgttaaactgccagtatcgttgcgaattttccatatcagatgtacgagaaggtccatgaaccaggcgactgagacggaaca

SEQ ID NO: 667516 - DNA, 179 bp, Homo sapiens
tcgatcgagctcggtccccccattaatgaacaactgattctcacaaccgaagggagaatggacacctcccattgagggaaaaaaaaaaaattcacactctggcctgcttggcaagttcaccggttcatttccagcttcatcttcatagtttccatagtttagttcctatttcttttagt

SEQ ID NO: 667517 - DNA, 1352 bp, Homo sapiens
gcacagggtgccctagcagagtctttctacagtggctgttgaagaggctgaaatggcaaagatgcctttcgatgtccaacaacacgtgtagttgcagtgaacgtgcgtggaccgagtacttcgcgtccaggacaatgatgaaaacgagggacactatgcttggaggagctaggacctgggtacatcgcatgtgcattcttgcagtcatggttaatccggtgtttacagagagacatcgaatcccatgacacgtggctgaggatgcatcgagagtgatggagcaatctgtttgattacccatcgtgctcctgtcgtaaatgcgttgagtctccacaattcgatgagcagcttcgctgatagggcgacgggtctatctagcgtgactgaatctcggtgctcgagggaatcagaacgatctcccggagacagtaccctgaaagtgcccggacccatgccggtgatctggcccccggaagggcgacgaggagcaaacctggccgattaccggttgggtctgaggatttcctgtgggtttcaacggaaccgcagttctttgtcccccccttcttgttgagtggaatacatcctgcaccagggaacgtattccaagtaacaagttggggaaacctggtggacgaagggacaccttgaacgaaggcattggtgcttggtgcccgaatcccctgggggttttcgccttcccgttggggggaaaccccctggaatggaggtgtcgcaggcgagcattgtggacctccgaggggtttcctttggccgagttaaaggtttccactcttgggcacagacattgtagcacaggtgcacgagaaggcgtcggagcaagagaaccttcaatggggacgcattttgggattctccaacaaataatcctcggagtttgcccaacctgcgcagggggtggagccagggaaacagcaacaccgacttctggaaggggcggaacaataggaccccagaacctatttggacgtgcccggggactttatgggaagtattaagcacattgcgaaggaaagttacccacccggaaggcagagggagctcccattacccatacggtgcacggcccctggagaaattttgcgcgagcggcaacaaagggggattcatcccagggaaatggttatgagccaatacatatcgatgtggacctgagggaaacaattgtgcaaaggaccaagataatattctcgccccgctatgttggagcaaatggagaggtgtcccccaaaagatacaataagcacacgtgccaaagggaaggggctacgactcacagattggatagggcgactatttacatacaagagagatttgctgcaaaacaaccg

SEQ ID NO: 667518 - DNA, 871 bp, Homo sapiens
accgagggatgaggggttgactgagcgtttgagagccttagattctcccgaaacgccaggctgaggacaacgatgtcgcggtctccccctcactgctttggggccgacaccttgcctgggcgtgctctgcgtgctgtccgggacaagaacacggacccagcacccgaacgtgacgactttagcgcccatctccaatgtaacctcggcgccggtgaggtccctcccgcttggtcaccattccggcaccagaaacctgtgaagggtcgaaacagcctggcgttaccgtgtttaactgttcgcgtgtgttaatactacctgacttttggatagacactgtacacagatgagagctaattgtgtcaccataactcaacaagttaggtgatggtcaagtggggaacaacgacaagaacttctgttccgtttccacggccactccagtgcccaaacagccaattctacagctaaacccacagttcagccctccccttctacaacttccaagcacagttactacagtcagggtaccaaacaaaatacacactgtgaactcccaacctttcaaaaatcttgtggcgaagagtctacccttttgctgccagccagtttcattggagggaatgtcctggtcatggggatgtgcaagggcatgtaaactgtctttcttttattaattctgaattttaaggaaggaaaattaccaacatctgtaacgtagccattgaattaatagggactggggagtcatggtgtacgtatggagcaaaatacattgtagatgcccatgtgaacgtatcaggacttaacaagggaataggagtggaggcaccgaggaaagaaacttgcagaaaataattatgaggggggtaaa

SEQ ID NO: 667519 - DNA, 153 bp, Homo sapiens
gtatacacgtgggcatagaggatgggaatcaaacccaaggtgccatgagtgttccacatccagctgggttgctgacctgggtgaacatggtgtttgccatgctgtggatcaccatgctgtcctgatcacagttgagggacacaatgtttgctg

SEQ ID NO: 667520 - DNA, 477 bp, Homo sapiens
  misc_feature (176)..(176): n is a, c, g, or t
  misc_feature (213)..(213): n is a, c, g, or t
ggagtccgtcctctaagaaatctgccagggcctttgatacaagaacccggagtgccagagggctggccggtgtcaagggaaaaaaagttgttgtcttcacccttggggcatcacatgcctggatctgttgacaccccaaacccaacaaggaggaagcctgggaagtgcccagtganttatggccaatgtttgatgcttaacccccccaatttntgtgagagggatggccagggcaagggtaacttaaagtgttgcatgggcatgggtgggaaatccggggtttcccctgggaaagcttgattcctcccatatggggggggttttggagtcctgctttggggggtccgggtcctttcccccctgagattggggtccccccctgaaatcccccttgggggaaaggctgggcccccagcgggctttcaaaaagggcccgttgatcaatgaataaataaacgggcctatttttttttgcca

SEQ ID NO: 667521 - DNA, 244 bp, Homo sapiens
acgagctgtcattagagcaactccatcaagatcttcagcagataataaccaaaggctatacggtaagcataggcaatttcaagagcaggtacaatggactggatactagaaattttctatatacactacaacagaacataggcatcctggaatatcacatatctgaccttttgatgtattcctaaagtatggagaaatatagcctcgatccaacttcatgccttcaataatttctaattcatca

SEQ ID NO: 667522 - DNA, 267 bp, Homo sapiens
tttggaaaaaggaaggaatttgccccaagtccgtcagctgggataaaaacctgggggtcctgtcccaaaagtgcaggggctttttgctttgtagcaaggcagcagacatttttgagccaggcccccccacaggcccttatttggggggtgggtcatgatccccttttgcttggacatgctctcaggaaaataaaaaccctggagaaaccctaggcccttggcaaatgatttgagaccccttttgaaaaccatgtaggatgaatggga

SEQ ID NO: 667523 - DNA, 178 bp, Homo sapiens
ctgcccacgcccttggagccttccaccggcattcatgacggcctgcctgcaaacctgctggtggggcaaacccgaaaatccagggtgcccccccccggaggaaggtcccatggcctgttgggcttggctcggggcccccccccctgggtaccttgtgggaataaacaggcaaattaga

SEQ ID NO: 667524 - DNA, 1156 bp, Homo sapiens
actgatcgcgagcggtgcccttttgattactaattttttatcattattacacatataaatagtgatgtttccaaatattaaataaagttcagagattcttacatcaattatctcaaagtgaaaccagtgcaaagcagattcaggtgttatacaacaactcaatttattccccattcaggttcgtgcgtgctatatataccaacaggtggtgaatgtgacagaaaaattgtggaatggcagtggtgcctgtggtctccagaaacaagtgtccactcgtgtatatacagaagaatacacaatcagtgacagccacaagatattcatactatgtggtcgtgacaagttcaaatctcacaaacaaaactatactatatatgttctctgtgtgtttatatacatatgtgaggcagagccacaagtgtgcacaactgtgcacacacacaattatcagcggtgcgccaaaaatatatatactctaacaacgtcaccgcgccacacaaacaaaacaacaaacagacacacacaaatactcgcaccacacagtgcacagagcacccagaacaaaacactctgtgacaaacaaaatatgggagcgagagagggatcagacagacactcagtgaaacacaacgcataatgtgtgtgcccaatccaacccagagcgcaagagaggttacaacacaaagtatacacacgagaaaaaaatatacatagatcctcccacacactaagaggcgccatattaccaatctatacaattataagagaccacaaaacacccgtgaggaaatctcacaagcgaaagaaaaaaccgagtggaaaaaaaacacccccccatcaagtgtacagacaacaatatgagaaaagcatgtatagaaaccacacgtgggagagctagagccacagaccaaattaacacagcacacaacaaactcaaaacggaggccaaaaaaacgtgtgacacacattcaaaaccacaataaaaaaaacaaaggaactaagaagcatactaacaaatggagggaccacagggcacaaaaacactaccgctaaacacacgaacacgtggcaccaccaacaacacatacagcacgaccacaaaagaaggcggtcccatctgaccccccaaaaacaccaaaaaaactaacatcacaca

SEQ ID NO: 667525 - DNA, 279 bp, Homo sapiens
tccttccggccacggactcagccagccactacctggcagaggctgagcagttgtgccgcaacatcggcatcatcgaccacggcaccattgtcgagaacaccagcatgcgcaacctgctgggccagttgcatgtggaaaccttcctgctcgacctgaagaacaacctgtcggtggcgccgcagttgctcggctacccaagccggctggtggacagccacaccctggaggtgcaggtgggtaaggccatgggcatcaccacgctgtgcgtggccagaagga

SEQ ID NO: 667526 - DNA, 295 bp, Homo sapiens
gggggcctgggggtaggaggctttgttttcaccatttgacaagaacccaaagttggaaaggcttttgtttccttccaccccaaggggggggggggaacccaccccgtttttgggaaagccccttggaaaaaaaggttgatttttttttttcgaaaaaatttttccttttcccagggaggcttttttccctttttgccccgtttcccttccccctgcgggagaggggtttttttgccttcaccccgactatgtggcaagtttgtttcctttagtaaactgaaaattattgcttaga

SEQ ID NO: 667527 - DNA, 494 bp, Homo sapiens
ggtgacccaggatcctacggaactagcgaatatataaagatagcctgtgcatccaccaaacagtttgagaaacaaacattccaacttgctatgcatctttctttcatcccattttcctttcctttcttccaccaggtatccattattggactgtggtgtatctagttcctaaagtatatttactacatttattaaacatacaatattttcactgttttaggaattgtacatacatgttaccgttctgtgtatccttctgcaacttgctttcccctcttcaacatcatatttgtgatttatccaggttaattcaggtaatgatatatataatacttgaagaaatgctcatacctatttccctgtttctggtcaatacttgctcttgggtcctctagattaaaaggtactgactccagtgagcaagcgctgaaaatttcctccttttacttctgtaatgtcccccttcactatataagattaagaggtgagaaatg

SEQ ID NO: 667528 - DNA, 526 bp, Homo sapiens
gctgcgcctactactactcaagcataaagacatgaaggatgaagacttttatgatgatccacttccactatgtgaatggtcaatatattttcttatccttatgatgttctttttcttttttttttttgtggaaatgaagtctgtgctctgttgcccagggtggagtggaggggcttcattgcgggtaacggcaacgtcggcctcctggggttcaggcaatgtctcatgcctcagcctccacagtagtggggataacgggcatgcaccaccaagccgggctaatttttttgggtattttaagtagagatggtgtccacaacatgggccaggtgggtctcgaactctggacctggtgatccaccggcctcagcctcccaaggggcggcaactacgggcgtgagccacggggccgggccctagtttaatatccaaatatgggcttccagtgggtgctcgggtactaaaattattagattggaacacccttatacatagcaaccttgtgttccatattataactatttcc

SEQ ID NO: 667529 - DNA, 277 bp, Homo sapiens
attccgcgctaacattatacttcctccctaaaagcaggaccaagagaaggacatctgtctcaccatatctattcaacactctacggggcggcctagtcagtgtaatacaacagggaacagaagtacggggcatccagattgcaatgtgtgctgattcatttagggtgtcaacttgagtggatgaaggatactcgcgacctggcaacgcattgtaccggggtgtgtctgagagggtgtccccagaggaggttggtgtgtgcgtctgtgcactgcgtgg

SEQ ID NO: 667530 - DNA, 127 bp, Homo sapiens
tacactcttgaacctctcacctcgaaaggttggactatgtgaaagtctggccagaaagcccgtgtcttgtgacagtgtctctgattgtgtatacacatgtcacagacacgggctttctggccagact

SEQ ID NO: 667531 - DNA, 347 bp, Homo sapiens
ttccgcttttggggtctttgctgagaatctagttttttgttgttgttgttgttttgttttttaaattttgagaagggggcttaacttggtggccagggcggtcctaaaccatttttccaacttaaccttccaaagtgccgggaataccagccttaaccaattgggtccggcagaacttggattcctgaacggggttcttccttggcccaacagctttctggtttattcggaataattctaacccttggtttttttttttggattttaaaaaaaatgggggcgggtgtttaatatggtttcccacaaacagccacaaattttttggggaatgaatctcaatttaaccc

SEQ ID NO: 667532 - DNA, 331 bp, Homo sapiens
tgtgtattgtgatgctgatgatgatgcagttttcacatagctcactcttaactcagaggtctgtttgtgtttctataggacaagggctcagaggaatggacgtgcttagacatcggtgttcttcttcccagttcttgacccctggtcctgtctccagcccgtcttgggttatccactttgactcctttgagccgtttggaggggcggtttctggtagttgtggcttttatgctttcaaagaatttcttcagaccagagaattcctcctggcagccctgtgtgtgtcacccattggtgacctgcggcagtatgtacttcagagcacctactg

SEQ ID NO: 667533 - DNA, 327 bp, Homo sapiens
  misc_feature (34)..(34): n is a, c, g, or t
gcgagactgtctgaaaaaaaaaaaaaaaaaaacngtgtaaaattccatctgttctgaatatatacggacttttttcttcttgtcattattctctaaatgagaaagtataacaactttgcatagcattagctacatcatattaggtatcatacataatctagagatggcttaaagtatacgggaggatgtgcttagcttatatacaaatactgtgctattttatataagcgacttgggcatccgtggagtttggtattggcagaggtcctggaaccagtcctccatggatgccaggaatgactgtaacgactgcttggattacaagga

SEQ ID NO: 667534 - DNA, 216 bp, Homo sapiens
  misc_feature (202)..(202): n is a, c, g, or t
gaaaatccagcccagtggaggcacaaacaccaacgaagcacttctacgggcaatattcatttagaatgaggccaatagctcaagactgttagaccctaactcgcctagttgattatccaggtccttgatgaggatacaacagtgagcgaactgaaactgtccaaaaatcggaaaaaccatagggagagcaatcaaaacaacncacactcgctcagt

SEQ ID NO: 667535 - DNA, 283 bp, Homo sapiens
  misc_feature (45)..(45): n is a, c, g, or t
gtgacttctttcacttagtaggtttttaaggttcattcaagttgnactgtgtatcattacttcattactttttatggctgaataatattccactgtatgattttgtatgtctacttatcagtttgttaacccattcatcagttgatggacattttggttgcttccatttggggctattatgaataatgctgctacaaatattcatgtacaagtttttgtgtgaatacatgtttccatttctcttgggtatatacctagcagtggaatgctgggtcatattaca

SEQ ID NO: 667536 - DNA, 159 bp, Homo sapiens
cacctaacgatatatcggtcagtggcaaaccatacatacgacagtggcccataagattataataggagctgaaaaattcctatcacctagtgacatcgtaatgtaggtcatgccacacattgctcatgtatttgtggtgatgctgcctttcatcgatcg

SEQ ID NO: 667537 - DNA, 272 bp, Homo sapiens
  misc_feature (12)..(12): n is a, c, g, or t
tgagaaagccanccctgagcttctttctaacccaaattgcttctctaggcagtttataaataaattgaacttcaagattcaagagaatggcctttaagatttcttctaagtctagaatacaaagttctttttttcggccaggcacagtggctcacgccggtaatcccagcactttgggaggccgaggcgggcggatcactaggtcaggagattgagaccatcctggctaacaaggtgaaaccccatctctacaaaaaatacaaatttaagcc

SEQ ID NO: 667538 - DNA, 169 bp, Homo sapiens
actcagaaggtatatcaataagaggcacagaatctatctatttccaagtgcataggttactcctgatcacaactacaggttagaactagtcgttcatttgtcatctcattcctctatccaattccaacagatttatactggggactgaagactaccacattcttcgatc

SEQ ID NO: 667539 - DNA, 1034 bp, Homo sapiens
  misc_feature (36)..(36): n is a, c, g, or t
  misc_feature (968)..(968): n is a, c, g, or t
  misc_feature (1034)..(1034): n is a, c, g, or t
tatctttctatacctataacacacaacaaaaacacngtgatctggaacaatgggcaaaacgttgtgagcagggccggagctgatcataaccttccaggcacagctggttatggcggtcaggaaccccataggcgaggtgtgtggagggtgacccggacaaggtgctccggttgctgttcgtttgtggcgctatgcccacactattactagctcagtctcttcgctgtctgacagtctcctgcacatctatcgctacagtcaataactatattttctgaccgcggtggcgtaccaaggcaaatcagaattgcgaaatcatgaccataagacctgcaacccctcttcgcgctacttctgcaactttggccacacccaatgctcgactcctttccttcattcccttactcatactaagcacgatcgcctcgtaacgaattgctgactccgtactcatgtccgcccacaccgcccctcctcactccattccctcattctcgactcccatcgcctttgcgctctcgttcgtcgatccgccccacctattttgtcttattatccacacgcctctagattagagacttagtccccccgctcaccactgtccctcctcctcctctctataatgtcgtgcctcgtctccccgtcccgtccatactaccacactttgcccttatctgatttatctatctctgtgcactcgcctcttctccgatccagacttcgccaccgttctcctccctgctcatcgtctgcataattgggccgtaccctcaggtcttcttcctcttcactcgtatatattaatttcgaacaaattacttgcacgccccgcgatccttcaccacggggcgctcccagccgattatctgtctcggattctcccatcctgtctgagacaacgccgattctacactcgtccgccctgatgtaccaaccgaggtgactcgtcatccctctatccaaccatntccatccccctgctcagcgagcacgctgtgcccttcgtcctttctgttctcctctgtgcagatggn

SEQ ID NO: 667540 - DNA, 97 bp, Homo sapiens
gcacgaggcctgggtgacagatccagactggagtgcagtggaacgatcccggctcactgcgctccagcctgggtgacagatccagacttcatctcaa

SEQ ID NO: 667541 - DNA, 701 bp, Homo sapiens
gttcatcctttactatcatcgggaggacatggaagaggaccaggagcacacgtaccgtgtcgtccggttcgaggtgattccccagagcatcaggctggaggacctcaaagcagatgagaagagttcgtgcgctctgcctgagggtgccaattcctcgccccaataaatggacaccccaacgaaggagaatcaagccatgtacttcgagctactctgtccactgggaggaaagtgatatctagaagtgggcctctcgcttgggacacttacctgacacatgagtgacggtccagatccacgtggtttttctatcatgtgaactccgtatgttagtaggtctgtgcttccgtggtcaggtatcctgagcatgcattgatcatttcggaccctccgtggaaggacattgccaactagcaagcaaggaggatgacattgaagacaccatggaggagtctgggtggaagtgggtgcaccagttgcagtacagtcattcatggcaccaaccctagataactccatgatcgcatcagcatccgcatggtgggctcgaggctttcagattgtctgtgtgatcctcaatcgtcaatctctagtagccagggttgggatgcggtctgccctccaggcgggagcgtctgatgagctaggagactgtttgcgtcttcatgtcaagggggggtgttgtggggatttacttggtg

SEQ ID NO: 667542 - DNA, 299 bp, Homo sapiens
  misc_feature (1)..(1): n is a, c, g, or t
  misc_feature (146)..(146): n is a, c, g, or t
nacgcggatggatggggaggcatacccctcgtagatgggccagtgtgggtgacccgtcaccggagtccatcacgatgccagtggtacgggccagaggcgtacagcgatagcacagcctggatagcaacgtacatggctggggtgtngaaggtctcaaacatgatctgggtcatcttctcgcggttggccttggggttcaggggggcctcggtcagcagcacggggtgctcctcgggagccacacgcagctcattgtagaaggtgtggtgccagattttctccatgtcgtcccagttggt

SEQ ID NO: 667543 - DNA, 735 bp, Homo sapiens
tgaatgtgctaaataaaaagtgttattaaaaaaaaaaaaaaaaaatttaaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaaaaataaaagaaaaaaaaacaaaaaaaatttaaaaaaaaaccgtgtttcccctttggccccaagatctttaaacttgggccattttttccttttggccccattttgggccatttggggccatttcccctaaaggggggggtttttaaaatcccgggccgggtttataaaaagtcccctggggaaaaacccgttttgccccccatttaattcccttgagaaaacctcccctttttcccctttgggaaaatttccaaagggccccccccaaagggtctttccacaaggtttggcacccctataaaggtccagggaaaattgtgggaaaaaaattttttttaaaacccccttggcacctttttggaaaaaacccccttttttctccaccaaaaggccccaaatttgggaatacccctcttttaacccaataggataccccccggcactgtgttaaaggtcgtggccccctttgggcacagagggccacattttaaaaaaaccgggtctttcccccctatagggggaaataaccccctattagagggctattgcgccacttggtgacccatatcccctagaccccccttttaaact

SEQ ID NO: 667544 - DNA, 755 bp, Homo sapiens
tttttttttttaaacaaggagttaacgttttattttctctgtgcttttgcaacattactcaggaccaacataaaaaagaaatacctccggtgtgggaaaaagttactttaaaaaggggaatggagtgggggtgctgaaagggattagtaccttgtgccccaaggagctacagcatctctgatgggtccaaggatatagaaaagtattttgggcgacaattgtacacaggaggacaggaagattgtgaatttactggagggagaggtgcctcgaagtgggccctcgagggggaactggtggcccggggcagtgggcttctgggtgcgagggagaggcccccgttgttagccatagggtgggggttcgtgcaggcgccagtgtacccatggcggggggcatcagtgggagtgaggtccacgcataccatgcggaggcataggacctgggttgacccctgggcgagatccgaactggaggccctcggggcgggcatgcccatttggaggacggcccaggatgaggcatcccaggtgggtgctcggggccggttggctggcccccagagcctggggtcccgctgtggggattgtcctaagccatgagggcccatggtgtgcaacgctgcgtctggaacatccctggatggggcatcccacccgcgtgggaattgggtgaaggatgtgagttgtccctttgaccctgggtttgtcttgcccctggggttcctggcgatggggggcaatgtcctgtgaccg

SEQ ID NO: 667545 - DNA, 1049 bp, Homo sapiens
cggttcactgaggcttcctctgtgtttcacttacccccctatcggaaatcctgatactactgccctaggccccacttgctgttgtttttcccatagcacacgtgtataccacaactacctggcgagctctcatacttcctattccttaatttctatctacttttggtgactccgccttctggcttggaatcaggcttattattcgcttctacttctttttggccccactgttatcaccggtatgaccttcatctctatggtttaaccatacgagagttccagggtcacggggcctaatgtttgttagcaagctcgtaccagtgctctggcctctcattacttcgacgtcatcctgtctagcaacactcagcatggcaagtattgcggctagactgtcctgctaatgaccactgccggttccctgaacttctcctctggcattcggtctcaagctgctaggcatgatatagctctacctatccttgcagcttttgcgatccattagcacgcgccctagcccactgggaggtgttactgcgtgtgcccgtgctatcgaaacccatgtgctatatagtgcgcagcagcacagtgtggacgccaccatgagaagagagctagttatggccacagcatggtggctatgactcctcggggaacatgtggtggcccgctgctctgaggtgcgccaggcctctgccttgccgggaatagacctctaactatctgcgacagttgcgccgacacctgccatgtgttccagcaccgcaggcctgacctctatggcaatctgggtcactcactgtcgataagacgtgacttctgtagagttatagactcatgccacgctcctcacccccacaccgtgccactatgagctagtgctcatgtgacttggaggcaggactctacggcacagctccccttacttggagaaccttgatctctcttgatggaacatcagatggcctgtattgggaaagaaactcccacctgtagcttcactatgaggtcagactgcagaggtcagaaaggtggaatttatatagtca

SEQ ID NO: 667546 - DNA, 755 bp, Homo sapiens
gccacgtgcccacccccccgcgcgcgggcggattaaactccccctacgtatactctcgcacgcgcgcacacgaaaattctttttccactatgggggtgttttccctcgtattctcttgtgggggacaccacgcgggggggcgcccccccccctactctcgagatggggggccccccccccccacatgggcccccccctacacggaagggtgtctcgcacacctctcctctctctctcgggaacacacacccccgtttttctgagagagaggggccactctggagattatagtgtgtgtccccccacacactgttttcacacttttgccctctagagggcgtgagagagtagcgcacacgccgcgcgcgcacacacaataggggcgcacccccacctcttaactctctcttgggagactctccgcggggaactctttgggtttccctctctctctctgcgccacaaggagaccacgcgcacagctgggtggagaagagagagagagaggtgtcctccacctgcggtgaacacataactgggttcacaggcacctaggcacttggagagagaagggtgcacacacagagattggggcacacacggagaggagacccctcgggacccgtccctcggggcccacaggccctctcacacacacaggagcccaaagccacgcccccaaaggagttacaggaaagggtttggtgaattaagggacccccaagggcacccaggattaaatttttttgtgacca

SEQ ID NO: 667547 - DNA, 633 bp, Homo sapiens
  misc_feature (49)..(49): n is a, c, g, or t
  misc_feature (55)..(55): n is a, c, g, or t
  misc_feature (59)..(59): n is a, c, g, or t
  misc_feature (61)..(61): n is a, c, g, or t
  misc_feature (145)..(145): n is a, c, g, or t
  misc_feature (231)..(231): n is a, c, g, or t
  misc_feature (235)..(235): n is a, c, g, or t
  misc_feature (249)..(249): n is a, c, g, or t
  misc_feature (272)..(272): n is a, c, g, or t
  misc_feature (294)..(294): n is a, c, g, or t
  misc_feature (326)..(326): n is a, c, g, or t
  misc_feature (633)..(633): n is a, c, g, or t
taaccgggaggtcgaattggcttgggctgctgatctcgcgatccccgcncctcgncctncnaaagtgctgggattacaggtgtgagccaccgtgcccagcctaatttttgcatttttagtagagaggaggtttcaccatgccggncagggtggtctcaatctcctgaccttgtaatccgcctgcctcagccacccaagtagctgggactacaagcgctgccaccacatccngctnattttttgtatttntagtagagacagggcctcaccgngccagccaggatggtctcaatntcctgatctcgcgatccccgcgcctcggcctnccgaagtgctaggattacgggcgtgagccactgcacctgccaagagttttaactataaggctgctgaatgaggagataggagcaaacctcaaatacacctccctgaggagttcggggataggaattttaaggggattggaatgggccatggcatgaagatcattgattgctctaagaatgcaagacaaaatcgtgggatggggaaatgaaaaaactgcattctcatgccaatttaatgtccctgcgggattttctaaactggtttgtgtcagctgaattcaagatctggaaaacatcttaaaccatn

SEQ ID NO: 667548 - DNA, 109 bp, Homo sapiens
  misc_feature (17)..(17): n is a, c, g, or t
  misc_feature (82)..(82): n is a, c, g, or t
  misc_feature (98)..(98): n is a, c, g, or t
  misc_feature (100)..(100): n is a, c, g, or t
gattggttgctggatgncggacagggggtgcgatgatcgacgtcgacgcattggtgagccgtggaatcgatgggttagaggngcctaacggccatgcnantcacccgtt

SEQ ID NO: 667549 - DNA, 1075 bp, Homo sapiens
gagatggatagaaggcgtcaagaagctaaaaaaaaatcatatagacacggactcgacacatagaagaaaataaataaacaataaaagaaaatagaccacacgtagcaccaccgcaaggagaacgagagagagacaccacgcgacaccacacaaaagcggacatacaacaacccggcacacacaggccagcgaccgcacaacgcgcaccacagcacacgaaaagacaccacacaaccagcagcacgacagacccacgagacgcaaaagaagaacggcatacaaaaaaaagaaagaagaagagaaacaagggagcaccaagcagagaacaaagcgaaacagaaaaaagcaaaaaaaaagagaaaagacacaaggagacgaaaaaagcaacaaaagacgagcacaggcggagaacacacacaaagaaaaaaacagacacacacaagcaaacaacaacgacaacagaagacaacgcacccgcacaacagacacaggacaaagcgcgcaaaagggacaaacgaacaagcaatacagcaacaacgagcaacacaacaacacataaacgaacaaacaaacacacacacacaaaaataacaaagcacgaccacagacaccaacacaacgcagcagcacacactagaaaagatagacaagcaacaacacagaaaagaaagagaaaaatagagaagccgacaacataaagaagcagagcacacacacaaaaaactagacaagatgacacacacagaaacaaaaagagaacgaaaaacagaaaaaataaaagcaagcaaagagcagtagtagaaacaagaacagcaccagaaaagaccagaaagacaaaacacaagaagaaaagaagcaaaacacaagcagacaagacagacaacgcaacagacaccaaagagagagcacaacaaacgagaacaacgcaacacacgaaacgagaacaacaacgacagagaagagaagacaacagagccaacaaagaaaaacacaaacaaagacaaacgcaaagacaaaaacaacacagacgctagcaacgcagaacagcaacgaaaagaagcagaaacacacacac

SEQ ID NO: 667550 - DNA, 553 bp, Homo sapiens
gccagaatcctacgtcagagtcatatgaacaggtgtacacccatcacacccaaggataggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttcaacagtgccattgtttagccagtgaagcctccaaccctaagccactgggacggtggccagagatgccagcagcctctgtcgcccttagtcatataaccaaaatccagaccttatccacaacccggggcttggaaaggaaggtatttaggaatcacaccctccgtgattatgtagctccagtaaaatcttgcctggaaagaggcagtcttcttagcatggtgagctgagttcatggctattttctgta

SEQ ID NO: 667551 - DNA, 316 bp, Homo sapiens
agtaacatgggtatttctcctcacctctaaatgggcttcattctgcaatagcaggcccggttgtagggaagcctctccatagggaacagaaagttccaactaccgggctggtctgtcgatctcggcttggtagccggtctgttctgcgcacatgtacacagaggcgtgtggcgacagtcatgcccctggggaaagaacacagggcaagtggaaagagcagcccgggtctagaccacgtcttcgggacccatgcggtgttggcacttaggggcggcaggcctgtagagctctgccggtcccggccacttggcagaag

SEQ ID NO: 667552 - DNA, 207 bp, Homo sapiens
tcagaggatcccggctcagttcatcggtctatggtgcctaatgtgctgtgaatctctgtcccagcatttcattgaacttttttcttgtatacggcaggtttcagcagtgttgcccaggctggtctcaaactcctgagcttaagtgatctgcccgccttggcctcccaaagtactgggattacaggcgtgagccaccgcgtccggcca

SEQ ID NO: 667553 - DNA, 854 bp, Homo sapiens
gtaaagccaacatcacaataaagcaaggaagcgcatgttttagtttcccagtgcatctaagtcatgtttactgcatattggagtccactaaatgtgcaatagcattatgtctaacaaatatacaaaccttaatttaaaaatatttactgttcaaaatgctgacacagaaacgcaaagtgagcacatgctgtggggaaaaatggtgccaaatagacttgcctgatgccaggcttgtacaaaccttcaatttaacaaacaacaaaacacggtatccacaaagcatagtacgaatgaggtatgcctgtatgggctcttcctgaacgtggtgtgctataaaccatctctaagaaatgtttctaccctaaagatttccccagtaccagtcaagctctccgaaactgtggtctccacatttagatccaacccagcctgggataggaaatacttctgaacacaaacgaatttgcattgtaattgaaacacgtacagaccctttttttctggccaattattccctaaacaatatgctggtagcattattttcaatagacatttaatatggtaactcggggcaatatatggaacatctagaagctggatttatacttttattacccgcgaaggtggttgggtaggttaaaggtgcacaagggctaatgccattggccccaatcagggagattgagcaatcccttcaagatttacgggaggtctgaagggctggcggtttgcacgtccttggaacccattcccccatggatactggcgacaactgtctggggtgttcactttggcgcttcgcacctaccgactggattgtgatcgcttcccacaaatgttttcacacacaacag

SEQ ID NO: 667554 - DNA, 114 bp, Homo sapiens
tcgcgaggtaaacacacagcgaacacgaagtgagctatgcgtctggttcctcactatcagaagcaccaattatgcttgtttactgcatgcgcgtcaccgttctgcgtctattcc

SEQ ID NO: 667555 - DNA, 331 bp, Homo sapiens
gaaaaaaaaattgcttgtcccgtttgaattttgccgaatgcctctttgtgtttttctatcccctttattttttgccaattggtagttatatttggagggttgcctgagttccgttttggtgtctttggtaaaaatcctttgtaggtggtgttgaatgtggcctttccttgggaggccccaaaggtttggttgtttcccctttggggtgatggttgccccgggtatggttttctttttactcctgttatgttaagggagggaggaaggaaaaaaggaggaaggaaggaaggaaggagggaaaaaaggaaggaaggaaaaaaggaaggaagga

SEQ ID NO: 667556 - DNA, 339 bp, Homo sapiens
ccctgtgatttatttatatggggttgaagtactgcaggggtcccgtgctgctgtgtcaggattgggcccacgtagcgcgcagaccatttgccttgcatgaaaaatgcatgatggcgtcgggaagccgctgggaagtttcgcgacgcccgtgcaggggtcctcgcacggccgactggctgtcagcgccccggtcctgccgcccatgttgccaatggatgagccaaatgtccctcgtgcgaggggccttgtagatcctgcagacaccgcgcctctcaccagggagtaagggaatggtcttcccctgggacccacgagttcatcctcagctccaccttcacc

SEQ ID NO: 667557 - DNA, 655 bp, Homo sapiens
cgggaaagtttctttggaggtctggcccggagtcggccatgtcccacggtcccatgcagcccggcgcggccgccgcgccgtgcgggcggcaaggctccgggtccaggcatgggggcttcgtggtgactgtcaagcaagagcgcggcgagggtccacgcgcggtgcgagaaggggtcccacgatggaggagccggttgaagaaactggcggctggccctagagggcaatcaagcggaagaacgattctgccgaagtgggcccgaaggcaccggtcacggtgctactgtgcgcttcctgaacgtatcggcgctgagctagatccgcactgcgcctacccggatctgccctttcccgagatcaccaagatgctgggcgccgagtggagcaagctgctagccaacggtaaaagcagtcggtacctggatgaggccgaggatgcagagaagcaggcagctacgagtgaaggagctgcgggcgtaccaggcagtctgaagcctataagatgtgcacggagaagatccaggagaagaagatcaagaacagaagactcgatgctctgggctcatgaacactctcctgaatggacgcaaggtggggactgcgatgggtttccaacttcgatgtcccatcttcactgaagagttctggaccacac

SEQ ID NO: 667558 - DNA, 119 bp, Homo sapiens
atgtacacagattgtcttatcatatacacagtcttcctcatataacatgatcattgatatacttccattcctcttgtcctggttcatctgtcacggcaaaacgacatcgccaacacctc

SEQ ID NO: 667559 - DNA, 164 bp, Homo sapiens
atgagctggtaccgtatgcgtgtgcgccaggttgctgtagcggccgtcgtgctcgatcagttcgacgccgctgactggcgccggctgggtgatgagccgggtgacgcgggtgctgtagcggaattcgacgccggcgcgcgcgcatgcgctcggccagcgcgacg

SEQ ID NO: 667560 - DNA, 295 bp, Homo sapiens
gggccctttttttccccccccccgggaaaggggggggggcccccccccctggggtgggtcatagggggggggggggggtcccccccctttttttccccctttgggaaaaggggcttccgggggggggttttgtttccctttcccccctaaaaaaaaggggaaattggatggggggggggggggggggacccccccccgggggggggggggggggaaaaactttcccccccggcttttttccctttttttttttaaaaaaaaaagggggggggggggggtccgggttcttcctgga

SEQ ID NO: 667561 - DNA, 258 bp, Homo sapiens
  misc_feature (29)..(29): n is a, c, g, or t
ctccacacttcctgggaggtcagagacanactgtttcagagagtcagatggacttcccaagacttgttgagagatgtgacatggttcttggatttcctctgtagcagcctcctggacttcctgaggactcgacattgtccacagatgtactggccattcaatgaacaaaaaacccaggatttttggtggtggttaattataaatggggccatggtaccaggaagattataggctagtctgtaataaattatcttatag

SEQ ID NO: 667562 - DNA, 713 bp, Homo sapiens
taagtttattaatgttctggcgaaaaatccacaggggccacagctaacatcatggcagcacctttactccttcggcggtgatccaatctccagctcacttcttttggccagcaccaacatgggccttggcagtccccctgactttcttcattctgttctggcgtccctttcgtggctttctggaggtctttttcttctcatacaggccagtgtctgtgcaagtctatgttggggttcatttttcttggcataatccaggaatcataaatcatgccaaagccagtggtctgtgccaccaccaaaatgagttctgaatccaaatacaaagatgacatccggtgtggtcttgtacatttgggctagttttcccgaatttctgtcttaggcacggtcgccttcccggggtgaaggacatcaatgaccattggtttcctctgaagtagtcggtgggtcatgaactttctagtgcggatagtaacggtggtcgttcatgatggcgatctatcttcaggggaagatggcggacattcagacgggagcgtgcctaccaaaagcagcgaccatctttcaaaacaagaagagggtcctgtgggagaaactggcaggagaagctcccgcggtactacaagaacatcggttctgggttcaagacacccaaggaggctatggagggccctaacttgaaaaaaatgcccctccttggtaatgtgtcc

SEQ ID NO: 667563 - DNA, 252 bp, Homo sapiens
aacgcgcctgacagtgaaagatggttagtgacagtatcccactctcagtcacatagctcgtgtcatagctggtatcctgatggtacagcctgtctgatgctaaagccaggacgagggaccacgaccccatgtggtcacttactgcagcgcgagctggtctgaagcggcttctactcccaggccagagcgttctcaggaaatctttctgggagggtggcagtgtgggtcagaggaaggtgaattgattgactg

SEQ ID NO: 667564 - DNA, 1870 bp, Homo sapiens
gtggatgccaggcctatcgtcccagcgacgatgctgcacaggggaccgctgtcatgcttgggctgagttcgatacttggacagcacagctatctgcttgtggtagggtttgtttgtaccagcgagcggaaaagtcggtaggataagttgcgctaattgatcgaggggaaagaccggatacccagtacgccacagcgtatgtctgcctattcagcgcgagcgacgtcgaaccggttagactcgggtgattgctcggctgagaggaattcgagagcttggaccagagtagataccctcacagctcgagagcaggaaggtattgtcccgcaatggcgcaaaagccggttctggcaattcgggagcagcccagtaatatatgtaatgcactgacttgattgctctcgaggatcttggatctatgaaacacagttggaggccttttgagtggatgagtggagatcgagttcgacttaggctatgcgttaccaaagggcattccaaagcggtcaggcaagagtaccccacggggcggaggaaggcaaccccacagaagaaggctttgcgtaatacccacggaaggggaacggctcgcttcgttatactacttcggaggtttgcttcgaaaccaaagaaggaatggaacacgggagtaggaacacttttcgggcgcaagtaaaaacaggcgcctttaaacgccatgtaaggcgcataataccggaaactaggttctcacacggcgaaaacataagtcggtttgctcggtgtgtgccgacccaaagttttgggcaacggaggagcgcttggttaagcctttttgggtaacaccttcgggtaacctatacctggccacagtaccgtgttgccgagggcggctataaaccccaaacaataaaggggacctaccgtctctggtgcgcaaatcaggtggacatcttgggcctggggcggtccatcggcagaagtgggttcaaccctttctcacgcaacaccgttgtattgtcccacgtagggtaaggtcaccaaacaggtggcctttgaccttgagccttatttctggccgtaataagcgggggacttctcaagtgaaccgaatcaaaggggggctgcgggggcaggctgaggcacagaggggaaaaaaccgttgtgagccctcggaaatcttatccgggtaccaccttgtgagagagcaaagtgcgtggtcacaacctgtaatgtgggaaatggcatggatacgaaagggtctactttaccgaccaatacacatagggacggcggcagtcgatgcacacgttcagtaaatatggcagcgagcccgagcagggatcacatccaaaggggtattggacaagcacgtatggctcggcacacatatgagcggttgcgccgatgacgaaagcattttctgtaggccacaggcacggaattggggcgtacccaggccagagtaatatcacttcgcgctcgtaggttcatagagaacgcacagacggcatattagaaagtgtgccctctgaatggtggcgacacgtccatgacacagccctgtggggcgcaacggcaccccgggtaccgggcagtcccgaaacgggcgcagagacagaccatacccattaccgggagcacagggagcaccggacgggcgacagccggacaccagcgccactgtgaaagcgccacgccacgtgatctagcgcgcccagtgtacacaccggccaccagcatggagaccgacaacaggggacagtacgacgcggaccgcaggaggacccgaagtacaaaggcgtgcacaggacacagattaccacgactgtgaccgcaaatctatcacgagaggccactccgcgacaccgacagatagcgatgaagagcta

SEQ ID NO: 667565 - DNA, 319 bp, Homo sapiens
gacagtggtgatgcgccgcactgagcccgctgcacagcagaccctgtctccggagctgggggccaagggggccagccttgtggagcacgtctggctcgtgtttgggcccccgcagggcacatacggagggtatttcctggggccagaagagcggctgccgcacaatcatcggttctacatgcgccggggtgggtcctcccacctgcggtggcacgcggccagctgggctctcccctctggttgccgcttggtccatccgctctttaagtctttttcctctcctctgtcttttaaggtctgtttaacgtttaaaaatata

SEQ ID NO: 667566 - DNA, 1074 bp, Homo sapiens
tcatctcggacacgtttattggctagaatcaggtcttaagttctaaagcgggtcagaaatatcccgcagtgaggaaatgtggtactcatggtaaaaataattagcaggtgactaagatcatgaccacaatctggacaaagaactgttgtgcagtatcccacgaaatataggaactattggctcgactggtcaatctttcacaatataaaatatcgggctccaacccaggagtggccgaggggcattgggcgagggaagggcttgcggacactgccgcccgatgccatagcacgatgtgaaaccccttctgtgccacagtggcggggaacgcggggtttccacaccgggtgtggccaagcagaaattccttgaacttctccccaatccaaggacatgtgtggcatctcggagaggctgaaccggacacacgcagggctcaggagggttgccagggatctgggaaagtgttcctctctcacaacgaggacaccaggcaagtgtcacagctcgagattatcgtgttaaaggtgcctcccgatacgtacagataccaacaaaaaaacacaaaacaaaacaagagggcggcgcgctctaaaaaattatcccataacagacgccaccacagaaaagagaggtataccccaccggacttctctatggaataccaaacagtgtggagcccacataagaggtaaacagaagtacgtattagaaaccggcatttatgagctcatgttgcccgttgcgttactataaccaccgttcttagttactagtggaacaacatgattgacccagtcgctggagcgacatatcatctgagcaaagaacgacacacccatcacttcacagtgtgggagggcaatgaaccaacaaatgttgccacccacaagtcatactcaacagaaagttattccagcgcacaaagcgggagataattatcaatttttgaaacgtgttcataacggtgttataaacacaaatcagagcattattactgtcagagaccgataagaaaagtattgagctgctacgaggaaataagctaatactagaaacgaaatcttttaccgg

SEQ ID NO: 667567 - DNA, 181 bp, Homo sapiens
tgaacgggcccgtagaaggcttcgcaccggagctgtcaccccactacgggacctcaaccaccggtgtcggccacatgacgggtcaccacctgcctgcgcttcccggccagctgaacgcagacctgcgcaagctgcggtgaacatggtgcccttccctcgcctgcacttcttcatgcccggc

SEQ ID NO: 667568 - DNA, 10118 bp, Homo sapiens
ggagaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaatatgagctgggctttggaagaatgggaaagaaggagctgcctacaagagctcttcagaaaattcaagagcttgaaggacagcttgacaaactgaagaaggaaaagcagcaaaggcagtttcagcttgacagtctcgaggctgcgccgcagaagcaaacacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaactagaggtgactccaagtcgatcaactttgcaaatagggaaaagagatgctaatagcagtttctttggcaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctttaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggttgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaagatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaacaatagtgaattgaagaagagcctagattgcatgcacaaagaccaggtggacaaaggcaagggaaagtgagcagaggaaatagctgaatatcagctacggcttcatgaagctgaacaagaaacaccaggctttgcttttggacacaaacaacaccagtatgacagtagaaatccagacataccgacgagaaattgacttctaacagaagaatgtctcagttcacagaagcctggagatagaccttttacaagtctagtaaagaagagctcaataacttcattgaaagctacctactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaagggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaa

SEQ ID NO: 667569 - DNA, 135 bp, Homo sapiens
aagcactataaaagctttatatacatagctttatactatttacattgcagtagaggaatggcaatagtataaagctatgtatataaagctttttggtaatatgttacaattaaaatgacaagcactatatcacaa

SEQ ID NO: 667570 - DNA, 203 bp, Homo sapiens
gtaaccttaaaaagaacattataactgattgttgtgaatcgggtgaatttgttaaaatgagtaaccttgataaagtttttcatgcacaggcaaaatgtatccactagatttccacgcagtgatccgcttttaccttgtaatttgtagttctcaaaagacttttttttaaaaaaataaagtccatacttacaaaacaaaaccca

SEQ ID NO: 667571 - DNA, 361 bp, Homo sapiens
agactgatgagataaaccctaatccatggagctgggcaggcgggccccgtttagatttccaggctctagcctggcgccctgcagtcggtgtgctcttgtgaaacgctccatgctgagagggcaggtgccatccaggccgggtgggatactggagccgcgtctcaggagagcggtggggcctgtggaatgtctctaaaggggtggggaaacttccctagtctgggctagcccagacctgagggttgacgggggcccttcttctgagggtgacggggcccctcttctgagggcaaggagcccaaggtgccaggaggggcccggaaaaggccaggccgccacagtgagcagcgcacggggcccc

SEQ ID NO: 667572 - DNA, 924 bp, Homo sapiens
ggggtcatggcgccccgtaaccctcatcctgctgctctcgggagccttggtcctgaccgatacctgggcctgctcccactccatggaggtattgtctacacgcgccgatgctcccggtcccggactcgcggaggagccccgcgttcctcgctagtgggctatcgctggacgtacacgcagtttcgtgcagtttcgtcagtcgacgccgtgagtccgaggaggggagccgcgtggcgccgtgggtggagcaggaggggccggagtattgggaccgggaagacacatgaagtacagatgcgccatgtgcagcagatctgatccgagtgagctctgcggaatcctgcagcgtgtctacgtactaatcctagagctgaggccggttctcacacccttccaagaagggactgtattgtgactagcgaacctggtggtcccagactgggcagcctcctcctgcgggtataaccagttcgaccttacgacggacaaaggattacatcgaccctgaattgaggacctagctgctacctggaccgccgacggacaaggcggctcatgatcagcccatgcgcaagtgggaggctggcccgtgatggcggatgcagcggagagcctacctggagggcacagtgcgtggagtggctccgcagatacctggagaacgggaagaagacgctgcagcagcgcggaacacccaagagacacgacgtgacccatacatcccgtctctgaccatgagggcaacctgaggtgctgggcccctgggcttctaccctggcggagatcacacttgacctggcagcgggaatggcgaaggaccaaaattcaggacaccgagcttgtggagacccaggccagcaggagcatggaaccttccagaagtgggcagctgtggtggttgccttctggaaaagagcagagaaa

SEQ ID NO: 667573 - DNA, 164 bp, Homo sapiens
tatcccctcaaatcaagctctacatcaaatgctgcaccagtagtgtccccttcagaaggtcgtagcattcgttaggtcccataggcccctcccagttcttatcctacttggcctgtaggaggcacccagcgcagcattggtgttatccttcctccatatgactt

SEQ ID NO: 667574 - DNA, 934 bp, Homo sapiens
ggtcaactgcgtggcaagagaagccaaaagaaggcagaatggtgtaaagattccagttgatgccagtaaacctaatccaaatgatgtggagtggataatctgtattgggatatgaatggaatcatccatccctgtactcatcctgaagacaaaccagcaccaaaaaatgaagatgaaatgatggttgcaacttttgagtacattgacagacttttcagtatgtaagaccacgaagacttctctacatggcaatagatggagtggcgaccacgtgctgaacacatgaaccacgcagcgttcaaggaggttcagggcatcaacagaacggaatggaacgcggcagtcgagaagcagcgagtcagggaagaaatatggcaaaaggtggctgtcttcctccagaagaaataagagagaaagattttgacagcaatctgtattacagcaggaactgaattcatggacaatcttgctaggatgccttcgatattacatagctgatcgtttaaataatggacccgtgggtggaaaaatttgacaggttattgtatatactgatgctagtgctcctggtgaatggagaacataaaatcgatggattacgatgagaaggggagagcagtctaaacatgacccaatgatacgtcagtcggatggtctatgtggagcagatgtgatctcattatgcttggcttgccacagcagtgagccgacgttaccattagtgagagagagacttcaagcaaggcaagcccaaagcaagggggcttgaagcagggggacatgggggcgaagactcgtgaggttgcccaggacccgcacgggaacgttgtgactggcgaatctcctgtgccagggaaacctcaaccgggaggctgagcgattggagaggcccccagggcccatccactgggaacgcaagaagtacggctcggga

SEQ ID NO: 667575 - DNA, 642 bp, Homo sapiens
gaggagtggttcagtttagccctgcaagacatctataacttgactgttgctaaaccacaactctttttggctacttgggtcatagagacagcagagttgctccaagtataaatgtgacttaggctccctccagcacacagtgtgtatgttggagggagtgtggattagcagagaatgagaactacctcagctattcctgccataaccacactgagagaggggggcacggtggggagcctatttagctttttttttttttggaaacggagtctggctctgtcgccaggctggagtgtagtgggcggcaatcccgggctccctggcaacctttggcctcccggggttcggggcggattctcctggcctcaagcctcccggggtagctggggattaataggcgctatgccggcacacccggactaatttggggattttcaagtaagagtcagggtttcaccgtgttgcccaggctggtgtcgaactcctgacctcaggtgatctggaccacctcggcctcccgaagtgctgggattacaggtgtgagccacgggacccggctctattaagctttttaaaaattatttccttcaagggccctttaatatctatcaagctccatcccctaacaaaaggggtgtcccg

SEQ ID NO: 667576 - DNA, 389 bp, Homo sapiens
gtcgatactcagataaaggcagaaggtgctgcaactcagcaagaaggtggtcgtttccccaacaaaaaaaggttgcagttgccacaccagccaagaaagcagcttttactccagggcaaaaggcagcagcaacacctgccaagaagacagttacaccagccaaaggcagttaccacacctatcaagaagggagccacaccaggcaaagcattgctagcaactcctggtaaagaagggtgctgccatcccagccaaggcggcaaagaatggcaagaatgccaagaaggaagacagtgatgaagaggaagatgatgacagtgaggaggatgaggaggatgacgaggacgaggatgaggatgaagatgaaattgaaccagcagtgatgaaag

SEQ ID NO: 667577 - DNA, 881 bp, Homo sapiens
cggggtcctctcgagagcggttcccaatagggcggctctccatgggcggcgaaatcgccttcgggtgtaacagggacttccttagagggagctgttccaaaaccccagccttgtcggacctaaccgcggtggtaagcgccccccctttggggcccaaggtcaaccgcgtctgctttggaggctcttcccgggccgcccttttttgggtatttttagaccttcgtcgcctcctgggcctccaaaaatctgcgccacaaccagaatttgtctctccaaggggacccccacccccgcgacaaaatggggggaaaaccacaggcgcaacaccattttcccccaccggcggcgtgaagggaactcctgcgcccattcgacattgtggtcctttaaacttcggcgccaacaaagaggcgtccccgcgcccccgccgttattgggatcgcgtgtttactcccccttgtgagcagctatgaaccccggtggccgaccactcaagtggagtcaagttgcgagtaattgtgaccaagctctcttgttattcagggaggatgaatcgggagcagtagatgcttaccccctccccgtccaacaatatgaaagtttgccttcacatatcacaggccaagagcaccctaaattctctatttcggccccgccacactagttattttaccccccttctctgctgcttgcccttcaggatttggtaccctgagtcgaccatctgtgaataaatccaccgttcctcccatatattaaacaattccttcaggccgtcgcccctaatagaacattaccaccagggtattaaattcctgttaaaatgttcatggatccaatttccccctccccaaaaaaggacaaatgaaacaaaaaaaaca

SEQ ID NO: 667578 - DNA, 894 bp, Homo sapiens
ggccgggcgtggtggctcatgcctgtaatcccagcactttgggaggccgagaggaggtggatcacgaggtcaggagatcaagaccatcctggctaccactgaaaccccatctctactacaaaaaaattagccgggcgtggtgggggcactgacagtcccagctactcgggaggctgaggcacggacggaatgtgtgggacaccctgggaggcagagcttgcatgtgagccaagatcacgccacttgcactccagcctggcaacagagcaagactctgtctcaaaaaaaaatcacctaacatacacattatgaatgagtatttctagaaattccaattgctaagcctgtaatacttaagggtaagttatctagatacagtactttaccttccctgataagtagtatcattggacgcccttaggtataggagacacgaggaccgaagtttcacacacgtgtacctgggccgcgcgttggtcggctcaatgcctgtaaatcccagcacttggggaaggcccgaggggggcgaaaccacgaggtcaggagatccagactatcctggtaccaaggtgaacccgtctctactaacatactacaaacaaactttccgcccggcgttgtagccggcgcttgtagtcccaagctactcggacgcgagtaggacatgttgacccaggagcgacttgcagtgagcgacattgaccatgcatccagcgggacgacaactcgtccaaaacacacttgaggtcaaaaaactgggcgcaaaacataaaagggccgggcggaaatgccagagatcttgtacaccaacagcaactcgttcgcaacggcggttcacggcaacaggcaaactgtggtcctaccgaaatttcccagctagagactttcgaggac

SEQ ID NO: 667579 - DNA, 188 bp, Homo sapiens
aggatcccgccaataacctcccttactatattgtaagcccctcaaaggcagacacaagtatccaattctgcccctgtgcacccacagtgaacagtactcaacacaaggaaccatgtaaataagtgtttgttggctgggcacagtggctcacacctataatctcagcatttggggaggttatttggcat

SEQ ID NO: 667580 - DNA, 225 bp, Homo sapiens
  misc_feature (30)..(30): n is a, c, g, or t
  misc_feature (106)..(106): n is a, c, g, or t
  misc_feature (131)..(131): n is a, c, g, or t
  misc_feature (158)..(158): n is a, c, g, or t
ttccattgcttggttcacatctgaattgtnctggtaatttaagaaaagggtagccccttggtatggatagtagcttgatggcatggaattcagggaaaagactatnatggtgtcacttgtaactccttttntcctgtaaaattgtcatggattaagangagagttggctgggtgcggtggctcacacctgtaatcctagcactttgggaggccaaagtaaggact

SEQ ID NO: 667581 - DNA, 874 bp, Homo sapiens
cacggggcgaatgctgcgcgggtctctgcctctcttgtgtgggtgatggggcgcgcggatcggagagggtggctccggtagcgtgcggtgaccactcagtccacctgtgagccttcggcagctgcgggcggctggcggcgtacccggcccgagacgggtaggagacgctctgtgcggccccctgccctgcctggccctgcctgtggctgcactacactctgcaccctgctgcactgcaccgccagcagtgcagcggccacctgccgctgatgctctgccctgcgggttggggaagtttcccgcctgtgcctcgtgcctgcgtgtgcaccctgttgcttccgcagtgtagtatgctgccgcctctgcgctggctgctgtggctggcctggcgcctccagcatgaccggccagagcctgtgggacgtgtcggaggctaacgtcgaggacggggagacccgctatcaatgtgggcggcttcaagaggaggctgcgctcgcacacgctgctgcgcttccccgagacgcgccttgggccgcttgctgctcttgccactcgcgcgaggccattctggagctctgcgatgactacgacgacgtccagcgggagtactacttcgaccgcaaccctgagctcttcccctacgtgctgcatttctatcacaccggcaagcttcacgtcatggctgagctatgtgtcttctccttcagccaggagatcgagtactggggcatcaacgaggttcttcatttgacttcctgctgcagctacaagctaccatgggccgcaaagtagagcccgagcaggagaagtgggacgagcagagtgaccaggagagcaaccagtctaccttccgatgaggatcttgccttctaca

SEQ ID NO: 667582 - DNA, 316 bp, Homo sapiens
  misc_feature (107)..(107): n is a, c, g, or t
  misc_feature (170)..(170): n is a, c, g, or t
  misc_feature (285)..(285): n is a, c, g, or t
gacaagcgatactcagcagagatgtgcccaggctgatcctcccagtgtgaagtgagcgctcagacctctcaggcaggcacttcctgcacagaggtctcagatggaangatcatcttgagtcggttaagcaacagtagcagatgaccacaagggcgtactggagagtttgntcttggagacacctgacccctgccctgcaaagatgggactgaaggaagtcctctgtgccaggaagaccctacacaatatcatgaaagctccgggaactcagccactggtgacgtnacggttgtgaggcgcagcagtgccaccctgg

SEQ ID NO: 667583 - DNA, 438 bp, Homo sapiens
acgatcacctttcatcatccatccactcttccatccatccaaccatccatccattcaacatccattcatccatctacctatccatccacccatccactcatacatccaattatctactcattcatccattcacctatccatccatctacctgtccaaccattcatccatccacctatccattcatctacctatccaaccattcacccatctgtctatccactcattcatccatccatccatccttctacacatccacccatccattcaaccatccactcacccatccatccatccatccatccaaccatctatccatttatctacccatttatccaaatatatgggcactgactctgtgcccaacccaacacagcataggatagcctggtgattgggatctcttctttgaattcagaaatatctgaatttgactccca

SEQ ID NO: 667584 - DNA, 271 bp, Homo sapiens
  misc_feature (9)..(9): n is a, c, g, or t
tcagcctcncaagtagctgggattacagggcgcccaccacccaaggccagctaatttttgtatgttcggtagagacggggtttcaccatgttggccaggctggtctcaaactcctgacctcaagcgacccacccgcctcggcctcccagagttttgcgattacaggcgtgagccaccacgcccagcggaatttcttattctttttgatctatcaaaacaacctcattgttctcaatgactgaccttataataagtaaatgttatagaacat

SEQ ID NO: 667585 - DNA, 284 bp, Homo sapiens
gcccacttgttatacctactagtctgttactcccaaagtctatacccacaacctgcacaacgtagcccaggtggggtcatcataaaacatggctgtaaattaaatcccatgtggaaaataaaggcttagcagttctgtcatagagcatacacagaatatccgaccactcttgttgtagtaattctctcttcactgtatttaaattgtgtctttatttattgtctaaatctacaactatatatatttaacagttcggtaacacttacctttctgcaatcaaattt

SEQ ID NO: 667586 - DNA, 245 bp, Homo sapiens
tctttaccctttttcaagccatgtgagtggacacatgtagctgtttgtagtcctcccccccctctctgccaggatttgtgcctttgaggagcttcttgggggtcagatcaactctccccctccccatactcccagtgattttattttgcttgtatgtgaaatttgctaaaagtcccttcaacttttttgagcttcctaagtgacgtttttgcaggtattttcaataaaaaaaagggctactttga

SEQ ID NO: 667587 - DNA, 307 bp, Homo sapiens
  misc_feature (87)..(87): n is a, c, g, or t
aaaccccgtctctactaaaaatacaaaattagtcgggtgtggtggcacacacctgtgatcccagctactcaggaggctgagacaggngaatcacttgaacccaggagacagaagttgcggtgagctgagattgcaccattacactccagcctgggcgagaagagtgaaactccatctcaaaaaaaaagaaaagaggaaaaaaaaagaatgtatttacagaggaaaaagaaaatgtacctttcaattgggaatgggttttttaatgggggggagggggaatcctggtaacttcatttagaaattacct

SEQ ID NO: 667588 - DNA, 211 bp, Homo sapiens
taacaaacacctaatggttattaataaattagtacacttgaaggcatttttctgatatcgggcctttaccactacccacaaaccccacccacacaaagggaggccacgccacctttgcattggaacctggcaactgagcattaaaagggacatttgtaaatgggagcatagttgccaatatatcaaacaagggttcttacagttgcagcca

SEQ ID NO: 667589 - DNA, 152 bp, Homo sapiens
taacatgatataatctagctctgtacctcggatgtctgatccaacatcgaggctaatcctattgttgatatggactctacaatatgattgcgcctgttatcccctagtggtaacgttgttccgttgcgccattgttattggatctaattaga

SEQ ID NO: 667590 - DNA, 116 bp, Homo sapiens
  misc_feature (67)..(67): n is a, c, g, or t
  misc_feature (102)..(102): n is a, c, g, or t
gctaaccttgtgtttatgttaagtggcttcgttgaagagggctgtcactgtcttgaaaacttggganaatccatagcaagctgtgccattagttgcctttgngaggcttgaggagg

SEQ ID NO: 667591 - DNA, 859 bp, Homo sapiens
  misc_feature (55)..(55): n is a, c, g, or t
  misc_feature (106)..(106): n is a, c, g, or t
  misc_feature (113)..(113): n is a, c, g, or t
  misc_feature (156)..(156): n is a, c, g, or t
  misc_feature (195)..(195): n is a, c, g, or t
  misc_feature (257)..(257): n is a, c, g, or t
  misc_feature (299)..(299): n is a, c, g, or t
  misc_feature (308)..(308): n is a, c, g, or t
  misc_feature (312)..(312): n is a, c, g, or t
  misc_feature (314)..(314): n is a, c, g, or t
  misc_feature (336)..(336): n is a, c, g, or t
  misc_feature (698)..(698): n is a, c, g, or t
  misc_feature (709)..(709): n is a, c, g, or t
  misc_feature (726)..(726): n is a, c, g, or t
  misc_feature (729)..(729): n is a, c, g, or t
  misc_feature (733)..(734): n is a, c, g, or t
  misc_feature (746)..(746): n is a, c, g, or t
  misc_feature (749)..(749): n is a, c, g, or t
  misc_feature (766)..(766): n is a, c, g, or t
  misc_feature (782)..(782): n is a, c, g, or t
  misc_feature (845)..(845): n is a, c, g, or t
ggtgtgggggtttgtgccggggggtggtccggtccgggattcccggggtcaaganggcagccaccacgggctcgggagtgaaagtccctcgcgatttccgactgtngggaggnctcgaagaaggccagagaggggtgggagatggcacagttagcnggggtctagaagatggcgaagacatgacacttacaaganggacagggatgataattgggcctccaagaacaatttatgagaaccgaatatgcagccttaanataggatgtgggcctaaatacccagaggcacccccctttgtnagatttgtnacananattaatatgagtggggtggatngttctaatggggtggtgggcccaggggccatatcagtgctagcgaaatggcagggttcatatagcatcagagttgtcctgcgagagcttcggcgcctaatggtgtctaaggggaatatggaactccctcagccgcccggggcgcagtgttacggcgattgatcagggagagaaaccacaggcccttccccttccccccaattcgatttagtcagtcttcattttccacagtggtggattttctgggtacgtcttgtagacctcaaagtaccggggagggggctcccattcgggggggatttgtcttgggatactgtggatgatactgattttttgtccatttgggatatatgagctggtgcnatgacagatcntcctgctcaagtgtaanaantgtnnaagtagttgaanttntgggatcaagaaagtcnatttaaattgattcanatcataactggtggggcacatctaactcaactgtgagaagacacatcacacaatcacaatgcngctgattacacggc

SEQ ID NO: 667592 - DNA, 1172 bp, Homo sapiens
  misc_feature (102)..(102): n is a, c, g, or t
  misc_feature (108)..(108): n is a, c, g, or t
  misc_feature (375)..(375): n is a, c, g, or t
atcgggagagcgctgttagttgtgtggggggggccgcgcaaccgaccggcgtgtgttccccgaacaccacgggctggtggggggggtaagaagaaagagggncgggcngagccacctccctcctggggtatatagggtggaaggcgaatatatcatgcgcaatcaaacccggggagcgggcgccccccgctgcgcaacatgaatgaatatcatgtgctcggtggccgttttcccggacggggaaaatagtttgggggtcggcccccttctcccccctccatccaagacgagggggggggggttggaacgaacacggggaataggttgccccagccacgcgactggggggggggcaaacagcccccccgacagggngcggtgtctcatatcaaaggcaggcccgcgttgttcgcacggccgcgtggtttcacttggtctaaggggcgccgcctgtgggtatttatttttgcgccacacaggtgagaggagggtcctcttcaccaggcgggttgtttgtgtgtgtggcgacgacgcggcagaacgctgcgggcgcgtttgttctcttgttgcgcaaacaccgccggttggttggccgacagcagtttggtgatgtggctgttttatcatgggcgggtgttttggcccacagggggcgccacctcttttcccctgccgcgattctccttcagcgctcccggagggggtttggtctccttctctcaacaagacgcgcttggtggatatccctcctccttgtcgggggacgtttttttttccgtgctccgcggcagaggagagctttttccaccgaccaatgatatatatagtgatggtggtgtccgcctcatacattatatgtgtgcgcgctccccacagaaagatgatttgctggaagagtgtggtcgcccaccaccaccgctggagaagaaagaagaagaaaattgttcccccacgttagacgaggtgtgtgaggcagccacataataatagaggtggaatagggtgtttatcaccagcgggattttccgagctgtcgggtgatcgtcaggggtccgagatcttccaccttttggatggacaaagggggccccaaacccccctttttttttggttcccccccggggcccctttgggttttggggccaaaggggggggccaaaaaccttttttta

SEQ ID NO: 667593 - DNA, 217 bp, Homo sapiens
aatcaatacacatgtatacacaaaaagagaggaaaaaagagcctaattaaagtagtgtttacacacagcaaaacatcagaaaacaacctatcctgctcaccaaacgacgcaattgtatcaggacggctgacggcacggaggaccctctgaacacacaacgacttttacacgcctgggactgcttcaaactttcaaaacaagacacggatgacttcta

SEQ ID NO: 667594 - DNA, 686 bp, Homo sapiens
  misc_feature (133)..(133): n is a, c, g, or t
  misc_feature (213)..(213): n is a, c, g, or t
  misc_feature (235)..(235): n is a, c, g, or t
  misc_feature (307)..(307): n is a, c, g, or t
  misc_feature (310)..(311): n is a, c, g, or t
  misc_feature (313)..(314): n is a, c, g, or t
  misc_feature (316)..(317): n is a, c, g, or t
  misc_feature (321)..(321): n is a, c, g, or t
  misc_feature (326)..(326): n is a, c, g, or t
  misc_feature (333)..(333): n is a, c, g, or t
  misc_feature (362)..(362): n is a, c, g, or t
  misc_feature (366)..(366): n is a, c, g, or t
  misc_feature (448)..(448): n is a, c, g, or t
  misc_feature (655)..(655): n is a, c, g, or t
gtgcacagcagcacacatgaggctggaggccgctcactccgctgcctggggcttgtgccgtcttgagttctaatgcccgtgctcattaggatggaccagcacagcgtgggcagacaccgtggaatgacaggcntccctcctgcagcgttctgcctgtctttaacaggtgcttccaaagctcgttccctaaggccattaagcagccctcaggtnacagagacactttgactaaatngcccaagaaacgtacccttcattcattgttggagctcgatgccaacttaattttacttgtagaccagcacanagnncnncnnagcngtaanacagacncagtagaatgacatgttctcaagcgtgcntctnaactcatctgtatggaaaatggaagtcataagacctcctttgctgtgttgtttgaaagatcaaatgcaaaatatgtgtgatnccttatacaacactcttgcacagtgatgcatttgtaaagcctatttatttttgatgaactcttaagaaagcctgaagacattctgtgtgcatggtgtctgcccttctgcccagaaaatacacatctgacattttattttctccatcttccagcaatctcatggtaaaaagtcattggaagatcatacaccaatatggcgcccactgnaaaccagtcatgagtctgtattaactgcttg

SEQ ID NO: 667595 - DNA, 384 bp, Homo sapiens
agctttaccccttactggcaggaatcccagcaaactcacagccaagctctgcttttcaccttcacatcatacagtcctcagactaaaaccctaactctgaccttccaaatcaaaaatcgtactcaaggccgggtgcggcggctcacgcctgtcatctcagcactttgggaggccgaggcaggtggatcacctgaggtcaggagttccagaccagccaggccaacatggtgaaaccccatctctactaaaaatacaaaacttagccagacgtggtggtgggtgtctgtaatcccagcattttgggaggctgacgcatgaaaatcacttgaactcaggaggcagaagttgcagcgatccataatcatgccactgcactccagcctg

SEQ ID NO: 667596 - DNA, 2097 bp, Homo sapiens
  misc_feature (183)..(183): n is a, c, g, or t
  misc_feature (319)..(319): n is a, c, g, or t
  misc_feature (1002)..(1002): n is a, c, g, or t
  misc_feature (1396)..(1396): n is a, c, g, or t
agtttagtagaactactggttatcgacgactgcacatcgtcatatctgtcccttaatttgaccgtaggacaaggtatctgtgctgaatcgaagggacatgtatgagcgtacttcgtcatttcgcacgtcagtactctgcagctccgctcgtgtgagcgcacacttaattggtggtgcatatangcaccattgctagtgtactgttgactcggctctgccggagagacaaagccgttgggggcgcgtagagtactctattttagatagtctcaatgatccacatcaagtaactacattctggggcacgtgaggtaacatnagctgataagtgagtagcattcacgttataaactctcctaaccttcaccaatctggcttgagcacacctgaaattactggttggcgctatagctgcttcgggttaggtaaaacgtcaaaccaatatggtgaacctctcgtagtaatattttcctctaaacacatagacccagtacgtgcttggccttaaggacgactcctatgtttcgggaagacttccatcacgcgtaaaagttgaggcttgaggagtgtggcgtatgaagatcgactaacgatgtaacacccaatgctgtgatccgtaaatcccctagtggtctaaaaaccgccgtaacgacatcctatgaaaggaccaacagagagcaccatcattttataattacacgcccttaaagttctccctcaggagcaaagaacgccgtacacagatcggcttgaagcacagtagatatctacaccatttcattatgtcgatacccctctctcaaccataacccctgtataatttaaagaggttagatctctaacccccattcggtaaactttcccatcaataaaagggaagacgttaccaaactttcaaacatttcacaattcgcagtttcacaagcggcatacatcacaaagttggtcaccttatcgatatatccatttggcacagaggcaatggtcagcatcccattgganttcattggtaaaaacggccccgaagatgtaaactcaactacattattgacctctaatttactatttacaggatcacattacgacattaccctaggattacgcggataacattattctctccccaatggaaaggaggtactcccataatatcaaatttcaatttctacctaagggtgcgcttctatacagcacaagcggtttataccattaaatgacattaatgcgttaggaggcggaggttatccgggctgtaaattgtaaagtttaacctgaaaacaacatgtatgccgtgggaacatcccatgtaatatggcgagctacaaactccatttcatttaccgggacccgcacggggaccatgcgttcgggggacatatggcacatataagtgccncccatgtgtacagtgagtataaggggacaacacgaataagtaatatatttcatgtgaattcacataatagaaagcagtaaaatcatcgtgaggaatcaatgtatataacaaatcctgtgtgacatcaagtgcatggaacaagacagagggtattatctctgacgagcgtagctatatgaaagatagaaccagcaccaactattatggtgcagtacaaacttattatccattaatactttcatgtataatacacgacacaacgtacgtacccacccatgttgtgggacacaaacacacaagtagtgacaacacgagccccgcgaagacgcaagcacggaagcaacacaaataagggtaggacacgagacagagagagataaagaggcagtaggaagagaggcagaaacacaagtttactaaaggaggcgacaacacaggatagaaagcacacagaagcaacaaaatagagaagatgcacagacagaaggcaaaacgaaacgcacacaaagggaaacagaaaataaaaggagggacggaagaaacaacagacaacgacaacaaaagcaagccaaagagagaaacacagtaagcataaagataagcgaagagagacagaaggaagaaagaaagaagcaacagatagcgaacagacgacagaggacaggaacagcagagaccagaacgacgaagagcgacgaagc

SEQ ID NO: 667597 - DNA, 354 bp, Homo sapiens
ggatgcaataaatgttgatggcaatagagaaaataccactttgctggtggcaagagctcttttttatttggaaaaagctactgggggccggccgcgggggctcacgcctgtaatcccagcactttgggagcccgaggcggccggatcacgaggtcaggagatcgagaccatccgggttaaaacggtgaaaccccgtctttactaaaaatacaaaaaattagccggccgaaggggcggccgcttgtagtcccagctactggggaggctgaggcaggagaatggcgtgaacccgggaggcgaaccttgcagggagccgagactgcgccattgcactccagcctgggtgacagagcg

SEQ ID NO: 667598 - DNA, 811 bp, Homo sapiens
agcggactggtagtgaggagccaagaggaatggagcagtttccccacttatccttctggcaggatcttggcaacctggtaccagatggctgtgactatgatctgccgttctaagacctcgaaattgtgcctgcagcatatcgtggtgtgggggatgaccagctgggggaggagtcagaagtaaagggatgaccatttattaccatatgtagattgcactttatatgtccatgccttcttcctcagtctccctcaaaccaaagctacacagccagattgtctcaagcagtgcgtcaactaccagtccctcatctcacccgttactcatgtgctcttgcttgtccagtattcgctttcgatttggcatcttgctcactagtaaaactgcgttccctttgttccttattttctgtctttactctagagagcgtacagttgtaagtcatgagttcaatatcatagggtcctgtgaagacacatgaggcttttgcacttgtctcttgacatcagaagttacaataggcatatgggcaaaatggtgtagcaggctcactggccgtttgtctttgaaacacattttcacaagttgttgagacactggatttctttaattcagcacaatacaatgcgaagaaacattatttatacagggcttgattgctttcatgttcgttattctgtaccctatagtagcctccatgagaatctggtattcttgctgcttggaactactttgcaggtgattacttggttgcagtccaagtactctcgtttagtctgagctgcagcaatgtctagacttgctttctccc

SEQ ID NO: 667599 - DNA, 103 bp, Homo sapiens
tgcgacgccattgtgattttatgattactatgttcaggcacagtatttgtttatggtcatattctcacacatctgaatcccttcctactgtgtagtgtgtgta

SEQ ID NO: 667600 - DNA, 922 bp, Homo sapiens
atgacccaccaatcacatgcctatcatatagtaaaagcacagcccatgacccctaacagggggccgtctcagccctcctaatgaactccggctagccatgtgatttcacttccactccataacgctcctcatactaggcctactaatcagagcacgactaaccatatacgcaagtgtgtggcgcgagtgtatagcacgagaaatgcaggataccaaggccaacacaaatcacctgtccaaagataggccttcgatacgggataatcctatttattacctcagaagtgtcggtctcttcgcaggatttgctgagccgttttaccgactccagtgctagctgcctactcccccaattaggaggagcactgggcgcccaacaggtcattcaccccgctgtaatccctctagaagtcccactcctaagtcacttccgtatgactcgcatcaggagtatcacgcacctgagctgcaccatagtctaatagaaaactggcgaaacccaaatagttcaggcatcggctttatgtacaagttcgtacggggtctctatttggaccctgcctacaaagcctcagagtcaccttcgagtctccccttcaccattctcctgacggctatctacgggctcaacattcctggtacgccacgagggcctcccgacgggacttcacgtattgattgggctcaacttcctcacgaatcgtgcttcatccgcaagtaatatttcactttaggtttcggacctcaattttgggtttcgaaccggcgctgataccggtttggaatgcgcggtgactcagtctggtgcccctcgatgggggcgccccagcgagacaccagcggacaaaatgttcgggcgcgcgcgagagaattaaattttggccgccaggaagaaacaccgctcacaaacgcggggagggcc

SEQ ID NO: 667601 - DNA, 299 bp, Homo sapiens
ctctagaggttaccgtaacagcgcttcgtaacgagcgcctctaacaccctccgtaacagcgcttccgtaacgagcgcctccgtaacgagcgcctccgtaacagccctccgtaacgagcgcttccgtaacgagcgcctccgtaacagcgcctccctaacgagcgcctaacagcgcctccgtaacgagcgcctcctaacacgcctaacgagcgcctccgtaacgagcgcttccgtaacgagcccctagaatggtttatatcgggatcgcgatttttcttttcttggtggcgctgttacgga

SEQ ID NO: 667602 - DNA, 573 bp, Homo sapiens
  misc_feature (29)..(29): n is a, c, g, or t
  misc_feature (33)..(34): n is a, c, g, or t
  misc_feature (37)..(37): n is a, c, g, or t
  misc_feature (57)..(57): n is a, c, g, or t
  misc_feature (71)..(71): n is a, c, g, or t
  misc_feature (174)..(174): n is a, c, g, or t
  misc_feature (184)..(184): n is a, c, g, or t
aaggggggtgggggggggaactctaaccnctcnnatngcaacccccattctacaccnaaaactaggccttngctgctctggaaggacaggggcaagaaagccacgcaaccctaacactcggccaggctcatttcaacaatggagaggacgccgaggccgggggggggggctccngttacattcnccggtgcggggggggggcctctagggacgaggggcccgggagcaaatgcagccctgaggatttggctactggatataacaacagggggcaaatcaaggacttcaggggtgatttttatgaagccatggatgactacacatctggcatagaaggccaacccaattttggagggccatattacaacagagggttgagactggataggctgggatattttgatgatgctttggaagatttcaaggagggcttacacttaaatcctgggatttcaaggtgctactttgagcttaaaacagactattctaggcaagggagaaaaacaaggaaggaatgggggcaggggatcagggatcagaatttagatattggctattttggttatatttaag

SEQ ID NO: 667603 - DNA, 255 bp, Homo sapiens
agagaatggccagccggaaggcggggccccggggcaaggtggcagcccccaagcaggcccaccgtggttcttcccccgtcttttccatgttttagaccaggcccagatccagggttacagggggcgcctcccgccttttccccccgttccgtggtggtcctactctgcggggcgccccggggggcccttctccctcgtggggggggggtttcccccggggggtggtggccgcttctgacggacggccccctctat

SEQ ID NO: 667604 - DNA, 1387 bp, Homo sapiens
ggatatagctggccacagtcaactgggcccgggcaggactgggcctccctctgatcgatgaggtggtgagccgctagaggcccgagccccgtcaatcgacgtcgtgcacttctcttgcagctggatctagtttttagagtgtccagcaagtacccctgggactcagtaggtaggtagcacagcgcctctgctgtcgcccagcccgttcgtaacagcacatagggcgccgcccgagccgcccatgctgtccctcatggaccgtgtcccagaggcatggacatcacgtgtgagtccagcaatggagcaaggtcctgacgtctccttttgaggtcagcgtccccgtagggaccggggtggtattcgactaaccgtcaggtgatagactcgagccaggagcatccaaggcactactcatacggaagagctatgtctgagcagataagatcaatgttaaccggatcccgtttcgagacaccgaggacttggagtgcatcgtgctagggccccggtgccttagcatgaccgtcgagccgggagcttttgcggttccgtcggagcaaagcgcggcccgctagacactcgtgacatcactagccgtggcatgggggcctggcgtcgcataacgtctctgggggacctggcatgtgagcgtgtcgctggggacccccatatccgtatggcgccccatcaatggattcttcaggcacgtaggggcgcggtggcaccggctagcacttggaccacgtcggattccccccaaaactgctggaaacgccacagttccaatgaacaagcccacttcaccaattcgccgacgttggggacccccctattcccgttgaggacccccccattttggcttttggttcgggccttagtgccccagcgctttaagcgaatgttgggggcttcctggtggcgaccgggaggacggcgccggcgggggtacctgtcgggcggcacggggccctggagaggggcaacacgtcattacacccttgggcctggttcctccccttcatacaggccctcacggaccactcaagagcaaccacactaggacagtcccgctaaatggggccaaaaagtgccagacccaacaagtgtggggttctgccaggggacgcagatgccttgagaaagtatccccccggatgtgcgattacaggcaaaattacggtcagtgggacctgggcctttgaccgtacccggggggattcacaagacaactagcgaaaaggacgatgcgaccacccatgtaaaggggcagcttaggaaagcgtcggggaagtttaagacacagatgtgtatttaacaaccaacccactatcagaagaaaacgtgagggcgaagcagagcatacgtgtgcggccaaagagaggatcag

SEQ ID NO: 667605 - DNA, 183 bp, Homo sapiens
tttcgtacattatctcatttaatcctctcaacaagtctacaatataggtcctattattattattcaacctttgttttgttttgttttgttttgagacggagtctctctctgactcccaggccgagattgcgccactgcagtccgcagtccggcctgggcgacagagctgagatccgtctaaaa

SEQ ID NO: 667606 - DNA, 102 bp, Homo sapiens
  misc_feature (9)..(10): n is a, c, g, or t
gtccatctnnacgtggacactgagtaaacgtgtacttagtcgtgtgctcttctgcctaaaatacatgtttacagcaatcatctttcaagacaaagggaaaca

SEQ ID NO: 667607 - DNA, 328 bp, Homo sapiens
cacatgtggctgctcgtatttaagttaattaaaatggaacgatggccgggcgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactcaggaggctgagccaggacaatcgcctgaacgcgggaggtggaggttgcagtgagctgagattgcgccagtgcactcctgcctgggtgacagagcgagactccatctta

SEQ ID NO: 667608 - DNA, 95 bp, Homo sapiens
  misc_feature (70)..(70): n is a, c, g, or t
  misc_feature (72)..(72): n is a, c, g, or t
agagaggttggattcaccagttctgaaggctgtgtaggaagcatggctggggaggcctcaggaaacttananatcatggcagcaggtgaagggga

SEQ ID NO: 667609 - DNA, 315 bp, Homo sapiens
aagaggcagtgatcgagctcgtgtaccctcgtgacggtgattatcatagttttacaggttttgggataggcggtggagttaggggcaatgttttgcgggcaggggatggatctcacgaagtacattctcaagggtggggagaatgacaaagaaccttcttaagggtgggggagattgcaaagtacattgatcagctagggtggggcagaaacaaatcacaatggtggaatgtcatcagttaaggctcttttcgcttattttgtggatcttcagttgcttcaggccatctggatgtataatcgccggtcacgagat

SEQ ID NO: 667610 - DNA, 259 bp, Homo sapiens
cgtgatcggctccgggtgcctcatcgccggcggcgccgtcgtgctgggtgggaccgaggtcccgcccggctccctcgtcgccggcgtaccggcctcggtccgccgaccgctcacggaagaagaacgcgcgggcctgatcgcgaacgccgacatctacctcgagcacgtcaggacgcatgccgcgacgactcccgtctgagccctcggccactaggctggagcgcgtacggggcggtggccaagctggttaaggcagtgg

SEQ ID NO: 667611 - DNA, 805 bp, Homo sapiens
gggtctctgagcgcctctgctctctctcccggtttcacatccgcatttgctaccagcggcggccgcggcggagccaggccggtcctcagtgcccagcagcgccgctcccggcaacctcggagcgtcgcagccgacaggccggctggccgagtctcgggcatcccagagcatcactcttccacctgctccttagagaagggaagatgagtgagtcgagctcgatagtccagtcagcccttggtcctccaagcaggacaaggacggcatctgagaagcggggtccggggcaggccgcgcaatgcatgacctccgaaggtagcccagctgaagttgtccaaacagcgctacgtagacctcaggggggcctgaccaagagggacacgcaacaaatcaacgggtgcttgccaaagaccccgggagaaacagcagaattccaggaaggaaaccatagggggcagacccgaaaagagactggacgaaaggacgcgaaagaaggagggcatctcgcaggagtccctcggcgtgacggacccatgatgcaaccgatggccgctgccggcccttgcttcgctcaagctggaagggtaggctaggatttcctttcgtgggaactaggagcagacattatgcgtcacgtgtctccaaactggccttccgctatccatatgggtggcgcacgagcgagatacctggacttgtatgacgcttgaacaccacgtgtattgacccttcaccctctaatgttacccagaatttccaacaatccagatccaccacatagtcctaatggggacttgtaactgta

SEQ ID NO: 667612 - DNA, 338 bp, Homo sapiens
  misc_feature (272)..(272): n is a, c, g, or t
tgactctcgcacatcatatgcactagggattctgaaaacttctagcatgactgcaaagtggccaagagaataaaagtccttgatgataaatcacagtataccccttgagcctcaccttcttgccagtgccagattttttctttttaaatctctctgattttttgctaatgaaaacttgaaaaaaaaaaaaaagcttatttggaagcttaaatgttttatcttttctccgtggactaaacctctccgaggactctctcggcacctggatgtcnagctctcgaagcagccaatcagatgggacatcagagttctctcatccctccttaaggcgtgatgac

SEQ ID NO: 667613 - DNA, 235 bp, Homo sapiens
ttcgtttgcccaggctggactgcagtggtgcaatcatagctcactgctgccttgaactcctgggcttaagcaatcctcccagctcagcctcctaagtagctgggactacagccaccatgcgtacctttaaaaaaaaaaataaacttttctcattgaggttcttatgcttagcacatcaggctgcttttctatagattataaatatgaagagttatagggtagttgaaggctttta

SEQ ID NO: 667614 - DNA, 354 bp, Homo sapiens
acaagttactggagcctgttttgcttctgggcaaggagcgatttgctggtgtggatattcgggtccgtgtgaagggtggtggacatgtggcccaaatttatgccatccgacagtccatctcaaaggccctggtagcttattaccaaaaatatgtggatgaagcctccaagaaggagatcaaagatatcctcatccaatacgatcggaccctgcttgtagctgacccccgtcgctgcgaatccaaaaagtttggaggtcctggtgcccgtgcccgataccagaaatcctaccgataagcccatctcaaggatcgggctttacctttgtaatacacctcctaggcttttaacgctc

SEQ ID NO: 667615 - DNA, 538 bp, Homo sapiens
  misc_feature (48)..(48): n is a, c, g, or t
attcgcggccgcgtcgaccttcactccagtcttccctcttgacagagnttccccagagctaagtctgtggtccctgctggggacagattgtgtcacgtgagcctcacagggaccagacccctggagtactcactcctgggaggcctggggaagggggcggagctgggctgtgatctggtgccagcacctgtgatctcaggaccttgggcaggctgctgctctacctgtgaccttgtgactgtgactgggagacagagccggcacccactcaccagagttcaagggggcggtgggcgggaatgttggagtgtggtgtggcccggggtggtggatatttcaacaatgattaaatattccctggagatcagcctgggctgcatagagagacccccatctctacaaaaaaaaaaaaaaaaaaaaaaattagccaggcttggaggatctcttgagcccaggaggtcgagtttgcactgagacatgatggcaccattgccctcactctacaaggcaacagaggagaccctgtctcaaaaaaaaa

SEQ ID NO: 667616 - DNA, 213 bp, Homo sapiens
  misc_feature (130)..(130): n is a, c, g, or t
tcccggtcgctcggaccactgtagtctgatatcctgtcatatccatagttccatagtataccagtataatcatattctgccatagcactatatgtttgatcaccaccataggcactattgtaattcatantcttgatcataatagtattaaatccttggttcagttttggcctgacctcggcacgacccctcgtaccacctcgtccgagcgga

SEQ ID NO: 667617 - DNA, 337 bp, Homo sapiens
  misc_feature (29)..(29): n is a, c, g, or t
  misc_feature (32)..(32): n is a, c, g, or t
  misc_feature (35)..(35): n is a, c, g, or t
  misc_feature (39)..(39): n is a, c, g, or t
  misc_feature (42)..(42): n is a, c, g, or t
  misc_feature (45)..(45): n is a, c, g, or t
  misc_feature (47)..(47): n is a, c, g, or t
  misc_feature (56)..(56): n is a, c, g, or t
  misc_feature (58)..(58): n is a, c, g, or t
  misc_feature (62)..(62): n is a, c, g, or t
  misc_feature (64)..(64): n is a, c, g, or t
  misc_feature (75)..(75): n is a, c, g, or t
  misc_feature (90)..(90): n is a, c, g, or t
  misc_feature (95)..(95): n is a, c, g, or t
  misc_feature (99)..(99): n is a, c, g, or t
  misc_feature (106)..(106): n is a, c, g, or t
  misc_feature (115)..(115): n is a, c, g, or t
  misc_feature (118)..(118): n is a, c, g, or t
  misc_feature (127)..(127): n is a, c, g, or t
  misc_feature (164)..(164): n is a, c, g, or t
  misc_feature (171)..(171): n is a, c, g, or t
ttgtgctagtgttctagagtatcccctcnggntgnatgngcncgngntaaactctnanggtnantttctgtcaantgcagtagatatganagaanggtnggtatantcaggaaangtntctgcagcntttccttgtctctagacctgccatgcctccccaaatngggcatntaattcatctttaaactggtcgtcctgttagacgctaacttagtaagtgcttttcttatagaaccccttctgactgagcaatatgcctccttgtattataaaatctttctgataatgcattagaaggtttttttgtcgattagtaaaagtactttccatgttactt

SEQ ID NO: 667618 - DNA, 277 bp, Homo sapiens
tccatcagccttaaccctgggaaatgcctgctgcccccaatgatttttggttttgtttcccccatacaaaaacagggtggaggggaagggtgggtttcagttaacaggggtccccagggcaagtcagcctcctccccccatgcctttttggtcagggggccttaggggggcctttccctcccccccctttgggccccttgggggaggactggggagggggccgtgggaaagccctgccgctggaacctgtatacccaataaaggacagtttcccaga

SEQ ID NO: 667619 - DNA, 503 bp, Homo sapiens
  misc_feature (463)..(463): n is a, c, g, or t
cgatgctagaggacatcaggatgactggtcctgtggtcacacttatttgtctggattccacactctagggtcctacatcattccttgtgacactgagtaagtgagggtcctgttgtcattggacatctcgcgcctgggactgaccgggaggctctgattatttacccaccacaggtaggttgtgttctgaatctcaggttcacaggttaaggctacagcatcctcatcctccacggggttggagttgttgctggtgatgaagggtttgggtggctctgcatagactgtgatcgtcgtgactgtggtcctattgaggccagtgtctgagttatgggcttggcacgtataggatccactattattcacagtgatgttggggataaagagctcttgggtggattgctggaaagtcccattgacaaaccaagagtactgtgcaggtgggttagaagctgcgtggcangagaggttcagattttcccctgatctgtaagatgtgtcta

SEQ ID NO: 667620 - DNA, 140 bp, Homo sapiens
caggaccccctcctgctcaaccgaacacctcccaccagaccctcacctccaacactggggataacatttcaacatagatatatagcaggggacactaatacaaaccatataatctccatactctaggtcagtagctaggt

SEQ ID NO: 667621 - DNA, 432 bp, Homo sapiens
ggtgacaatttttagagaagaaagaaaaagacaaaaagaaaaagaagactcttgctaaagaggccagtgaaaattaacttccctctgatgttgatatgaatgaccagtactttgctaaagaagtttaaaaaaataggtataaagaaaaaagtgaacaaaatctgcaaaagatggcacatctccagaagaagaaaccaaaatagaaagatgaaaggctgaaatggctttccttactggatgaggaggaggaaagtaagaaacacttcaattacaacaagattgtggagcaccagaacctgagcaaaaagaagaaaaagaagaaaaagcagctcatgaaaaaaaagaaattattagaggatgactttgaggtaaatgttagcaatgcatggtttcaagcaatgtacacttcccacttgttcaatgtgcatccct

SEQ ID NO: 667622 - DNA, 642 bp, Homo sapiens
  misc_feature (546)..(546): n is a, c, g, or t
  misc_feature (568)..(568): n is a, c, g, or t
  misc_feature (594)..(594): n is a, c, g, or t
ccattccacagtatcagctatgacatgttacgattgagctcgtaccttgtgcaccgaatgtgactgcgccatcggcgagggttcggggaatctcctgccggactttgatgtcctcgatctaagtcagtcccacgataatcgctctattccgcccgaccgatctttggggaatacgcggatcgggataaaactggttagtacgttcctcccccttggcatctcgaaccttcgcagcatcgagccgctcgaccacaaccaagggtgttcgactcacctgcgagtaaacaaccgcaaagctatcagaacacagagccattggcttcatggccggcggtacgcttgcgacgttgatcggcctgcctgccgggaaaaggtcgacgcaaccatcgaacgaggccttcttctgctgactggtgtagagggcaagggcttcactcgggttgatcgttccggatcggtagctgcttttttcttcctgggcattgggaaacttgatgaaatccatcaggccgcgagcctgtgcggagccggcggacagcattaccngggtcgatagcccaacagcaantttgcttagcttcatgcgtgagtttncgggattgaatgacgaaatactgacagtcagagcagtgacaacctgat

SEQ ID NO: 667623 - DNA, 694 bp, Homo sapiens
  misc_feature (447)..(447): n is a, c, g, or t
  misc_feature (687)..(687): n is a, c, g, or t
  misc_feature (690)..(690): n is a, c, g, or t
tggggaggccagccataaacacgtgtgacctgtgtgggctagctatcgtcagggtcaccaatgcatgtacatttcctgtaatggaacgaaagttggaccaaccccttatcccgtgagagtaagccaagcccatgcacgactcagtgccggcagctctgcatgcagcgctgacacataaatacaacacttcaatattaatatttggacagctcacggagatctttgatgagtgataaggcaaagcccaggagccggtatggtcttttcattccattcgtattagaaacacagtgttgggaaggtcacgctgtatacatgtgtttacaagcattcttaggagggtgttgcataccaaacgatgcatcaggtcttggccctggatccttgtaggaagcttccaaaccctgagggtttcgcaacaatgtgtagcgtcagctgttgtcttgncgggccccttgttccacacctatgtttatgctaatgaggtgtcacagggggtgttgctctccaatttcagaatcggtcgtgttgggtcatagacccgttattaacggtttgggccttggaaccacggaatgtcatcccttccacctggcagtgagagtagtggactcctttttcctaaccaatcattccacggttcccgttccccatttaaccccaatatgcttttgtaccccgaaaaanccntaaa

SEQ ID NO: 667624 - DNA, 192 bp, Homo sapiens
  misc_feature (7)..(7): n is a, c, g, or t
cagcggngtatgcgacgatcaactttttaaaatggtttattgatgagcaagttgaagaagatgcgatgtttgatagcattattcaaaaattacggcgcattcaaaatgataataatgcactctttatgctcgatagcgagtttgcgaaacggacatttacgccggaagcgcaagcataaggggactctctgg

SEQ ID NO: 667625 - DNA, 420 bp, Homo sapiens
  misc_feature (355)..(355): n is a, c, g, or t
gaacgctcatccctgaccctggccacgggctttaaccaaagaggcatctatgtgatccaggcacgcgaagttggccaaaagatttccccagacacggttctgcacttgatccttcctgagagccctggcagccacgaggagtcacgagagcactctttagaggaggtgaaggagcttttgaacaagttgatgctgatgtctggcaagaaggatcgtaacaacacggaagtggagaggttttcagaggtcttctgcagtgtgcagaggctcagccaggccttcatcgacctgcactctgctgggaatatgctgttcaggacgtggatcgccatggcctactgctcccccaagcagngtgtgtccctccaaatggacttttggcttgtacctggtgacggagcttaaagatggtggagatgt

SEQ ID NO: 667626 - DNA, 335 bp, Homo sapiens
tgaaagaaggactgagaaatatgaggaaaaaagcagcaaaaactgaattggctggctgggcaccgtggctcatgcctgtaaccccagcactttgggaggccgaggcgggcagatcgcaaggtcaggagatcaagaccatcctggccaacatggtggaaccctgtctctactgaaaatacaaaaattagctaggtgtggtggtgcatgcctggaatcccagctactcaggaggctgaggcacgagaatcgcttgaacccaggaggtggaggtcgcagtgagccgagatcacgccactgcactccagcctggcgacagagagagactccatctcaaa

SEQ ID NO: 667627 - DNA, 487 bp, Homo sapiens
cctagaaggaatatctcacacagcaaggaaataggcaaaaaggctcaacaatgaaacacggagaacggtgaagcctcctgcctagataaagccagcacgtctggcagcaattccatttccgtgagggcgttccttgatgaagatgacatgagcttggaagaaataaaaaatcggctataatgcatctcgacataacagcccgcccacggtcggtgcttttggacttacgaggtgcagcgccgttccccttggtagcaggaggcagacctcatagaagccgccgagccgggaggtccacacagcagcagaaatgggctctgccatcctctgaatcacagcaggaccctggcgggccaagagaccaaaggccccccgtggggaggaagcgcatctgccacctgtctcggatttgactgtcgagtttgataaattgaatttgcaaaatataggacgtagcgtttccgagacaccagatcaacatactggc

SEQ ID NO: 667628 - DNA, 131 bp, Homo sapiens
  misc_feature (1)..(1): n is a, c, g, or t
  misc_feature (28)..(28): n is a, c, g, or t
  misc_feature (31)..(31): n is a, c, g, or t
  misc_feature (35)..(35): n is a, c, g, or t
  misc_feature (42)..(42): n is a, c, g, or t
  misc_feature (44)..(44): n is a, c, g, or t
  misc_feature (49)..(50): n is a, c, g, or t
  misc_feature (54)..(56): n is a, c, g, or t
  misc_feature (58)..(58): n is a, c, g, or t
ntaacagaaaaaaaaaataggcatgganttnaagnttcaacnangtacnnggannngntcttgttttgttatataaaaaaattgtaaatgtttaatatctgactgaaattaaacgagcgaagatgagcatc

SEQ ID NO: 667629 - DNA, 199 bp, Homo sapiens
atgtgttatgaagaagggggtgaaataggaccatttaaaccacagaaaaccctctgtacttgtctagcgcctggcagaggggggcagcatgtgcagcagcttggctggagcctggccctatttgtagaggatatcgtagtgtccaggccggtagagaaggtagaccttggtactcgtgagccctcaggggaagatgtgc

SEQ ID NO: 667630 - DNA, 131 bp, Homo sapiens
ggctttccgaaggccatgatctgctccaagaagatgggaggaagggagccccgtcctccaaggcagcacccccactttcaactgaatcaagtgaggaagaggctcagagcctgactctgaggggttccgcc

SEQ ID NO: 667631 - DNA, 963 bp, Homo sapiens
tagtgcacgatgggcgtttggttcatggggcacagtggtcacattggggcacccttgatgggaacctggtgtcaaattgcctttcaggtagggaatacttgtgcttgtagtagtgggcccaatgatagcgccctttgtcttctgttttcttgcggggatatcgggttctttggagaatggtactgttggctaccttgcgtgccattgactccctcaatccgagactagatgtgcttgagcaacggagttcatggaaggtcaaagtgggttctcgtctcactgtgccctcttatggaactaaccctagatccggtcccatgttcggctaacagcgggctcaaggaacaaatggaatttaggggtcttcttgacatgcgctgttgagcagtaggagctgttctcccatgccccaagtcctatcacagtattcaggtagaggtaggctagggaggggtttagtcctttggtcccagatacacaagtatctcggctggcttcctgatggccatccctaccctacagagtgtgggggataggggtgggggtgctgctagtagaattagtactataagaatgagaaccctaatgtaggttccattcgccaaccatattctttggtcctctctgcttcaataccacgcaccttgtccaatctccagattaatgttatcgggtgtgtgtgtgtgtgtgagagagagtgtgtgtgacgatatgaatgcatgtatttgtatgcttgcaggagatggcatattacttgagccaaaccctttctctggcctctcaccttcagggaggatgagtggaaaatagcctcctcttgcccaaacatgaagggtgcttgaggtcatcagcaggagctgaagaacacaatttggggaacagaagggcattttgttttggagggttttgttttttaagatgaattcaacagcctggtggttataatgtctcggacccaagcca

SEQ ID NO: 667632 - DNA, 411 bp, Homo sapiens
atcttccgtgactacatacttcgcgactacatacttccgggactacatacttccgggactacatacttccgtgactacatacttccgggactacatacttccgggactacatacttccgtgactacatacttccgggactacatacttccgtgactacatacttccgggactacatacttccgtgactacatacttccgggactacatacttccgggactacatacttccgggactacatacttccgtgactacatacttccgggactacatacttccgggactacatacttccgggactacatacttccgcgactacatactaccggtactacatacttccgctgccaacatatttcggaagaatacatactcccgacgaccaaaatactgccgctacctacatggggaa

SEQ ID NO: 667633 - DNA, 264 bp, Homo sapiens
ggggtcccccgggccctggggggcccccccccaaccctgtttccggggttttcccccccttccctttcccaagggttggcccccggggggtgaaagggtgggggccctcccccgtcccccccagggcgcggcccttccccggggggattttggttttaccccaaaggttccccggggttttttttttccccccctttcccccctttttttttttgggggggggttgccggccgccttcccccaaaaaactttctttttggggga

SEQ ID NO: 667634 - DNA, 306 bp, Homo sapiens
  misc_feature (133)..(133): n is a, c, g, or t
aagggctccaggggacccacccacccttttccctggaggaaagtcaggtgggctcaaaaaaagccctcaaatttgggccctgggtcagggtggggtcaagtccaccctttaaaaaaatggactttggaatttnacgtttgggtttgaatccagcttccaaccctccctgggtgtgtgactttgggcaaaataacttttccccttgtccccatgtgtcattggagataaactaccccccccccagattgttgttccatgctgggcaaaccctaagtgtttaataatggtagccccctgctcttgtta

SEQ ID NO: 667635 - DNA, 188 bp, Homo sapiens
tatgtctgattcagtgttttaatctgacgcaggcttatgcggcaggcagaatgttttccatgttacttcatactcaacattcagttcttctcatcagggtgatagcattggtccacattaggtgtgcaggagttcagttcatatgtcgccaatgcagagatttacaatctcctccattgcgccagctt

SEQ ID NO: 667636 - DNA, 252 bp, Homo sapiens
gcatacttatgcatgcgagatccctctcatacattggcacctggtaataaagggaatggctcctccacccgtcatgcgttgagtggattcacgactccagacctccgttcttggtttgtcattagcctttttcgcttatctaaaatgccccctcttcttataccctaaaaccttctacactagtgccatgggaaccaggtctgaaaaagtagagagaagtgaaagtagagtctgggaagtagctgcctataa

SEQ ID NO: 667637 - DNA, 375 bp, Homo sapiens
acggcggaagcgacgtgcgtgtgtgtgtgtgtgtgtgtgtgtgtgtgtgtgtgtgtgtgtggtgcagagagtgacaccccacaggtctctgtcactctctcttttctcctctatgggtgtgtgtgtgtgtatctgtctctgagaactctcggggcgcgcaggagatgtcaggacggggaaagcccgccctctctatcttggtgtgccttgtgtgtgaggagcccacagtgatgtatgtcactatctaaagcccggggtgtgtgtgagcgcgcgctccgtggggctgtgccttcgtgtgtgaggcgcccacaagtggggtatgtcgctaaataaagcacagggtgtgcgtgagccctcgcgcggggggctgtgccc

SEQ ID NO: 667638 - DNA, 478 bp, Homo sapiens
cgacaatatacaaacagcacatgaggatccgtcgcgcgccagcatcacggcacgtgtccctagctgaccagaggacagatggtaacaagtaatacaagaaatataaaattaaataactctataatagtataaaaatagctagaacttccatatgagttattcttacaatattaaagttacagataccctgtaactgaattaccttcattgacggcatacagatgaaaatcgatttcttatccaaatttaaaatttctagagtgacagctgtgcttgaaggggtccctactcatactacccattcttactgtacatacccagatacaaatgaacattgctccaataaagatatcttctaatacagacgccttggagcgaagtattagtgacctttccaaggtaactgtcatcttaaaatttaacagtgatttattaagtctaacaataatctgatattaataaaaataaaatcccctaa

SEQ ID NO: 667639 - DNA, 104 bp, Homo sapiens
tggtaccacttacgccgcccttgacaacctcaaagacgcatggccggccagccgtcgaccctggtgctggtgatcggcgagtcaccaaccgccagcgcatgagc

SEQ ID NO: 667640 - DNA, 395 bp, Homo sapiens
  misc_feature (1)..(1): n is a, c, g, or t
naaattggaagtggtcatggtactcaatgaagaatatgagtatgaagatcaggactgtattcccatgtacattatgctattggaatagttctttcatacattatattcctctgtaactctcaagcacatgtgagtgttacgtttgttaagaaagtataggatcaattacattagtatagctacatgattttcatatgtgatcttcatttctcttgctcaccaaagagtatcagtagtatagttttgacagagttggtgttgatcatttcagttcatagtagtttgcgagaattttgatataagtaagaggggtgttttatccttgttgtagggtgcccatgtcgtaaaggaacacctcatggttcatagtcctttgggccgaattcctgcagccc

SEQ ID NO: 667641 - DNA, 1072 bp, Homo sapiens
ttctatttgggctgtggtgttctcccccatgtgggctttgtttttaggggtcagggtgtttcccgtccctcttgcgcgggtctgcccaccgttgtggagtctccccgtctgaggcccaccgttgttgcggcgagtccctccccatgtggtctcggggtgccacgtgatgtgaccgcttcgtcccccccgagttgatgctctcgtgtgtgtgaagatttttgggggcgcgcgtttggggtgattttaagtatcgcgcccttcacccacgttccagtttcgtgcaagccccccccctgggccctgtatcacgcactggcccgtatccgccccttgcgcctgggtagcttattccccccttattgaaggcaataaattgatacacccaagcgttccaatctgcccttacgcacacaaccagtactctttaaattcgcctcacattgcaataactccttcacaatcagccccacaattagcccctctgttagtacaccagccccattctgccatctccataccccccccttgatagcctttctacctggccgcccagatcaattctctcaataaatctcccccccccgggaccttacaatcctctccattacatatatcctgcccttacgccaatacctctcaatacttcaccgataccgccactccacaagtccgcatccataaatccttcttctcaaggacttccaaacttttactccccactatataagcttttttgatagactttcttacgccagacctccgcttaacctccccttaccccccaccttttaacctactgggagaacttcttctttgctaagtaaccaccgttttcctgatcacaatatcacctttcctaacttaccacggaactcacaacacatactagtcaccagccctatactccctttacatatttaccaccaacaccacatggggctcactcaccccccaccatttaccacattaaaccctcattcacaccgagaaaacaccctcatgttcaaacaccctatcccccattttcctcctatccctcaaccccgacatcattaccgggttttcctcttta

SEQ ID NO: 667642 - DNA, 578 bp, Homo sapiens
  misc_feature (367)..(367): n is a, c, g, or t
  misc_feature (527)..(527): n is a, c, g, or t
  misc_feature (536)..(536): n is a, c, g, or t
  misc_feature (563)..(563): n is a, c, g, or t
  misc_feature (572)..(573): n is a, c, g, or t
  misc_feature (575)..(575): n is a, c, g, or t
ccggttgggcgccgcgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggaagccagttctgcttctcggccaaggagcgatttgctggtgtagacatccgtgtccgtgtaaagggtggtggtcacgttgcccagatttatgctatccgtcagtccatctccaaagccctggtggcctattaccagaaatatgtggatgaggcttccaagaangagcaatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataanacagttttntgagggatttcatcacgtttcaagaanagaaaagannanaag

SEQ ID NO: 667643 - DNA, 339 bp, Homo sapiens
  misc_feature (277)..(277): n is a, c, g, or t
  misc_feature (314)..(314): n is a, c, g, or t
tctcctacccgtcagacgctgaactatgtggaatttgaagtcaggtaatggggattttttcgcttttgttctttttgcttaggatagctttggctattctgggtcttttgtggtttcatataaattttagaattattttttctatttctgtgaagaatgttattggtattttgatagagattgcattgagtctatagtttgctatgggtagtatggatattttaacaatatgaactcttcctacccatgaaaattgaatattttccatttttttggngtcctctttaattattttcaccactgttttatagttnttattatagagttcttttatttctt

SEQ ID NO: 667644 - DNA, 592 bp, Homo sapiens
  misc_feature (541)..(541): n is a, c, g, or t
  misc_feature (550)..(550): n is a, c, g, or t
  misc_feature (577)..(577): n is a, c, g, or t
  misc_feature (586)..(587): n is a, c, g, or t
  misc_feature (589)..(589): n is a, c, g, or t
ccggttgggcgccgcgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggaagccagttctgcttctcggccaaggagcgatttgctggtgtagacatccgtgtccgtgtaaagggtggtggtcacgttgcccagatttatgctatccgtcagtccatctccaaagccctggtggcctattaccagaaatatgtgtgccatgacggtcttccacagcaacgggagcatcaaggaggatcgatgcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataanacagttttntgagggatttcatcacgtttcaagaanagaaaagannanaag

SEQ ID NO: 667645 - DNA, 205 bp, Homo sapiens
cttatctagtgttactggacggacaccctcaagatacctcactccagtatgactcctatggctctacactctttgagttaaaaaactaaggaggttcttatatggaataaacaggtattacgctatttaaaggagagggctgcgcaatgcttgattatgggctcttcaagattgggaggaccaagcgtatgtcacttttcttcca

SEQ ID NO: 667646 - DNA, 413 bp, Homo sapiens
  misc_feature (5)..(5): n is a, c, g, or t
  misc_feature (82)..(82): n is a, c, g, or t
  misc_feature (97)..(97): n is a, c, g, or t
  misc_feature (101)..(101): n is a, c, g, or t
  misc_feature (156)..(156): n is a, c, g, or t
  misc_feature (179)..(179): n is a, c, g, or t
  misc_feature (215)..(215): n is a, c, g, or t
  misc_feature (326)..(326): n is a, c, g, or t
  misc_feature (348)..(348): n is a, c, g, or t
  misc_feature (375)..(375): n is a, c, g, or t
  misc_feature (397)..(397): n is a, c, g, or t
  misc_feature (407)..(407): n is a, c, g, or t
gcacnaagcggctccagggtacgtccccgccacgccgcatcgcaggatcggtgcgtggtgacgtttcgccggcgcgggccantcccggaagcgcganaagngccgccagatgtgcaggcagcggaggaggagaaagagatggaccttccggaattnggcttcgagggtcttctgcggcngatcctgagcatggtgaacacagatgatgtcaacgncatcatcctggcccagaagaacatgctggaccgctttgagaagaccaatgagatgctgctcaacttcaacaaccctgtccaagtgcccggcttgcagcagatgagcgaacntttccttgcaccacacgaaganccttagtagagattaaaccgggacctnggacaagatttttcggcgtatnaggacgcttnaaagga

SEQ ID NO: 667647 - DNA, 372 bp, Homo sapiens
atctatattcaatttctaactccatatatcaaacaataatacaggatatttggtcatgctaatattcaaatatgggtttaccctcacttcataattcctcttctcccctcctaccttaaatctaataaagttctcattatcaattggaaattcataattcttaaaaagccaattggatgctgagttgaatgattgtctttacagggtccaaatttaacttttcagcgacctgtaagccatggaaagattaactctcatctcctatcaaagtaaactcaaagctctatttggctggggaatgggtgttaaatatgctatggtttggtaaatccgtgctccgacgaatagtctgaagtgcaggatggctgtaga

SEQ ID NO: 667648 - DNA, 421 bp, Homo sapiens
gtccccccccccattgaaagcgtcccgattatgggttaacctccccttgggcaacaacaacaaggaaaggaaccttagggggccccttagagcaccggaaccccggagttccgcccccctggggttcccaaccccaaagtggagtcaagggtgggcccctttggggcagccaaaaaaactgccgaatgcatcccttaaactcccgaaagaggccgtaagggaccccgccccaaagaaccccccacccctattccccccctgggttcccagggagcccactcggttttaaaaaggaggagggattttggggtccaaactgccgtttgggaaagcatgggccccggatttgttttttattccttcccctttgggggaaattttttgttttttaaaaatgataaatttgggggttgggccctta

SEQ ID NO: 667649 - DNA, 525 bp, Homo sapiens
ggggcaccgcggtggctcaggcccaacacttggggagacctagacgggtacatcacttgaggtcagccgttcgagaccagcctggccactacggcgttaacaccgtctctactaaaaaaaaaaaaaaaaatacataaaaaaaaaaaaaaaaaaaaaaaaaaaaacagtggtggcgcgccgcgcgccccggcgccccccacaagaaaaggacttttgaaacacccccgggtggggggcggcgcggggcccaccaacgaggatcaagtagaccaacgtgggccaactacgaggtgttcctcgaagaggacaactccggggcgcagagacacgacaggggcgggggtctctcctacaccaacaatataaaaaacgcgcggggggcgacaccacgagcggcgtctcgtaacaaaactccgacgaaggaggagctccgggagggccgacaacagcgcggacctcaactcaaacggggacccacgagagagagagccataatatcaaaatgagccccgcgcaggggagagc

SEQ ID NO: 667650 - DNA, 149 bp, Homo sapiens
gccggatccttgactgggcgggaccttagaggtggggacgcagagaattctcttatccaacatcaacatctgggtcagattgaactcttcaatctctgcactcaaagctgttaagatagttaagcgtgcataagtgcccgccaatcgaa

SEQ ID NO: 667651 - DNA, 323 bp, Homo sapiens
cgccttaaataggactccagtctatcttattggctataaagcagaagtcaggcagaagagtgcctctcacagcacaacctgctttaacaggttatagtttagatgtttatttgcttgtcagaggtttttctgtcacccaggctggagtgcagtggcgacaatcttctcatggcaacctccaactcctgggttcaagcaattctgcctcatgcttcctgggtagctgggagttatcaggcacccgccatcgcacctggttaacttttgtattttattgtagtagagacggggttgcagcagattggccaggctgacctcgaact

SEQ ID NO: 667652 - DNA, 440 bp, Homo sapiens
tgcatgcttttggtgtctctgaggttcccgctcagtcctggttgatgctggagtaggtcacttgagagatatgctgccgggcctagctcacgacgttcttcgccctgagctgctctcccattcctcatgtgaccctgacattccggggaactgggacccctgttccttattggctacatcagtcctttctttcctctcacaacagaggatcatgttctccgtgaatgcacttttcatttacagctctcaaaagaatatgccttctcaaggaatttttaatgcacttttcttgaatgtcagctcccagtcatcacgagcttgggtgttgtttgggcattccccggctcgggggcggccgctccaacatgtggttccagcggccatgacgaagtacctgcccacgtaccgttcctactatgactcagtggacccccgcatca

SEQ ID NO: 667653 - DNA, 630 bp, Homo sapiens
  misc_feature (40)..(40): n is a, c, g, or t
  misc_feature (67)..(68): n is a, c, g, or t
  misc_feature (84)..(85): n is a, c, g, or t
  misc_feature (99)..(99): n is a, c, g, or t
  misc_feature (101)..(102): n is a, c, g, or t
  misc_feature (104)..(104): n is a, c, g, or t
  misc_feature (106)..(106): n is a, c, g, or t
  misc_feature (127)..(127): n is a, c, g, or t
  misc_feature (138)..(138): n is a, c, g, or t
  misc_feature (307)..(307): n is a, c, g, or t
  misc_feature (311)..(312): n is a, c, g, or t
  misc_feature (314)..(315): n is a, c, g, or t
  misc_feature (335)..(335): n is a, c, g, or t
  misc_feature (337)..(337): n is a, c, g, or t
  misc_feature (344)..(344): n is a, c, g, or t
  misc_feature (430)..(430): n is a, c, g, or t
agggttgggagttctctgggcatccattttttttaaaggnactggacagagtacacacaggaaaggnngctgttaccctcttgnnatctggttcaaggngnntntngtttagcattctttctttttntcttgattggntggggccacatgatgggcagctaggttttgggctgtcccactagagcaggttgtaaacatagccatgtttcagtgaggggttgatctttttccctggtgttccaacctaccagtgcaacgttatagcccagagtgagttctacaagcgttgctggcctaatggatgggntggnngnngggggtgggataggggttgntngtggggntctggggtccatcacggcacaggaacaacacgcatggtgttggtgaagctggagctagggcgctatttggttagcacaatgaccanattttcttttttgaagaagcctcgggccttgccaacattcatggcaaagttcacccggaggtccacgtcctcagcccaggcctcctggactgggtccttgcacagcacagggaagatgccacggtacaggtgggcctgacgagctgtctggggattccgggtcacagcaatgatgggggcacgtgggcggtatctgggca

SEQ ID NO: 667654 - DNA, 756 bp, Homo sapiens
agcggacagaagtccagtcattcttggcaggatggcttctcatcgtctggtacatcgctctggccttgttggactggtattcgtgtctgaggctggccctacgggtcaccggtgaatccaggatgtgtacctcctgatggtcaaatgttctagtatgcgtaagttgggaggcagaccatgccatcagagtgggcgtgcttgtgttcagaagaggctcgtgatgacacctgggagccatgagctctgctgggtaaaatcagtgagtgatggagagctgaatgggctcacaactggaggatgaatttgtggagaggatatacgaagtggatgtagaactgaatcttatggaaggtcatttggctatcttgcgcataaccagggacgcatgcacgaggtggtattcagcgatgccaacgattccgggccgccgccgatacagctaatgccagccctgatgagcgcactactcctattactaccaaggatgtcaataatcgaatctccaaggaatgagggacggctcctccagagggacagtgaacgacgaggggatggggattccatgtatccacggagtataccatgtcgacgtaaaagtcagtgtttttcagctcaatatgctatggttagaagttccaaggccagagtacccataactatcatgccctgcggaagagaccactctcaaaaatccattccttctcaaagatggaatctgactgaaaaaggggggaaaaaccttcaaaggggggggcc

SEQ ID NO: 667655 - DNA, 165 bp, Homo sapiens
tatatattgtatgcggttatactgcacgatatatgagatgaggaatctcaggttttccaacaattcaatactaaaaatacaaaaaattagctgagcgtcgtggcggacgcctgtagtcccaactactcgggaggctgagccaggagaatggcgtgaacccgggag

SEQ ID NO: 667656 - DNA, 1045 bp, Homo sapiens
agccgccacccgtgtatccagtgctgactggtcgtgggtgcatacatgaggagataacctggaccaggtgggcactgacaaaacgtgggaaacccctattcccagccccaacgctgctcgtcctcttcatactcactatttcccactccaagcccagcccatggagattgacctggatggggcaggccaactggctctcacctctaggtccccatactcctatgatctgagtcagagccatgatcttctccctggaataagtagaggccactgtgtaccttccgctatggagctatattccaggcttctgctaggaggcctagggacaactgcatcccacctcctgacacccttctcccactctcctaggcatactggacctctgggttgggatcagggagtaggaatggaacagcgatggagcatcaacagcagggtgggctatgtggggcctgggaggggcaatcctcaaactgcggggtagagaaggcagcacaggacgggcggcatccttctgagctcctgtcccctgctacacctattatcccagctgcctagattcaagggaaagtgggacagcattgtaggggaaggagctcctataccattaaatccttgatgatatgacaacaacccactaatacctttaggccgacccaagagatagagacgttgaagtaactcatcaagagaacttggtgcttacaagatagtacgagacaaggaactgagcacctgacaggggttgactttacccaattggggatggcatgttgcaccatttggtcccccttagaatctgtgaagcacaaactaggagctgggacagaccctagaggaccataaccaccaccacaagagctaaggcacagcatacgtaatatatcagcagcaaaagggaaaaacacttacgaagcgacaaacaagcgagcacgggtgagacccaaaagggcacacgatcagccacaaccaacagagggaacacaaaaggacacacagagggcatcacgaaacacgcgcaacaacaaaagaacaacaacaacag

SEQ ID NO: 667657 - DNA, 784 bp, Homo sapiens
  misc_feature (11)..(11): n is a, c, g, or t
  misc_feature (15)..(15): n is a, c, g, or t
  misc_feature (537)..(537): n is a, c, g, or t
  misc_feature (582)..(582): n is a, c, g, or t
  misc_feature (599)..(599): n is a, c, g, or t
  misc_feature (623)..(624): n is a, c, g, or t
  misc_feature (629)..(629): n is a, c, g, or t
  misc_feature (631)..(632): n is a, c, g, or t
  misc_feature (635)..(636): n is a, c, g, or t
  misc_feature (642)..(643): n is a, c, g, or t
  misc_feature (646)..(646): n is a, c, g, or t
  misc_feature (648)..(648): n is a, c, g, or t
  misc_feature (664)..(664): n is a, c, g, or t
  misc_feature (666)..(666): n is a, c, g, or t
  misc_feature (668)..(668): n is a, c, g, or t
ggctcttcctnaggnggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacatttaatacatctacttgtcaatgtatttgagacattcacagccaaaagcnctgggactctttgtgaagtcctcctcacctctaatcttctttctntctcttctcaaactttnccttaaaggttctcattgcctttnnactgntnntgnnaacagnnttngncttcttcccacctttngngngaagtgccgaacattcctggtgaatgacactaatgcccttgcaaaggtgattgccgaataagccggtggttaccccaagtttttgttgataagggcgttatggccctggccccctt

SEQ ID NO: 667658 - DNA, 244 bp, Homo sapiens
tacccaggcaggtttgaagcacacccgtatatccccaaaggaccagcaagtattcattccgtgcatgacgtcccagacactccttctgcttctcagactctattccgactaccctcgcaacgatggaggaaacgcaactagcaaatccaatctaagcgctgctccgaattctcccatgctgctcatcgaagtcgtggcatggagccccgtgcggttactcaggcagtatgttcgccaacgaacc

SEQ ID NO: 667659 - DNA, 149 bp, Homo sapiens
agatatggtgaggcatctcgcgagttacgttcataatctgatgcatggagatgaagatgaggagcccgagagccccagaatccaataatatcggagggtgtcgttcaaaggtagtggattacccccaagtgtgtctttaatatcttgta

SEQ ID NO: 667660 - DNA, 263 bp, Homo sapiens
  misc_feature (17)..(17): n is a, c, g, or t
gagtttagtgtcattantcactctgtatacctttttgtacccatagtagctctcacttataagtgagaacacacagtatttggttttccattcctgagttgcttcacttagaataatatcctccagctccatccaaaattgctgcaaaaaaaaaaaacccacaaactttattgggtcctttttaatggcaaggtcatatcccagggggtagagatcccacttttaatttatccactcacggctgaatggggtggctcccacat

SEQ ID NO: 667661 - DNA, 342 bp, Homo sapiens
taggtaggcagaagcgagcctacaacttggagcctagtgtagactgtcacagtaaggagtttgaagtcctgaaagcagcttgagagctgtaggagcggccatattgggctttggagcaagatagtctaaatcaaagtaaagagatggagacgcttcagcaaccagatggcaggttgggcatgggagctgtggctgtgctgagctgagaagcctcagactgcctgcgaggctctctctgggaggaagtcaggtctttctttccttcgtttccttcctttcattcctttcctttccttcctttttcctctttctttcttttcttttctctctctctgcatgacg

SEQ ID NO: 667662 - DNA, 801 bp, Homo sapiens
cctatgaactgtgagaactgagagcttcctgcatgaggctggctgacctcaacgaagttcagtgtgactgtgctggtggaacgagtttgacggaggtgatcgaggactggtacatgcgaccccaccagtgcaggaacacctgacttgcacttccgtctgtcgccatgccacgtgtcgtgatatggaacagtacaccacgtttgccatggcagcagcagtgtgctctcggcaagatggtggagactatcagcctgctccctgggaacgtggtagaggacacgtcgcaacgagaagcaacgaggctgtcagtggcccaatggcaagacaggcaggtcgagggagttagtcaccaatccaatatagcaatagatgggaagggaagcctgggctggcctatctgcagcgcgacgagcccaagacgcgccagaacgcacgcgaatgacgggcatctcgatcaatcgctagtccccctcatcaactactaccagccaccaccgtgagactggaggcgtacgtagaagcactctcaacccacgaggctactcgcgtgcgtggctccctgcaggtaccccgcgtgtgagtcttctgcacagcctagaccgtgaggcatcagcgagggtgcattagtgccatcctttggcctagcagccagcgtgacttgcgcacacccagccacagccctttcatcgcccccccctcccgtctgctcttttgtgccttggtggcccgctcctttcatgcccacccggcacctccgaccagcacaccgccctccgcggcaatcgcaagctcaatcacgcg

SEQ ID NO: 667663 - DNA, 1231 bp, Homo sapiens
atacatgggaagtatcatcctgctatatgcgctggtctttcattgtcgttcgttagagacgtggaagtatacgtcaggaacaatatccagctttggatgtggtgaaggctgctgtgtgctccatacacatacggaggatttacaaagtatgcgtgtatatgtctgatatttgcgttcgaaatgccgctacaagtaaaaacacatcgccaggactatctgtgattcttatacttcacctatatgtaagatgatggtgacggcttccatgcttttgctcttgatctgcgcatttagcgtcgaagccatggcgagcttaacattgttaacctagggagaagaaatatcacgaagaagaatgcgtatactatgcaggtgcacggtcagtaattaaccgtggacgaacaacctggtgaaaaattcagaggatattgtctcatggaggagagtcaacgttcaaacatagtaaggaactgcgcacctatgcctggtaaggcaccattatctatgtgggtagagaacgcgtcgtacagaagttggggagaaggatgatcacctaggagacgcacaagcaatatccctataatgccacgtatatacaccagctccacacaacattggcttatcctagaggtttgcaagtgcccgtacacatagggcccttcaaacataccttctgggttcaattaactctcgtggagaaccaaagctaagttagtaacccaatgcgtaggtttggaaaacagagggataacatggttaggaggaaaaacaaaaacaggagagagttcattatatagtgtcagaggcacttagataagtacagattacgcagttttacccccttgggactagaacttaccaaacagtagagggaaaaaagtaattatgtaagacaatatggttatgggaggtagaattgcaaaggcggtcataaaattatacttaatctcacccatgtgccctattatgtacccgttgcttatggggcgactcccaaagttatataggagaccgttatctaccgattaaaaagacatggatcgcgtgagacccaatgtagagggtcacgaatatttacagaagcgtgattatgacgccgcgccgaaaccgcgtttaggaaattgacatttacaatggagtgagttcaacacacaaatttttcccgatttcaagatgtcaacacaatgaggtaagagcccccagaagccagaagaactgtgtgtatagggac

SEQ ID NO: 667664 - DNA, 362 bp, Homo sapiens
  misc_feature (39)..(39): n is a, c, g, or t
  misc_feature (109)..(110): n is a, c, g, or t
  misc_feature (114)..(116): n is a, c, g, or t
  misc_feature (121)..(121): n is a, c, g, or t
  misc_feature (136)..(136): n is a, c, g, or t
  misc_feature (138)..(138): n is a, c, g, or t
  misc_feature (144)..(144): n is a, c, g, or t
  misc_feature (148)..(148): n is a, c, g, or t
  misc_feature (160)..(160): n is a, c, g, or t
  misc_feature (169)..(169): n is a, c, g, or t
  misc_feature (171)..(171): n is a, c, g, or t
  misc_feature (177)..(177): n is a, c, g, or t
  misc_feature (217)..(221): n is a, c, g, or t
  misc_feature (223)..(223): n is a, c, g, or t
  misc_feature (225)..(226): n is a, c, g, or t
  misc_feature (236)..(236): n is a, c, g, or t
  misc_feature (242)..(242): n is a, c, g, or t
  misc_feature (251)..(251): n is a, c, g, or t
  misc_feature (260)..(260): n is a, c, g, or t
  misc_feature (362)..(362): n is a, c, g, or t
tttttttaaaccattaaagtaaaatccataattttctanagagtacaacacaagttcacacaaaaaagacattttcttttgcaaatcaaaacaggaaagaaaggaaaanngcannnaaganaaggggggggggttngngggggngggnggggggtgggtngattgggtncngttgtnggtggagaacagactgtgcgtttggtcatagtggcaattnnnnntngnnttgacattgngaaatnactgtaaanttgttttcnagtagaaaaggcaaaaaactgtacaaaacccctagtgttaaatacaacgtttgtaccaataaaaaactcacacaggtttgtctccaaaatgtaaagtttctn

SEQ ID NO: 667665 - DNA, 675 bp, Homo sapiens
  misc_feature (133)..(133): n is a, c, g, or t
  misc_feature (162)..(162): n is a, c, g, or t
  misc_feature (201)..(201): n is a, c, g, or t
  misc_feature (204)..(204): n is a, c, g, or t
  misc_feature (208)..(208): n is a, c, g, or t
  misc_feature (249)..(249): n is a, c, g, or t
  misc_feature (261)..(261): n is a, c, g, or t
  misc_feature (264)..(264): n is a, c, g, or t
  misc_feature (269)..(269): n is a, c, g, or t
  misc_feature (290)..(290): n is a, c, g, or t
  misc_feature (298)..(298): n is a, c, g, or t
  misc_feature (309)..(309): n is a, c, g, or t
  misc_feature (337)..(337): n is a, c, g, or t
  misc_feature (347)..(347): n is a, c, g, or t
  misc_feature (352)..(352): n is a, c, g, or t
  misc_feature (363)..(363): n is a, c, g, or t
  misc_feature (393)..(393): n is a, c, g, or t
  misc_feature (447)..(447): n is a, c, g, or t
  misc_feature (467)..(467): n is a, c, g, or t
  misc_feature (471)..(471): n is a, c, g, or t
  misc_feature (481)..(481): n is a, c, g, or t
  misc_feature (488)..(488): n is a, c, g, or t
  misc_feature (511)..(511): n is a, c, g, or t
  misc_feature (517)..(518): n is a, c, g, or t
  misc_feature (535)..(535): n is a, c, g, or t
  misc_feature (542)..(542): n is a, c, g, or t
  misc_feature (548)..(548): n is a, c, g, or t
  misc_feature (550)..(550): n is a, c, g, or t
  misc_feature (563)..(564): n is a, c, g, or t
  misc_feature (572)..(572): n is a, c, g, or t
  misc_feature (585)..(585): n is a, c, g, or t
  misc_feature (587)..(588): n is a, c, g, or t
  misc_feature (597)..(597): n is a, c, g, or t
  misc_feature (604)..(604): n is a, c, g, or t
  misc_feature (606)..(606): n is a, c, g, or t
  misc_feature (609)..(610): n is a, c, g, or t
  misc_feature (615)..(615): n is a, c, g, or t
  misc_feature (669)..(669): n is a, c, g, or t
tccggaattcccgggatagtacgtccactcttctgtccagcttttaacaatctaactaatgccctctccagggtcaccctagaatcagatctgctccccagcatcttctgtttcctggtgagtgattcctgcnactttggatggccatgacgggctggagcngccttgtgacaggagcaggagggtttctgggacagaggntcntccncctcttggtgaaggagaaggagctgaaggagatcagggtcntggacaaggccntcngaccngaattgagagaggaattttcnaaactccngaacaagaccnagctgacagtgctggaaggagacattcnggatgagccnttccngaagagagccngccaggacgtctcggtcatcatccacaccncctcgtatcattgatgtcttcggtgtcactcacagagagtctatcatgaatgtnaatgtgaaaggtaccccccncccnttagaggccngtgtccnagctagtgtgccagtcttcatcnacaccnntagcatagaggtagccnggccccnctcccncnaggaaatcatccnnaatggccntgaagaagagccncnngaaaacacntggcccncnccnnacccncacagcaaaaagcttgctgagaaggctgtactggcggctaacgggtggaatctnaaaaac

SEQ ID NO: 667666 - DNA, 630 bp, Homo sapiens
  misc_feature (133)..(133): n is a, c, g, or t
  misc_feature (162)..(162): n is a, c, g, or t
  misc_feature (201)..(201): n is a, c, g, or t
  misc_feature (204)..(204): n is a, c, g, or t
  misc_feature (208)..(208): n is a, c, g, or t
  misc_feature (244)..(244): n is a, c, g, or t
  misc_feature (258)..(258): n is a, c, g, or t
  misc_feature (278)..(278): n is a, c, g, or t
  misc_feature (287)..(287): n is a, c, g, or t
  misc_feature (291)..(291): n is a, c, g, or t
  misc_feature (293)..(293): n is a, c, g, or t
  misc_feature (298)..(298): n is a, c, g, or t
  misc_feature (302)..(302): n is a, c, g, or t
  misc_feature (308)..(308): n is a, c, g, or t
  misc_feature (314)..(314): n is a, c, g, or t
  misc_feature (320)..(320): n is a, c, g, or t
  misc_feature (334)..(334): n is a, c, g, or t
  misc_feature (348)..(348): n is a, c, g, or t
  misc_feature (387)..(387): n is a, c, g, or t
  misc_feature (440)..(440): n is a, c, g, or t
  misc_feature (458)..(458): n is a, c, g, or t
  misc_feature (464)..(464): n is a, c, g, or t
  misc_feature (479)..(479): n is a, c, g, or t
  misc_feature (504)..(504): n is a, c, g, or t
  misc_feature (516)..(516): n is a, c, g, or t
  misc_feature (518)..(518): n is a, c, g, or t
  misc_feature (536)..(536): n is a, c, g, or t
  misc_feature (538)..(538): n is a, c, g, or t
  misc_feature (540)..(540): n is a, c, g, or t
  misc_feature (545)..(545): n is a, c, g, or t
  misc_feature (630)..(630): n is a, c, g, or t
tccggaattcccgggatagtacgtccactcttctgtccagcttttaacaatctaactaatgccctctccagggtcaccctagaatcagatctgctccccagcatcttctgtttcctggtgagtgattcctgcnactttggatggccatgacgggctggagcngccttgtgacaggagcaggagggtttctgggacagaggntcntccncctcttggtgcccggcgccggcgctcgcccggcgcnccgggtcttggccncggccttcggcccccccttncccacggcntttncnccccncccncccccncccccnctgccngtcctggccggcgnccttctcggctgcncccttcctgccgcgcccctgcccggaccgtctcggtccncctcaccccccgcctgtctccttcctgtcttcggtgtccctccccccccctcnctcctgcctgtccctgtncccggncacccccctcctgtnccccgcctgtctccccgcccgtgtncccgtcttccancnccccccagtcgcctcccngncnccggncccccctcctccccggccctcctcccgcctggccctgccgccccgcctctggcccccacctggcccgctccctccccacacagcn

SEQ ID NO: 667667 - DNA, 2038 bp, Homo sapiens
ggcacgaggctaagagccccattcagcccattgtctgtcttccagtgcctttccttgggggcccacggtgggggcagcctctgcgccttctttgtgccccaccagggggtcaccacccacccatgttaggaaaacaggccaggcaggacctggctccggacagcctgcagctgctgaggccttggagaccgggctaggggctatgggaggccatctaggggaggggaacactgccccgggtcagtctgagagggccctggcaaggcctgggtagcaggagcttgccctcggggccgctgggaggaggcctggggtacctgggcctgcctgaggtgcactggtgtcctgggaagccccagtggcaggcgctgcctggagactcagctccttggctggcctggtctggggaactgggtatctgcctgcaccaggctgtgagatgggccaggcagagttctccagggggcggggtctcacattgggtcctgcctctgaagacccagaagggcacacgggaccccaggggtgctgtggtggggagcagcaagcccagggacccaatgcagtgcccagcacagagggaggctgtctggaggcagagatgcctcctggcctctggacagcgatgctggtggtggacgagggccaagagggtatcctgcgcagggggtctgagcaactgtgaggagctggctgccgcaggggcctgtgggacatggtccactgggtgactgcctcgtttccaggctgcagggccctcggaagggtgctgagccggggtaacgtgtcccagctgcattttggggacactaagttgcagggggactggattgggaggcggggcaggagagctgtgagcatgggttcccagcccggggtgggtgggggtggggaaagggccctgaactctgtgactgactgttaggggcctgactgggcttctgtggaggtggctaggtggaggaggctttggggcaagcggaggtgatcactcctgggctccaggtgagggcaggagctggacctgtgcggtggcctgcaccaccagatacactacatgctggctgtgctgcccacctggcctctaaccctccccttcccgctgctgagaagccacctgactgcactgccagccacctgctgccctgacacaggatccctggcccgagttgaatcctctgcacctgcctgtctccccttcttactgtaagactcagtgaagttccctcctccttcaggaagccttccaagattacacagccaggtgctccccttctctcccaagtcctctgaatgtcatttggtgcaccctagggatcctctgcatttctcaggagccctagggtaggtggatggagggcagatcctccaggggctagggcaggtgtccttaagggtgtggggagttttgggcagggcactgtccttaagggtgtggggagttttgggtcatgacccaccccctctgaggcccctgatgatgatgtggggaatgggatcctatgggcccagctgcatgccaggcaggcatccccaggtgtaaacagggcagagcggagctgacaggtaagcagttgccatgggggtgatgagctgggcagtcctctgttgctgagtggctttaaagaaccactcgttgttctgtgacttgggggttggctgggctcatcctgccagctctcctgctctcgtttgagtgtctcctgaggctgcagtcagagcgtggtggtccaggatgctggtgatgctgggatggttgccctctctgctccatgaggtctccctacagagcacctcccccatggtggcagcagagacaaaaccctggcctccttcaggctgaggcccagagccagtctcctggtgggtaaggtggccacagggccagctggcagcagggtattggcactgagaggcacaggcctctccaacagaggtggtgccgggacaggggcagtgcctggagaccgcttaggttgtcacaactgggatttgtgtactagttttctgtagctgccataaaaattgccacaaattc

SEQ ID NO: 667668 - DNA, 1753 bp, Homo sapiens
ggcacgaggctaagagccccattcagcccattgtctgtcttccagtgcctttccttgggggcccacggtgggggcagcctctgcgccttctttgtgccccaccagggggtcaccacccacccatgttaggaaaacaggccaggcaggacctggctccggacagcctgcagctgctgaggccttggagaccgggctaggggctatgggaggccatctaggggaggggaacactgccccgggtcagtctgagagggccctggcaaggcctgggtagcaggagcttgccctcggggccgctgggaggaggcctggggtacctgggcctgcctgaggtgcactggtgtcctgggaagccccagtggcaggcgctgcctggagactcagctccttggctggcctggtctggggaactgggtatctgcctgcaccaggctgtgagatgggccaggcagagttctccagggggcggggtctcacattgggtcctgcctctgaagacccagaagggcacacgggaccccaggggtgctgtggtggggagcagcaagcccagggacccaatgcagtgcccagcacagagggaggctgtctggaggcagagatgcctcctggcctctggacagcgatgctggtggtggacgagggccaagagggtatcctgcgcagggggtctgagcaactgtgaggagctggctgccgcaggggcctgtgggacatggtccactgggtgactgcctcgtttccaggctgcagggccctcggaagggtgctgagccggggtaacgtgtcccagctgcattttggggacactaagttgcagggggactggattgggaggcggggcaggagagctgtgagcatgggttcccagcccggggtgggtgggggtggggaaagggccctgaactctgtgactgactgttaggggcctgactgggcttctgtggaggtggctaggtggaggaggctttggggcaagcggaggtgatcactcctgggctccaggtgagggcaggagctggacctgtgcggtggcctgcaccaccagatacactacatgctggctgtgctgcccacctggcctctaaccctccccttcccgctgctgagaagccacctgactgcactgccagccacctgctgccctgacacaggatccctggcccgagttgaatcctctgcacctgcctgtctccccttcttactgtaagactcagtgaagttccctcctccttcaggaagccttccaagattacacagccaggtgctccccttctctcccaagtcctctgaatgtcatttggtgcaccctagggatcctctgcatttctcaggagccctagggtaggtggatggagggcagatcctccaggggctagggcaggtgtccttaagggtgtggggagttttgggcagggcactgtccttaagggtgtggggagttttgggtcatgacccaccccctctgaggcccctgatgatgatgtggggaatgggatcctatgggcccagctgcatgccaggcaggcatccccaggtgtaaacagggcagagcggagctgacaggtaagcagttgccatgggggtgatgagctgggcagtcctctgttgctgagtggctttaaagaaccactcgttgttctgtgacttgggggttggctgggctcatcctgccagctctcctgctctcgttgtcagggtctaatccatcttcaacatctgttcctgggatgttgtgcactagttcctgaag

SEQ ID NO: 667669 - DNA, 1022 bp, Homo sapiens
agcggagacagtacttcgccgagagtcgtcggggtttcctgcttcaacagtgcttgcgacggaatccctggcgtctcgttccccaccccggtccggccgtccatagccagccctccgtacagcctcttcgaccgcacccgtcggtacatgtcccacaggcccccgtcgaccgctccagtcgccgggcagtcaccgacgctcggcgccgacgtcgtccgttagctcgccgccattgacgaccgcgtgcaccctcgtcaggtgcgccgagaactaaccaccaggatcgtcagaggcgcgcaatcgaactcacacaggaatcagacctggagcatcgtacggccatcctacgtttacctgatccatgtctgttacctactctaggaccgcgatgagtgctgggcgtattgacagaacttgtgccaaattactattctatcaccgagtctcactgaggagatgggacacatgctgagtaaaactgcattgaaggctgcagggaaccaacggaggatgggccgcctttacttgcctctcagagatagtcaaggagaatcagcactgatggatgccactgggaagcagcgggcctcaatgtggcgattggcattgtgcacttagcattttgaacatgacaagtgtgacatcaagtacactttctggaaaacttgcacagaacatgggcacaccttgtaccgcaaaaaatgagcccgcaatgtgtggatgacttcatttgcagaacagcattgacctgacattgcatccaggtgaagcgcctttcaaccgaaatagggtgaccagcgtgacccaaatttgcgccaagatgggaagcgccccgaaaatctgggctagggcggaatatactactttgacaaatcaacaccttggagacccgctgataatgacaagcctaaggcctctgggcttattaccccataaccgtggggatagttcacttggtcgccatggcagtgctttcaatgtgggggtcgtattacctttctataattgtaccaaacatccat

SEQ ID NO: 667670 - DNA, 549 bp, Homo sapiens
  misc_feature (5)..(5): n is a, c, g, or t
  misc_feature (25)..(25): n is a, c, g, or t
  misc_feature (45)..(45): n is a, c, g, or t
ccccntcccgaattcctggcttccnctaaaatacctgtgataccntagtacagtgcctacatatcagttcattcatgtggattcactgtagtacttggcatatgtcaaacttaacttttgctttttggaaccttatggaacttttctttctgaaaaaaaattttttattatggagacagggtctcgctctgtcatccaggctggagtgccagtggtgcagtcatagctcactgcagcctccagtcttctgggtttgagagttcactgaagcctccacattccgggttcaagtgatcttcccagctgggctttccaaagtgctgggattagagttgtgagccactgtgcctggccttgggattcttttttttttttttttaacgctctcggatgagtcatgcttttaaaaaggccaagtatatcatgggtccactatgaaacaatagatgtaatagccataatggtgtgttagtagtcctagttgtgtgtgtataattattagtagttcaagttatttaaataaaaacaaaaaattagaaagtgtaaggc

SEQ ID NO: 667671 - DNA, 131 bp, Homo sapiens
gtccgcactcagcatgcatgggtatgagaagccccttataatgaaagctgccagcctttcgtccttgtttcagagggtgggtcaggtggttggtgtgagaccttgctcacggtgcacccaacaagagctgc

SEQ ID NO: 667672 - DNA, 135 bp, Homo sapiens
aatgagctcggtacccttatgttctgacccacccggatctgcacctgcggtggctcgcccgggcccggtgctgtatgattcaggctctaccgcatgtggccctccttctcggttgcgagacccgttccacgggtc

SEQ ID NO: 667673 - DNA, 370 bp, Homo sapiens
catgacatcccattccattccactccattccattcctctccattccattccattccatttcattcctctcgtgttgattccgttccatttgaatccactgcattccaagtgggttgattccaatccatttcattccattccattccattccattctgttgcattccactcgtgttgattccattccattccattgcattccattccattccattaatctcgggttgattccattcctttccattgcattccattccattccattccattccattccattccattccattccattccatttcattccattccattcctttccattgcactggagttgattccatgtcgacgcggccgcgaatttagtagta

SEQ ID NO: 667674 - DNA, 156 bp, Homo sapiens
attttgcctgtgtagatttcatttattggtaattcattagtttaacactattatgtagtgtttaaatgctgctttacatatttctcctgaacctgcaatacttgcaattttcattcttcaacctaaatggaatactaattttacactgtatgggat

SEQ ID NO: 667675 - DNA, 247 bp, Homo sapiens
  misc_feature (13)..(13): n is a, c, g, or t
  misc_feature (29)..(29): n is a, c, g, or t
  misc_feature (93)..(93): n is a, c, g, or t
  misc_feature (153)..(153): n is a, c, g, or t
  misc_feature (180)..(180): n is a, c, g, or t
  misc_feature (183)..(183): n is a, c, g, or t
  misc_feature (246)..(246): n is a, c, g, or t
taaaattctcacnaaagagccctaaaacngcacatctaccataccctctacatcacggcccgaccttagctctcaccatgcccttctactatnacccccctgactctcacaacatattttgtaccaagccctcttctaacctccctgtctatnattgaacagcatacccccgattccgcncgnccaactcatacacctcctataaaaaactcctaccactcaccctagcattcttatatgatatgnt

SEQ ID NO: 667676 - DNA, 107 bp, Homo sapiens
ttgaggatccccaacggcaacattcagtgaatgcctctctgtgatgaacgaaggcagaatgggcgtagcggtgattatgcaagcgagcgaattatgtggaattatta

SEQ ID NO: 667677 - DNA, 223 bp, Homo sapiens
ggggggtcccttttttggttttttaaccccccggccgggaaaggaaccttgggtttttttttgggcttttccccggggggagccccaaaaaaaaaaaggtttttttttgtttatagccggaaccttttccctttccaaaaaataaggggggtggtttttttaaagcctttaggttagtccaagggttgggaccggtttttccaattaaaggtttttgggggga

SEQ ID NO: 667678 - DNA, 333 bp, Homo sapiens
accgctcgccctctctgcgagaacacccaagaatgatcatacaaaaaaaaaaaaattataacagcagtatacaacctacaagaaaaagatgacctcaaaaggtatttatggctggggcatgggggctcaggccggtaatcccagcacttggggaggccaaagcaggcggatcacgaggtcaagagatcaagaccatccggaccaacagggtgaaacccggtcggtactaaaaatggcaaaaattagcggggcatgggggtgcgcacctatattcccagctactcgggaggcggaggcaggagaatctcttgaacccagagaggggcggagcag

SEQ ID NO: 667679 - DNA, 622 bp, Homo sapiens
ctcgagcactcccatagagattcggccttggaacactagacagtgagccaaaaaaatgtatgcgctcacatacaattatgggttttaaaggcaagttattctaaatgagtaacttcgacatatgtccaaaggtagacatcttatggattatcattgcatactctctcccaaatattattatatcttcgacagtatttaaagtagggtctacagagtgagcattccattcccgtctctttctagtcatttgatcttgatggtaaagctgatgaccagtacaagggcccaactgccggccatgacaacaagcagaacaagaaagtgtagcagctagttcctgagctccttggatgtcacaactcacaaaggtcaatctggtcttctctattcacatgccttctttctatacagacacttgtttaacgcttccaatggggccccttcctgtccgtaggcagctgtgtgtgtctggcagcccctgagcccaggctccatctggtcaccgcctcaccgctcataggctctaacctctctttcatggacgtgccatagtgtgctttactctgcagctataaatttctaaaaattccgtaattagagcctgtcactccatagactgtgg

SEQ ID NO: 667680 - DNA, 443 bp, Homo sapiens
agcgggcgcccagcgagcgctcagggccggggccagcgagcacagccaccgcagccaccattccctggccagcagccttcgcagccaccacacacacccgagctacggtcctcccggaggccccctctctacggcccatggagatgcgcccgcccgcggccatggggcccccgaaggagcccgtaccgcgggcgcgagctggcctcagtgcccccggaactgaccgccagcagacagtccttccgcatggcatgggaaaccccaagtgagtcgttgtggatgtgatgtgagcagggccccgtcgcccagctcattccgtcccaccccgagccggctgcagtttcctcatctcccatcccagtccgtctggtggtgtaactttagtcgtcggtaccctggaaaggggcgacactaagagggaacgtaaaagtccaggaggggag

SEQ ID NO: 667681 - DNA, 1352 bp, Homo sapiens
  misc_feature (615)..(615): n is a, c, g, or t
ggcttcttcgccagaaccaaaccggttggcttgctgtcccaggcggcgccccctcatcaccgtctgctcagtgcccggagagtctggcttctacggggacgtaggttcgccaactttgagggccaataccagccgtgcggaacgcatccgtttccacgactgttactagggagactcatggggcatgctcttctcccaaccctcggggacgtttaccccagggtgcaccacagatgctgtgcaggaggctgcgagagagtctggcaccagaatttgccacagaggaatgtgaagtaggattgcccttgcaactagacagtagtggaggaccatctgcctggagcaaggatatcaatgcttacaatggtgaagagcccactagtaaaagttgacctttgtcccatgcatgcgatgataggaatcgggagcttggcatcctgtggggcatgctgggatccagcagagagaggatggaccgggcatgcctagtgacagctcgtgtggggtgtgagaagggccgtgataagaagctggagctagtctatcgctctagccaagactagcagctggagggaacttggatgagaaactcaaggggaaacagctctgtccagntggaggagaacaaagggtggcccccactgaggggggccggggaagggggatggcgttccaccattccgttaatgaagccaagtgtccgcaagggcttcaacgcgagccttggggaaaaactgcttaacccgccatatagtcaaaggcggacaagcagcaccgtgtctcacaaaacgcgtgccgacggtcgcttcctcttctgtccctcgtcttatcactacccatcttcgcactgtacttgtgcagaaaaaacaagaggcgaagaagaagggcagggacggccgcggaaggcggcagaggggggccgcaggaggagagagggagggcggagaggagcgggcagacggaacaaggctggcgggtcaggcacaatgaggagagggagcgaggcaagaagagagaggcgggaggggggagaggagagagagaggagggaggggcagggagaaagggggaggagaggggagagagggggggccgaggagagagaggcaagaaaagcaaggagaggcaagaaaaaacagaacaaagagagagagagaagacaaggaagggaacaaagcgcaaaaacaccgagccgagcgaaaggcgagagaaagcgaaagagcagaagaaggagagaaacaaccgagagaagcggacgcagcgacagaaaaaaaggaagaaacgagaaggagggcgcagagaagaagcagaaagagagacggtaagaaagcaagcaaaagaacacgaaaagg

SEQ ID NO: 667682 - DNA, 707 bp, Homo sapiens
  misc_feature (8)..(8): n is a, c, g, or t
  misc_feature (89)..(89): n is a, c, g, or t
  misc_feature (91)..(91): n is a, c, g, or t
  misc_feature (100)..(101): n is a, c, g, or t
  misc_feature (127)..(127): n is a, c, g, or t
  misc_feature (133)..(133): n is a, c, g, or t
  misc_feature (136)..(136): n is a, c, g, or t
  misc_feature (145)..(145): n is a, c, g, or t
  misc_feature (160)..(160): n is a, c, g, or t
  misc_feature (189)..(189): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (226)..(226): n is a, c, g, or t
  misc_feature (231)..(231): n is a, c, g, or t
  misc_feature (255)..(255): n is a, c, g, or t
  misc_feature (276)..(276): n is a, c, g, or t
  misc_feature (352)..(352): n is a, c, g, or t
  misc_feature (376)..(376): n is a, c, g, or t
  misc_feature (409)..(409): n is a, c, g, or t
  misc_feature (412)..(412): n is a, c, g, or t
  misc_feature (442)..(442): n is a, c, g, or t
  misc_feature (447)..(448): n is a, c, g, or t
  misc_feature (450)..(451): n is a, c, g, or t
  misc_feature (578)..(578): n is a, c, g, or t
  misc_feature (586)..(586): n is a, c, g, or t
  misc_feature (628)..(628): n is a, c, g, or t
  misc_feature (631)..(631): n is a, c, g, or t
  misc_feature (641)..(641): n is a, c, g, or t
  misc_feature (701)..(701): n is a, c, g, or t
ctgccaanagctggcggccggcgggcacagccggctcattgttctgcactacaaccactcgggccggctggccgggcgcggggggccgnangatgtcggnnttggggccctgcgggggctttcggtngccgcnaantgcctggtnttgctggatgtatanttgtctggttcttgcggccatcactcaancacatnctntcncgacacttggtctactattgcctgntgaanatcacactgagtgacctgctcacnggcgcggcctacctggccaanatgcttctgtcgggggcccgcaccttccgtctggcgcccgcccaaatggttcctacaggagggcctgctcttcacngccctggccgcctccaccttcagnctgctcttcactgcaggggagcgctttgccacnatngtgcggccggtggcgagaagcggggccacnaaaannanncgcgtctacggcttcatcggcctctgctggctgctggccgcgctgctggggatgctgcctttgctgggctggaactgcctgtgcgcctttgaccgctgctccagccttctgcccctctactccaaangctacatnctcttctgcctggtgatcttcgccggcgtcctggccaccatnatnggcctctatngggccatcttccgcctggtgcaggccagcgggcagaaggccccacgcccagcggcccgcngcaaag

SEQ ID NO: 667683 - DNA, 736 bp, Homo sapiens
gcaggaattcggcacgagggcatgtttcttctgaaatggtagccattagtaaatcatccacatactgaaggaccagagtgcctggactttagaagtggcctagatcttgggccagtgcctcaccaaacagatgagggctatccctaaacccttggggcaagaccatccaagtaagttgtgatgtgtggtctgtgggatcctcaaaggcaaagagaaactgggagtcagagtgcaggggaagacagaaggcagcatccttaaggtccagaactgtgaaccatcctgcttcttctggtatttgagagagcagggtataggggttgggtacaactggatatagaggaattactgcctcattgatgagtctaagatcttgcactaatctccactgaccattcggcttttgtactcctagaattggggtgttgcaaagactgctgcatttccttactaagctagagcttttaaatgtttaacaatatcacgtaatcctttatgagctttaggccttaagggatattgcctttgataaggaaaagtggcgggatcttttaacctgaattggactgggcaggcatttttttgcctttctgtcctttcaatgcccagacgtcagggttgatttcctcctcaagtagaggacaacaaatgggtaaccttcttcccattatcatggagataatagcttcaggcttgggttataatatctttccctaataaggtgggggcttttgct

SEQ ID NO: 667684 - DNA, 513 bp, Homo sapiens
tgggtaaaaaaaattttttttacaaaaacaaacaaggaaatccaaaaaaggcaagttttacgtccatgctttttaaaagtaaatccaacaccccaagtaaaattttaactaaataaccccaaccgtaaatgtgtaacttttggatgaacaaatagggtttatcccaggaatgcaaaaatgtttcacattttaaaaatctctcaatataattcacttttttgggagattaaaaaggaaaatcccatgaaatgagtcaattctgataaactattttttaaatgtaaaaaaccatttttgtttaaaaaataaacttttaaaaaacccggaataaaaggaaacctactaatttagtaaagggtgacagcaaaaacttctggaaaaattgagtaaacatactttttcctattcatctcactaaggacaactaaaaactctggacatttttttttttttaaacaaaccttagaagacttttaaagggggaaatgaaaaggcaaaacagctaaaatctta

SEQ ID NO: 667685 - DNA, 219 bp, Homo sapiens
ggaggctgaggtgggaggatcacttgagcccaggagattgaggctgcaataaactatgatggccccactgtactccagcctgggcaacagagtgagaccctgtctcaaaaaaaaaattaattaaattgaaagaaaaagagaaaaagaggctgagtgtggtgggaaaatcaagtgggaagatcacttgaggccaagagttcaagaccagcctaggcaaca

SEQ ID NO: 667686 - DNA, 887 bp, Homo sapiens
ctcggggttcctttaggggcgcgcccccttttggtggcagagttcatgtgcgccgcggtcttggcgcgggcttggcgcatcgccggggcgtttaatcttgggcccccttacctccggaggggcccccatggcccccgggtgtgcatcgcggcaccccctgcgccgtgtgcgggcgttactcgtgccgcctggcacttactggtccgtccacgaggtgcgctccctacgtggcctggtgcttgttatgaaggccacccgctggtgcgcatgtggcgcctcccaagtccccgtggctctgtcaccggtgggcagagagagctgtccctgtagccacctttcttggtctggccaccggcgccactttatcgccccacgcggtcggtgtttaccgacatcactcaggcccccgggatcttgttgtattggatagaaggtgcgtcctggactgtattccccgctgcgtttggaaacacatggttatcgagggtgtggtccccccctcgttggttccacatccacccgtttattgaccgcccgcctcccttcttggggagtgcgtttccataggccacgcgctgctgatccccccgccgtgcggtgcacctccctctttcagaattaaccccccgcgcccgcagacagtctgtaaacccccttttttcttgacaagggtggcgcctcatactgcagccccgctgttgtcgcgccgccccctttgtgccccgcacctcgcctgcggagcccccactgtccagcgaggtcatcgcttgatacatcccactggggcgcagcaggtctcgctggagtttgcagattctgtccaccactcagcacctcctgggcgccccctctcgcgggcttcatcctccccgacaaacaaacaaaac

SEQ ID NO: 667687 - DNA, 169 bp, Homo sapiens
ggcacgagggcagactcagtggtcagcggaaacttgatgatagcatagtggtcaagccaacaagcaccagattaacagggtgttgaccttggccaacatcaatgtcatacagcttgattcggccttgatggagagaagaaggcatattcgactggctcctgattacatg

SEQ ID NO: 667688 - DNA, 179 bp, Homo sapiens
actctacgaggatcttcagctattccaaggatatagtgcagagtgcaacatgaaaataatttctagcattgagtggtggcagtgctgaccttggtgggccaaggaacccatgaaggtcctggaaggtgtgttgcagcagtccacgccattgtgaacaagggtgaggagctggtttcacc

SEQ ID NO: 667689 - DNA, 718 bp, Homo sapiens
ggaagcgctccgggcctggaatccctacgcgtccctttgtgtttagcacgaatgacgctcgatcggcactgggtatgacctgtcgagcctctacatgtctctcctgacggaagagtttttcaagttgaatatgctatgaaggctgtggaaaatagtagtacagctataggaatcagatgcaaagatggtgttgtctttggggtagaaaaggttagtcctttctaaatctttagtgaaggaaggttccaaggaaaagacttttcaatgttgatacggtatgtaggaatggcagtagcaggttcgtaggcagagtgcgtcgtgcttaaagcagagcatagcaagagaagaagcttccaacttcagatctaactttggctacaagattccactacaagatcttgcagacagagtggccatgtagtgtgcatgcactatacagtctacagtgctgttagacccttataggctgcagctcccagtgtcagggtcttacacgcgtgaatgaccggtgcgcaactctacatggattgacccatcaggtgtgccatacggttattggggactgtgccatcggcaaagcccaggcaatgctgccaaagcaccggaacttaggagaaagcttcagcatggaacggaccctgacctggccgtgatattggcaagagaagttgccacaaataatctacatagtacatgcacgaagttcaacggctccagc

SEQ ID NO: 667690 - DNA, 160 bp, Homo sapiens
aggcgaggcaggcggcccaggtttcacctctcaagctgtgggggcagggacagagctaaaaagcaggggtgtgctcagtcctcaggggcacacttcctctacatttgggtgctcttagaaataacagcatttattgggggctcactttaactgtgtcata

SEQ ID NO: 667691 - DNA, 896 bp, Homo sapiens
caggattgtgggaatcaacagggaaccagaatcctcaaccaacgttgatcctagtgccatgcagcatccgcacgtggcaagtaggttccgtctcagtataatcattctgggtttggacagggaagatattaccctagcttgagtgctaccgcgacccttacattttcgctaagagccccaagtactagagaacttagtccacagaatcctgaataacgagctacctatattgaattactgtgtagaccaacaggatggctatggaccagatccttggggtgtgatataagtcttctgtaagcgtctacattcaattctgttagatttaccatcgggtgcttccctagatgccgaacatttgagcactactacactaatcgattcgtcgttcctctctctagtggacataaattttggggatggccggtgtgtatatatttcggcctatttaaatctgctcgcagttagtactaaatttccctccagttcagagtcatggcaagagcctcataagattctacaatagcttgcagtaagtagttatccccggttgacaattatggctgtttttgaaggatgacgctgcatcctgcacggtttggaggattgactaacgtaggataaggctatctctcatatggtataacccttctatattgtgtgctgccgttaaagtatgccaatcgctctactttttccaagccacaggttcttgccccccggagtcgacctttgggtgcccccgtgttagcttcggtgattgtggcctttgcgcgtcaggacctattgtttctgaggtctatctggggatttccgaatacaggtggcgtaattttgcgccgggaactgcggtcatttctcccccttccgtcgggcggttggtccgagggttttcc

SEQ ID NO: 667692 - DNA, 148 bp, Homo sapiens
gggacagggcctccctttgtccccaagggtagagtgcagtggtgtgtttttggctccctgcagcctcaacttcccgggttcaagcgttcctttttcctcagctccccaagtagttggggctgcgggaacgttccccccccccccgcca

SEQ ID NO: 667693 - DNA, 295 bp, Homo sapiens
gagatgtaatacaggtacagatcaaacagcttagaaagtagattggtcattttataattagaatggaatgtacattagaggccaaatgtttttatctgggtttgtcgtgattgattaaaaaaatgtaattgtaaatgcttgagaaataactttttcaatagggctccacactgtcactttgcatttaatttctttacctatcttatttgaaaatgtagcgatagctatggaatattaatacaattctgcaaacaattggtattgcaacaggcaaaccctctgcttgtcctgttcg

SEQ ID NO: 667694 - DNA, 288 bp, Homo sapiens
gggcatcacggggttttattctttatacctggcaggactagtccaagattggaatacccggaacttattgggcaagagcgatgagtactcttaaaattactatctggaaatatatattatttagagatctgccaagttaccatagatccccccgtcaacaatgtgtggtcaccaagagaacttcctgaaaagcacatgtatacagtatcataacatattagacaaatgtttcaaatggctattatatttgatacgaaccattcagttaacaaaatcctaacatcataa

SEQ ID NO: 667695 - DNA, 266 bp, Homo sapiens
gttctcccggctcagacgccagtttctgttgagtgtgggtttagtcatggggtttgtggggttttcttctacgccttctcctatttatgggggtttcgtcttgattgttagcggtgtggtcgggtgtgttattcttctgaattttgggggcggttctctgggtttaatacgtttttttacatttactttacgggggacatgactggttgtctttggactactactacagcgatggctattgaggagtactcctgggtaccgagctc

SEQ ID NO: 667696 - DNA, 622 bp, Homo sapiens
ttccaggacatcatgccctgcctctactggcgctgcccaggctgtgggcaaggtcatcccctgagctgaacgggaagctcactggcatggccttccgggtcccccctgcccacagtgtcagtggtggacctgacctgccgttttagaataacctgcccaatatgagtgacatcaagaaggtggtgaagcacggcgtcggagggccccctcaagggcatcctgggctacacctgagcaccccggtggtctcctctgacttcatacagcgacacccactcctccacctttgacgcctggggctggcattgccctcaacgacccctttgtcaagctcatttcctggtatgaccacgcatttggctacagccaacacgggtggtggacctcactggcccacactggcctccaaggagttagacccctggaccacccagcccccgcacagagcacccagaggtaagagagagaccctcactgctggggagttcctgccacactcagtcccccaccacactgaatttcccctcctcaccgttgccatgtagaccccttgaagaggggaggggcctagggagccgcaccttgtcatgtaccatccataaagtaacctgtgctcaaccca

SEQ ID NO: 667697 - DNA, 333 bp, Homo sapiens
  misc_feature (4)..(4): n is a, c, g, or t
  misc_feature (24)..(24): n is a, c, g, or t
  misc_feature (56)..(56): n is a, c, g, or t
  misc_feature (73)..(73): n is a, c, g, or t
  misc_feature (108)..(108): n is a, c, g, or t
  misc_feature (111)..(111): n is a, c, g, or t
  misc_feature (191)..(191): n is a, c, g, or t
  misc_feature (284)..(284): n is a, c, g, or t
ggtngcccaaggcccggctttccncccgcagtggcagaattgagtggtgaagcccntagggtccctgcaagcncccccaaattttacctaccaggttggcaaaccccnaancccaaaaatcctgaccataaaaaatgcccccaaagttcaaaactttcctgagtgctgacatcatgctgcaagtggaaaantccacgcctgacctcatgtgactggtcatagtcaaaacaattaagactttgtttcatgaacaaaattattaaaactgttgtataaaattaccntcagtctatgtgtataaggtgtttgtgagatataaatgaactttatgtt

SEQ ID NO: 667698 - DNA, 342 bp, Homo sapiens
  misc_feature (72)..(72): n is a, c, g, or t
tacttatcctatttatttgagacggagtctcactctgtcaccccaggctagagagcactctcggctcactgncagcctccgcctccccaggttcaagtgattcatgtgcttcagcctcctcagtagctgggattacaggcgtgtgctaccacagccggctaatttttatatttttagtagagatagggtttcaccatgttggccaggctggtctcaaactcctggcctcaagtgatcctcccgcctcagcctcccaaagtgctgggattacaggagtgagccaccatgcccggccttacttttattttatttatttttatttatttattttttctttgagac

SEQ ID NO: 667699 - DNA, 270 bp, Homo sapiens
  misc_feature (1)..(1): n is a, c, g, or t
nctctacgacggatcccctcgaacgatggcggttgggcactaacgacaggacactcgaggagccgacacgagcttatttacgcctacagagagacgaccacgtacaacccaccccacgcaagacagcagcgatgcttgtagcacacctcccaaaagtagcagaaattttgaaaagccagtttcaaccactagtcaaaaacgactgcgttacaggacagccagctgtggttgaacttgacaatcacgacaaactcttactggcctcaaact

SEQ ID NO: 667700 - DNA, 329 bp, Homo sapiens
gcaacagtcggtgtctctgatgataccacaagggtctctgaaggctctaacacaaaagctactgggggctctaccaacatgatcttcgatggctctggagatagtgctccccacagatttcagcacagactacatctgatactccactgacattgttacaactggctcagataacttcaacaccagtgtagtagtaggcacttggtgctgctgcaaaggaatccagaatctttgtcatggatggttctggcattactgccacagaccgctcttacccgaaacctcatggatactagtcgggtttgaaactgctgagccatgatgggaac

SEQ ID NO: 667701 - DNA, 109 bp, Homo sapiens
gcatgcaggtcgacgtgtatacaccactgcggtgattgcatccctgtacaagtaccgtcgacacgtagagcaccgtgctgacctccaaatatacgttaagctggagcct

SEQ ID NO: 667702 - DNA, 237 bp, Homo sapiens
gtgatctcttcgtatgaaatacagacaacgtctgtctactattccaccatgtaggcgatgatcttcaattagtaacttgtagattattgcgtgctcacatctttgagcttccatcttcactgactatcaactttttgctttttgcaaaatttaacacacatacagtttatctgatccttattctttttgctgccctttgaccgtttcatgattctcctcctctcagttcactgccta

SEQ ID NO: 667703 - DNA, 353 bp, Homo sapiens
agggaggaggggacacgggcttctcaggtctcaggaggttagctgtcctctccgtgtcaagcggtagtcgtgtctttcgcagtctaacggatctgcgttctacttgggcaatttctcgatcgtagcacgatccatactctgtattaactcttcctttgagagtttcgaaggtgaagcattttgatcatctccacatggttgccccgaaagtgggagaggatggagcttcatgttggcctccgaatgctggatccttcttagcatctgcagaagccctcagcccttctggcagcgggtgcactataggcaaaaccgcagcactgacacgctgaacatgagaatcagaaacctgt

SEQ ID NO: 667704 - DNA, 303 bp, Homo sapiens
  misc_feature (58)..(58): n is a, c, g, or t
attgggttatgtttaattttttttaaaaaaaaggctttttttttcccggaaaaatctnaaccgaataaaaaacctttttaaaaattcccttggcccggattagggtcctcaagggattttggggttttgtttggaccgcgggggtttttctccccaaaattggaagggttaacggggagcccttaaaaattataaattttgggttgttcggaaatgccttttataagttttttgggcccccaagccctaaaaactgatggtccccccctcccgcaagtattaaaaaaaaggatgttttttcca

SEQ ID NO: 667705 - DNA, 517 bp, Homo sapiens
aaagagttgaatgctgaaacatgcaccttccatgcagatatatgcgcagctttctgagagaggagagacaaatcaggaaacaatactgcacttgttgagctgcgtgaagaataacgaacgggccggcaaggtaacaaaagagcaagtgaaagctgttatggatagatttacggagctttgtagagaagtggtgcgaaggctgatcgataatggagacggtgtgccgaggagggtgaagaacttggtggtgctgagtcaagctgcgttaggcttatatactatcacaatttaaaagcatctgagactaccatgagaataagagagtgaaaagtgaagaatcacgagcttattgatgtggtatgtcgtttatgcagtatggtgtagagctcaagcagcctgtctaaaaaaacatgaatgtctttgagtcatttggcctcttttctctgtgcttgaattaataaaggatggatgaatcgagaatataaagtgctagtggggctgataactattcgccgca

SEQ ID NO: 667706 - DNA, 179 bp, Homo sapiens
tatggcagtcccaggctaagggtactactcggactgtagctgctggctatgccatagccaccgctaggtcaagtcgcgtctgtgcactacaccacagctcatggcaacgccggatccttaacccactgagaaaggccagggatcgaacccacaacctcatggttcccgagtatagcggt

SEQ ID NO: 667707 - DNA, 237 bp, Homo sapiens
agcgagcggaccttcaggctgattgcaggcacactgttgaaagcaggcatatttggccaggcgcggtggctcatgcctgtcctgtaatcccagcactctgggaggcccaggcgggcagatcacctgaggtcaggagttcgagaagagtctgactaacatggtgaaaccctgtctctactaaaaatacaaaaacaataagttggctgtagtggtgggcgcctgcaatcaagcctggaa

SEQ ID NO: 667708 - DNA, 205 bp, Homo sapiens
gctgatccgttaagctcaggagtttgagaccattctgggcaaaatggcaaaaccctgcctctgtggtggcacacttttggtcccaactacaccagaggctgacgtgggagaatcacttgagcccggatgttcgaggctgcagtgagccgtgatcatgctactgcactccagcctgagtgacagagcaataccctatcttcaaaca

SEQ ID NO: 667709 - DNA, 1209 bp, Homo sapiens
  misc_feature (843)..(843): n is a, c, g, or t
agcaagcagagcctgccagcctgactgcatacccatggctacactcgctcaccccacctgggaccctcctgcttccggccgggggcacatggcctgccgctcctgcgtggttggcttcagcagccatcagcagctgtgaggtgaccccggatgggcagacccacgtgcctggaaacctcaggatgggacagctgcagggcccccgggaccgggcttcagactcaccgcacgcctcacaggctgctggatcgagctggcactcaactccaaggtagacttgtgaacaccaggaccatgctggtagcacccctgcgatgtacaacgtttgggaccaccgccgtggttccagccagcgtgacagaaccaagtgcagaaggcaggcagatgcaagggccctcacgtgcatcaaattatgcgctcccgtaattcggacaaggttgcaaagacacctggacaccagcgcacaccaggcctgactggcgcaccaccgcatggaagacattccctgccacgggcccagcgaacctcacgcccacacatatcgacacatcgcggacaatctctactgacgggaaatatcagggacccggcatgcacggacggaacctgcgcaacagtgagccagcgcagcgcgtcggcaggctgtgaaggacaaaccatggcctgcacggtgctggcgaagcggtgcaggacgtcttcgacatcccgcggtatgagggatgagatctccacagcggcacaccacattgcagatccaccttatggtgccaagatgacagcatggaccctggaatcagaagtcgccttcacatcgggacctgaaatgtacaaacacacagcttncaaccagcctggcagaagcattcgagggcagtcgactaaaagcacagaatgaaccagcgacgccgccagggaacccgtgaaagacaacagcggtaacacggaactgctactcgaagggaaccgagatggccgcagggcacaacggccgcggaccaaccacacgacgaccggacgcgcagcaacgagaaaacaggtgcaccggccccagcaacgacagcccaggcaagaggcacgacgacgacggagccaggccgcgagagcaccacactaggaacacaacgaagcaccatggcaccacccgacacgacacgtacatcgacgcaccacaagacgacaagcgccaacggaacccaagaggaacccaca

SEQ ID NO: 667710 - DNA, 980 bp, Homo sapiens
agcgggttaacttgcagcctggtgtggggtgagtggtacccaacgggcccggggcgccgccgtccgcgagggagagcaggcgcgcggggtgccacggcgttggtaagacgagtataagatagaagagatggcgtgtccaaaatgagctctggctcatccctggacctacacagggacgcgaggaggcacacatgcgagcagcggtcatcccttgctagatcgtcactgcaggcgcagcgtgcgggatctgaacgggtccactcggtctgctgggtgcctgagttggcatacacagacccaaggtgacatgctgctagccgatggaatggtgggtacatcttgatccttgtactgcacaaggccgtatggaaggaagtgcgagacataacataggagtggagccaataatggaatgtaggctaggtatactacgcaagtgaggctaagtcctggcgcgcgacacgagattctatgcatagacgtactggcatgcgtagtggaacgggacgactacgtagacacgtgtatgcacggaacagactcggaaaggaggccgtgactacgcctgcgcaatcttgttgcatcggatcctagcttgcatctgagtttggactcaactgagaataccggattcagagaatgttaaggtatacaaccatgagaacgctcggttgctacaaggatccacaaggtgatgacatgcgaggtcacttacctgactactctgcagaacctgcgtgtggaatccctgacggtctgatttcttagctatgccggggtgccctggtgatcatgattccagtcggcagctatgcgaatgtgttagaagccctgaaatggcgaggacggtggcggctccaaagtgagaggctccacgtatgttctgaagggactagaagcagtgaacgtgcggacgatcagtaaagagaaagcaggggcgcaaggaatccgaattctcactgtgtgcgctctgaaacaaa

SEQ ID NO: 667711 - DNA, 328 bp, Homo sapiens
gtcgacagtcaatgtggcagaataaattggtgtgtcaatacaacaggctattacacagaagtatacaaactattgatacacatgactatggatagttttcaacggtattaaggctgagtgattaaaaccaagttcaacagtgaaacaccgtctctactaaaaatacaaaaaaaaaaaaaaaaattagccggacgtggtggcgggcacctgtagtcccagctactcgggaggctgaggcaggagaatggtgtgaacccggggagcggacgttgcagtgagccgagatcgcgccactgcactccagccggggcgacagagactctgtctc

SEQ ID NO: 667712 - DNA, 1419 bp, Homo sapiens
  misc_feature (496)..(496): n is a, c, g, or t
cgtgacgcgtgggcccgaggagcaccctcgtgactgctgaccgaggccccgcctgtaacccctaagggccaaccgcagagaagatgacccgagatcatgtttgagaaccttcaacagcccagaccatgtacgttagctatccaggtctgtgctatccctgatacagccgtctggccgtagcactggcaatcgtgatggactcctggtgacggggtcatccaagactgttccccatctacggacggcgtatgcccatcccccaatgccaatccttgcgatctggaccatgcgcctggcctgggaccttgactgacataccttcattgaaatgatcctacaccgagacgcggcctacaagcttcaaccacccacggaccgagcgggcacatccgtgccgtgaccactaacgcgacgaaacgcttgtgcataccgttcagccacttggcaacattcacgagaccacgacgattggccaacggccttgctcttccacccntcgctccccatgtgaagaacgacgctaccgagcactgccatgaccggccagcgatcaatcacccatcagtaccaaatgaacgcgacgccccgaaagacactagacagacacatccttccacagccctatcccaatcccttggtgcacctgcacgatccatgctggcaattccaccagagaacaaccttatcacacgtcaccatcacaatgaacattgtcgacgttgaacaatccagaccacacgcacttggtaccggcaaaagaacaaagggtgacatagactcaggccgagcgtcaactaaaccaattggatacccacttgtacctcttttgcacggacaacggcgaactagccacaacacgccgcaattacactggaccagtggtaacacaccagcacaccacacagaaccacactcacgacactcagttgatgctagcctccatgacagcgaccaaaccataactcccgatgcttgcaactgcgacaagccactcaaatcctttctccccactcaagactaccccatatccaacaaccaactatgaataaaacaaacacacaggcacaactacaacactaccacaaccccaatcacaacaaacacgcacacatattcaatacactgaacaccattacatatatactcggtacacccccatattataacacaacctaaaattaccacaacaacaacaatcaataccatgcgacactaccaactaccagtcacactcataaacatccaacactcaaataccaacacacatcagtcaaacagatcagacacaatcaaccatacaaaaacaccaaaaaatacagcacatcataactaacataatcaaacaacaacatccaagacagcaacaaataacaaacccactacagcatacatctctcgctcccttatctctttcccacc

SEQ ID NO: 667713 - DNA, 204 bp, Homo sapiens
acttctacgtttctccattgtacattcccttccatgcttttccatactattttttatttatttatttatttttcacattcttttaatgtcacttctttctatgtgcctagtttcctagggtgttgttttttttttttttttttttttttttttaaggggtacccacccggaaaaaaatacccccgggggtcccgcccccaattt

SEQ ID NO: 667714 - DNA, 130 bp, Homo sapiens
tcaggagttagagaccagcccggccaacacagggagaccctgtctctacaaaaaatacaaaaattccttagggatcaattttgacggtgggataacaagtatctcttactagtatgtcacctatatttca

SEQ ID NO: 667715 - DNA, 138 bp, Homo sapiens
caatcaatccatcatttcatcatcgtggggcatcctctcagcagtcggagcctgccaggccatgccaagctctggcctactggcctgttcgttttcacacacgtacgtgcactagggcatcagcggcatcaacaattt

SEQ ID NO: 667716 - DNA, 376 bp, Homo sapiens
ctggttgacaattggttgagcttagctgaagacctgggatcaatggaaaggaatgttcaggttaagataaaggatcgtggaggccaagttttattgtgcaggggaagctctcagcagacttcagagagagagagagcaggttgtaaactgtttcttatcgacttaaaaggggtgcctggctcttagttgatgatctcctggactggaaagaaaggaaggaaaacaaaggggaaaggggcttctttataggatgtggattctcctcacaagagactctgcagggcaagttcaaggtagggcaaagaaatatatttgggggttaaatatttttgcctcgtcgtgtaatgttatgccatagtcagattaaaaataagtc

SEQ ID NO: 667717 - DNA, 586 bp, Homo sapiens
  misc_feature (151)..(151): n is a, c, g, or t
  misc_feature (154)..(154): n is a, c, g, or t
tcgtagatggcacatgaatgtggcattgatcagagggaccatgcgcggttaaaatctgagggtcaccaccattgatgcctggcctcacctcttggtgttccccaccatgtccagtgcatccttcccaggcagctgggcttcctgccagcgnatnttcaggcattgttcacatttttgccctgtgcttccagctacagaatatgtcctgagcacacaaactgtcccccaggccctttttaggaacagtctgacaaagtcagtctcctaggaggagcaggtgacttcgagaaaataggagacaggccagttgcagtggttcacacctgcaatcccaacactttgggaggccaaggtgagaggatcacttgaggtcaagagtttgagaccagcctaggaaacagcgagaccctgcctctacaaaaaatttaaaaattagccaggtgtggtggcacatgcctataatcctggctactcaggaggctgaggtgggaagactgcttgaatccaggagttcgaggctgcagtgagccgtgatcataccactgtactccagcctgagtgacagaacaagattctgtctttaaca

SEQ ID NO: 667718 - DNA, 741 bp, Homo sapiens
cggacgcgtgggtcgaccacgcgtcgccacgcgtccgcccacgctccgttttcaaaatatattagattggtttttattgtagagcacacatatcagggcgaagtgctgcacacacaactacaaatcattttgggaaaaaagctgtacagaagaaataaaactgcaactgctttaattatgcagtcccgacttgagaaatccacgctggcaaaggagttctggcccctgagaggggcttcttgatggtggctgccccagatttcttgcagcctatgaggtctcagacaccggaactctgtgatcaacaaagcgcccacaagtgggggggtcttgtgggcggggaggggcgtctgctgctcgtggggcgacacgcgcggcgtgcctgctggtgctggcctgagccaagaagacatctctaatgaatctagatccacaaaacttgctgccttccaggatctgagtggatagaagctacccaaagactttacctttttttcttattatttgggaaagccccttcaccaacctcccataccctgaacgcggaggaggaaccacgcccagtctggcaggacctgacgctcgggcatgggatgccatggagcggaaagacaagacggggcaaggccccttccagaaggatgacagggatgggcccagctggcagtggaaacggcaggaccgccacaccagacacacgggacaacacccaaacgaacaaacccccaacacaaatccacc

SEQ ID NO: 667719 - DNA, 878 bp, Homo sapiens
gggcccaagcaatagctacactacaccattctagggtcattgctgccactacacgtggcttcatagagcctgggatactgccaatttttaccatctcagagtccagagtcaccactgcatggtgccttatccccccaggatctaagttgtctctgagccctgttgggtctggttcccaaactgatgcctaccctgctccctaggtccaaactttcagagcatttctagggcagaagtgctctgagggtttgcacctggggagcagggtagactagaacagagtctcagctacaaccaaattcccttggtctgaactgcgaaggtgcctcagagtcatgggtgctgcttctgtgggcagtctatatccaacactgtcacagagagtggatctgcacctcaggacccatatgccacagtaggttcatgaggacctgagcctaggacctcagcttcacagctgctctgaataactgcaccctggaacccagcactagtgtggctacttgcaggtcatgtcagacctgacacaaagaaggatctccatggctaagtctccccattgtggggaaaatgaacataggaagatctaatacacattttccgaccattttatttaacatatgcagaatacacattttggtaatcagcacatgaaacattctcctggggatcgatccatatgctcagatgaacacaggattaggttccaagtaaattcaaaaaacatcaaaagggatatcaaggtaatacattggctctttcaataaccacaggtaaagctcagaaaatcagtaaacaaggaagctttcaaaaacgtggtacacattacctggaaattggaccacctgcctactggagtgaaccaatgactgacatgg

SEQ ID NO: 667720 - DNA, 535 bp, Homo sapiens
ttctgtttctaattcgttgattgtacatcttctaacaacaggattcctctggtagcctctgatctatagatgttgagcttatgacagatataccactgccagatcgaactcttctaaaagaaggtggaatgtattcaggaggcaggacaggtggcagtgtattggccagacatagctacatcaatgaagtgcatggccaggaataaattcctctgcatgtaagattattccatcttgatcaatgtcaaaatgattccattatggaagccagctgagcctgtgataaacattgacctgcatgtgaatagttctggcttggggccctgtcaagtgtccactcatagattttgtcgtgatctataggaactccttggctgtatttcagtcttgatgactgaggaacagcccactctgccactggtgggacactggccacatcaaatgactgtgcctttagtaatttagtgtttagttgtgaccctggaccagatctactaaaggaagaactctttggcaatgtggctgcaggatgagc

SEQ ID NO: 667721 - DNA, 693 bp, Homo sapiens
agcgggatggtccaggcatgcttgtatgtatatttcagaacctttcgtaaatgtaaaagctgtacatgtactgggaagttctgaatctctttggtttccttttttccttcaagcatattttgcagtgagcttcttttttatatactacgcaaacaaagttcgaatacagaatacaaaaagatatgtgaaggttctatttacacaaaagataactacaagtgattacgcgctgggtcaccagtaccacgtgaagatagcacgtttgcataacagcagaaaacgaactaaggtaagacagcgcgctcccattcttgaaagtgtccatgtcaatatgataccttgctggcatgcacgagctatatgacattgtctaagcacacttttatttcaagagagaagtacagattacttgaagttagctgatataacaatgatatatagaatagcagaagacaagaacagaaaaatatacaaacaagacctaagggcctgatgtacaaccgaggcaagcaaggaggggcgcaacaacccatctcccgaggggcggcgaacgatgctaacagaagattatgaggtccggttgtgacaatgcggagaaaagacatagaccacggacgaacaagcgggcagactcctgaccccgggggaagattgcgacagctgcagcacaaccgtgtctgctgaaggaaaggg

SEQ ID NO: 667722 - DNA, 867 bp, Homo sapiens
catggtggctcacgcctgtaatcccagcacttgggaggccgaggcaggtggatcacctgaggtcaggagttccagaccagcctggctaacatggcaaaaccccgtctctactaaaaacacaaaaattagctgggtgtggtggggggcgccgtgtaatcccagctactcgcggaggttgaggcacgagaagactcggctggaacccgaggaggcgagaggttgggcagtggacgccgaagaatgtggaccattggtattccagcctggggcgaacagagaatgaatctcttgtctcaaaaaaaaaaaaaaaaaaataaccaacctgggggggggcggtgccctcaagacccatgctaacaacgggagagggttggaggggcggcgaggacacctagagtgcccagggaaacgttggcgcgtgagctgtgtgacgccaaggaataggtcgccggtgcacccccacgcctggggtgggcccgggacgaacctctaagaaacaccccggggcgacaccaaaggcgcttctagcatacaaatcccgcccggaagggcacccgacggggcacagggcgcgtactgcagacagggtggcaccgaggaaggtccacaaatccaattacggcccggggggggaaacctgaccaactcagggtatacacctcgcaatgtgaaaactgagaagaacaaaagcagcaggtcctgcagatacggacgtagatagaactcctcggtttgacattgcccacactagggggggatccagagcgtgaatagcaggagggggaccccgtaaccaagtgggggcaacgggtcatgggcaggtgaaccggcgggaacttcccgaaacatcgcaggcaggggaccacg

SEQ ID NO: 667723 - DNA, 447 bp, Homo sapiens
  misc_feature (9)..(9): n is a, c, g, or t
  misc_feature (16)..(16): n is a, c, g, or t
  misc_feature (250)..(250): n is a, c, g, or t
  misc_feature (427)..(427): n is a, c, g, or t
  misc_feature (440)..(440): n is a, c, g, or t
  misc_feature (443)..(443): n is a, c, g, or t
  misc_feature (446)..(446): n is a, c, g, or t
aatgaaatnctgatgnaaatatgggggaaatgaaactcctcatgggttttgccgggaatctaagtcaagtgctgtgttgtgaatgtaggtgtacccctttgaactcatatgttgaatcctaaccccccaaagcaatggcattaagaggtggggcctttggggctgggtgtggtggctcatgactgtaatcccagcactttgggatgctggcagggggcagatcacttgaagcccaggagtctgagatcancctggccaacatggtgaaaccccatctgtactaaaaatacaaaaattagccaggtgtgatggcgtacatctgtggtttcagccactcgggaggctgagacgggagaatggcttgaacccagtaggtggagatttcagtgagccgagatcgtgccactgcgctccagccctgggtganagagcgagactcnaanccnt

SEQ ID NO: 667724 - DNA, 538 bp, Homo sapiens
  misc_feature (355)..(355): n is a, c, g, or t
gctaagactgatatcttagcttatcatgcctttatcatgcccttatctctatgtgtttccagacttctgtttcctgcactttctggttctttattccatagggacatgttggatgatttctgtcagtcaggcaccgtgctaatgggataattataagaggccctgccctcgtggaaccttttctctgggatagtattaagacacacagatcaaaataacagtcagaaattcctgataggaaccatgaagaaattaagtgatgagtgagacagagacgaggttggtggggcctctcggggatggtgattttggccagtctccaaagctggacagggatagttgtgcagagagccanaaatggtgctcctgagcagcctccctaggaatgacagtcccagggtgcaggcgctgggggataccgagcagagacggggccaccatagtgagtggacagcaaacaggtcaggtggaccagcatgggcagatcacatgtagatgaggttggattttattttgttattttattttattgttaaaa

SEQ ID NO: 667725 - DNA, 715 bp, Homo sapiens
gagtacttcagtgatgagcagatgcggttccgggccccccatgctatatgagcagtacatcgggcagtatctcatccaggaggagctcagtgcccgcaccacagaacccaccagaccagccaagccacgggtcacaccggagaagaccatgcgttgcccagcatcaccagacattgactagcacagcagtaccatacagacggaagccgagggagactacacagcacacgcgactatgctgccgagacacgcacacgggccaggcaagagcaggcacggagccatgcctcagcgacagcgcacacgacggccaacacagcgcatctgaagcgaccacacgctcgaacccgccgactcgcagacacccaacgcagagcgacaaccggcacgacacgaacccacagcaacgcagacacatcgcagacacaacacccagaagaatacagagaaaaggagaaaacaggaacaatgacaggcaacactcggtcaaagcatgaacgcagccacggagaagacccgaaacgaggagagcacacaggacaccgcggagcacacacaccagcagggaccgacacaaacacacagcaaagaaccaacagagccagacagcagcaggagacgaccgcagagaccgaacacaccacaagcacgaggcacaggaacaccccgaaagggacagacacagcggacagagacgacccagagaacacgaacc

SEQ ID NO: 667726 - DNA, 147 bp, Homo sapiens
  misc_feature (88)..(88): n is a, c, g, or t
gggggcccggggcccccccaaaaggggggggggggttcccccccccaaaaatggggggggggggggggggggcccccccccccccccnccccctttttggggggagggggggccggggtttttttttttttttttttttttttttta

SEQ ID NO: 667727 - DNA, 943 bp, Homo sapiens
  misc_feature (19)..(19): n is a, c, g, or t
aaagaggcaatacgcgctngtggttgtgtactttctcccgcgaggttgttttttgtcgctttgtttgcggtcagtccgcttttctcccccgttttttccccgggccattcccctgtgttgcgggcccccccggagttgtgttgttctgaccaatgcttgcttgtttgaaagtgccctcggccatcgttgctttgtgcccgtcccccaagggtccctcttggcctcaatttcgatctgcccgcgccatttctagctgcgcccgtggctgtccctagggcatccccggcttcggggggggaccttctcaccagcccgggtgtgctgattgccgcacactccctgagcccttgtccacccgccaagtcggaacccggggtgcttcccccccaagaggcacacgtttagggtgtttttcgcagccagtgcaagcggactgtgatgtttaccctgggaagcgatagcacttccactcggtctggtacaaaatggggttctttccccgccgtatacttgtagtgaccgccccttttgtgccaatcttcccagacactccaagtgtgtttcacaccagcaaatgagctgtgcgacaagttttgcaataaagcgcattcgacccagagggccatctggggtaaaaaaaggcgagtccatttctctgtcatcgcctgggcacacaaagtatcggttcacaaatgggctgttcttaaaacagcatatggcccacgaagatggggcagcctgcgagataccatccagaccgtgggggaagcgtatttgcttgtcactcaccttttagcggccccaagtgcgaccgagtggtgatggggacgccgtttttttcaccccagacttgctagcccgccattctgcgctaacgtaaaaaacatgcccccttgtttctttaaaaaaaaaaatacattttttggactcgaaaaacaaaaca

SEQ ID NO: 667728 - DNA, 340 bp, Homo sapiens
tatgcatgagatgagaatagtgtcagggccaggcaccagtggctcacactgtaatcccagcactttgggaggcgaagcaggcggatcacgaggtcaagagatcgagatcatcctggccaatattgtgaaaccccgtctctacgaaaaatacaaaaattagctgggcacggtggcacgcacctgtagtcccagctacttgggaggctgaacccaggagaattgcttgacccgggaggcggaggttgcagtgagccaagattgcgccattgcactccaccctgggcaacaacagcgaaactccatcgcaagaaaaaatagaaaaacacaaatgtagtcatac

SEQ ID NO: 667729 - DNA, 290 bp, Homo sapiens
ggtcgccgtagtaactgttatgcattattcacatcgtgtgcaccagagcttaacagtatgaatacgcctagtgcacagtcagtaatgagctgaggcagatgtgaagaggacatctgaccatgtgaaatactgatacggtgaattagaagcattgctcagtgtattgcgaactgacatgctgtaaacatgagctcagaaatggcaatatagtatcacactcaaggcctagcgtggcgagtcagatggagactcggcgttctgtggagtgatgcacagcagacctgatgcgg

SEQ ID NO: 667730 - DNA, 180 bp, Homo sapiens
  misc_feature (75)..(75): n is a, c, g, or t
  misc_feature (86)..(86): n is a, c, g, or t
  misc_feature (90)..(90): n is a, c, g, or t
  misc_feature (103)..(103): n is a, c, g, or t
  misc_feature (161)..(161): n is a, c, g, or t
cgccatgagataccgcccacagaaacgtcaagacaggtggtcattttcaagtaccccactaccacggactccggncgttatcagtngganaaagacagtgacnaacatcagttagccgtcatcctgatgaccattaatgaaacgcccctcccggcttatcnagcacgcgggtagctttta

SEQ ID NO: 667731 - DNA, 320 bp, Homo sapiens
  misc_feature (35)..(35): n is a, c, g, or t
  misc_feature (59)..(59): n is a, c, g, or t
ggtgcccccaaccaaccaccttactgcattttccngccacccatctgccatttggtggntttacatatacttagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttaga

SEQ ID NO: 667732 - DNA, 223 bp, Homo sapiens
  misc_feature (13)..(13): n is a, c, g, or t
  misc_feature (159)..(159): n is a, c, g, or t
  misc_feature (192)..(192): n is a, c, g, or t
tgtgtgtagatantgatgtgtgggtgtgtggtgtgtatctgcatagtgtgtgtgcatgtgtgtatgttgagtgtgtgtgcgcatgtgtgtttccaagtctctcgccagctgttctgatgcagcatctggtggccataccttgggcgtgcgttgcctgcntgtgaattcgtgtctagcttgatgctgagcctnccccagggtgcgtggttcaaacgaagaaccc

SEQ ID NO: 667733 - DNA, 596 bp, Homo sapiens
gtgtgggctggagcattttagtttcgttgtgtgcttattatatcctagctttgtgcctaatattttgttggatatctccctgtttctctgcggtaatatagtaactcgttgaacgtaatgagtggggtctatgctagaatttggtgcctctgcaaatttctccgagctttatctctgggtgaagtgctgtggacgcaaatcgagaaactgcttgtaatccccggaggcagatgacgtgcagtgatagtccgagacggccagcactccagcctgggtgacagagcgagactccatttaaaaaaaaaaaaaaaaggaaaaggtacaaagttttgtatacacgtttaaaggaggtaggccaggcacggtggctccgcctgtaatcctagcactttgagaggccgaggcaggcagattgcttgagctcaggagttcaggaccagcctgggcaacatggcaaaaccccatctctacaaaaaaatacagaaaattagccaggcgtggtggcgagctcctgtagtgccacctgcttgggggttctgaagtgggaggatcacttgcacctgagaggtggataccgccagggagctaagagtgca

SEQ ID NO: 667734 - DNA, 135 bp, Homo sapiens
ccaagcccacccagccatttacccaggaagggaaaaagcccccaatacccaaaccccctctccccggggtttgcccgattctttaaacaaaggggcccaccagttttcccctttggaaagcggcaagtaagcccc

SEQ ID NO: 667735 - DNA, 720 bp, Homo sapiens
cagaaagattatgttagaagtgtgattttaatttctcagaagtcatatacatgtcagctacaattttgagtgctttataaacacttaagatatatatataaatttttaatttcatagcaacttgtaaaaaataaaatacttgttgaaaagcctttttcaacatatccctaagctaagggcaagaggaaggaataactaactcagttgaaaagatggtctccagtttctgaatgaaatgagctacagctgagaaataatatatgaatgtcatgctgcagaatatgttatagccttattttgtgtaaaggatatatttcattatgtgaatggttgcgtatcagtttttagtagtgatgttttgtctgcttgtattgggaattaggctttactggtaatcttccttatttagttgatagtggtcaaggtctaataacaatgaaactagggctgagctagttagccctacactagccaaactgaaactctatgcgacattaaaagaagagatccatcatgtagcttgtgacacttgtatcttgatgagtcaccggggaacttttcagtgatgaaagatacacagggtaataaaccttcacatggtcttcaccaaggaacacgagcaagtcttctctaatctactcttactataatttcctaagtgtacaccaaactctggatctccccaatctgaagtactattagaacattaagttgaagaag

SEQ ID NO: 667736 - DNA, 178 bp, Homo sapiens
ctgtagagagaaagagattctatttgtttgggagaaagtacaggaaaaaaacaagagtctttatctagtaatccagagaactcttggattttgtccaagaccgtcaaggtggtacctcttaagagtctgcaagaaacacagtcctgctgggcttgaggtcccccctaaagcagataca

SEQ ID NO: 667737 - DNA, 866 bp, Homo sapiens
  misc_feature (866)..(866): n is a, c, g, or t
cttcgtggaggtggccgggtggcctatgtctccttgggacctcatgccggaaaattggtcagcgatagtagagtgttattgatctagaacagggctttggtctgatggacctaggcactcaagtgaggagacatggccatgcctttcagagtgctaatgcgagctcactgatttcatcctcaagtttccgcacagtgcccaccagaagtatgtccgacaagcctggcagaagggagatatcaatacataaatgggcaatgacacatgatgggccgaagaagattgaaggcagagaaaggaaagccaagatgacagatttggatcgttttaaagttatgaaggcgaagaaaatgaggaacagaataatctaagaatgaagttaagaagcttcaaaaggcagtctcctgaaagcttctcccaaaaaagcagctggtactaagggtactgctgctgctgttgctgctgctgctgtctgtgtctgctgctgatgttatagttccagcaaaaatagatcaccggcggagtaaaaaggctccagcccagaaggttcctgcccagaaagtcactggccagaatagcagcgcctgtccaaaagctcagaagggtcaaaaagcttccagccccagaaagcaagctgttcaaggcattggcaagaatgatagtggatcaataaaagtataaggtctttcgactgttgaaagaaaaaggggggttaaaaatactgggggccaagtttggtccgtttttgacaagggccataggggggtaaaagagacgggggtacaggcgggaacggttgggctgggaggccttgggggcatggcccgataggcagaaaatggtggggacgttggggattcgtgaan

SEQ ID NO: 667738 - DNA, 208 bp, Homo sapiens
ccccaaaaaaaaaatttggggggggccccggggccccccccccccaaaaatttttttttggggaaggggggggggggggggtcccccccccccccaagcccctcctttttttggggggggggaacaaatttttggttaaaaaattttttggggggggccccctttgtttaattttttttaaaaaaaaaaaaattttgggaagggccca

SEQ ID NO: 667739 - DNA, 247 bp, Homo sapiens
atcccgtactttcagtagcatctaaccccgactagtctgttgcctccggggtcggcggtgcaggcagccctcctgatgtgggcacacgtccgcgaacgtgcaggacctgctgctgctgggcgtggctccccttttcgctggggtctggccactgccggatggcgtgatgactgccctgatcaatgcgcaactccaccatccccaccaagcagtacgcatatcttagggtacccgaatgcctcgaaat

SEQ ID NO: 667740 - DNA, 105 bp, Homo sapiens
tcatcggcacttgtatcatcggcactctcgcaccaagagagagaaatcatagcactgggagcattgaatcgacgtgcagcttaggtgggtgccgattaatagcga

SEQ ID NO: 667741 - DNA, 602 bp, Homo sapiens
ccggcaggtgggcccacattgttggctatcttctccaatggacgaaggagtccccggatggaatacaactgtggcctgcatcctgaccttgcccccctactaacgccgcggctacgggaagttcctcatcgctttcagttatgagctctccaagctggagagcacagtcatgctccccggagaagccgctgtcatgacctgggcaagctcagctaccgcagctaatggtcctgggtgctgactggagatcctgcgggacttccggggcacacgtgtccatcaaggacctcagccagatgaccagtatcacccgaaatgacgatcatcagtaccatgcaatccctcgatagtggtcaagtatatggaagaggccagcatcgctgagtcatgatagtcagcaccacaaagttcatgtgtggacggagcacttcgacaagtgacctcagctataagataccacccattcttcagtggagctccagtctgcctcaaggtgtgcaccccaacaagcactagctatttaagctctccaagaagtgagcaagcatggcaccgagatgtcggacgtgagcctcctggctcccagcctgtacatagtataa

SEQ ID NO: 667742 - DNA, 519 bp, Homo sapiens
tgtcttccttgctaagactaaggaaatggaaatgaaagtgcctggtttagtgctcaggacacagccagagctctgcgtttccgcatctcctctccacaccaaataataacaatttgctctagaagacaatggacatccaagtgaaataaggctcaagggactgcagccgttttttattagttatccactagtaaatgcactaaaccaaagaagccccacttcaaggaacacagacaaacatctgtctctataattatccatacgccccaaacgcccctcctcatctcattccccctacttatcactctgaacatattctacaatggacttactcatcaggcccaacatctgtctcccctcacgggaatgccagctccacaaggtcaagggctgggatgttttgtttgccaatgtgttagcattcccaaacttagattagcatcaggcataacataagcactctgcctattcctcgttaaatggaatggatttgaaaattatcagaaacactagtttcaa

SEQ ID NO: 667743 - DNA, 263 bp, Homo sapiens
caatactgacgcgggcacgcgataggcccatgcgatcacatgcagcactgtggcacaggtatagagaccgggaacaccggctatagtactatagaacgtatttgacgccgggactagaccaccagttggccgtcaatcagtggccttggagcccagcaacaggcggtaaacgcatggcctatgcggcaggcgagggtagaattctacccgccataacccgatcgcccagggccagggtagtgctgatacacataaccgaccta

SEQ ID NO: 667744 - DNA, 193 bp, Homo sapiens
cctagtctgtctgatagtcagtacggtagttatataagtcagtgtagtcaggtagttagtcaggtagtcagttaggtagttaataatggtaatcagtcagtcaggcagttagttatggtagtcggtcagtgtaggcagtcagtcgtcagtcagtctgaggtagtaaagtcatagcgaatggtcagtcaagtaa

SEQ ID NO: 667745 - DNA, 355 bp, Homo sapiens
catcatggggttctggaggatacatagacacccttgtgatgtggaaaaggatcactgaggaaggcttttaataatgactcttgggataacacactctgtaatggaaaacttgtggtatcctaagcttgcatgctgagtatgatgaggtatttgacgtaatgtagccacagttcactatgtatgtacagcataatcaacttagccttagtagtctgacgagatatatacagacgattttcccacacagaagcgtaatgcaataccccctgccatagttgattcaaaagcctaaagtactatagacagggtccataaatactactacctgttcagaaacattagggttcactgacct

SEQ ID NO: 667746 - DNA, 299 bp, Homo sapiens
ggcattattctcatagaagcacaaactgttgtgaagtgtgcatgcgagggatctaggttgtgtactccttatgagaatctaatgcctgatattctgttactgtttcccatcaccccagatggacagtctagttgcaggaaaacaagctcagagatcccactgagtctacgttatagtgagttgtagaatcatttcattatatattactatgtagtaataatagaaataaagtgcacaatacttttggttaatttcctttattaacttgtccctaatagaatactagtttctattcttta

SEQ ID NO: 667747 - DNA, 337 bp, Homo sapiens
ttgggggaaatcctgtttttttgtttgttttgcttttttaaaacggagtctttttctgtccccagggtggaaaccagtgaaccaaaattgggccagggccctccagcctggggggaagcgagcccctgtttccaaaaaaaaaaaaaaaaaaaaaaaaggggaggggcctttcctttttcttggtcctatttttgccatgggaaaggcccccccccctttttccttcccccatgattttaacattcctgggggttcctcggaaggggagcaaatgccagccccatgtttcctgtaaagcccgcaaaactggggggcaattaaactttttttttaatta

SEQ ID NO: 667748 - DNA, 511 bp, Homo sapiens
acaagtggaaagggagttcatgacctgcagctccgagaaggtaaataaaacatttagaaactattctaatgtgaatatagccatgtagcatctatctacactgcaatctcaaacatcttgattgcccaagttcacctatagaaatttagatcggctgcatcttgcttctgaggcaggattacgaaagatttgtttaaaataatagtattgagcttggtgtgccaaggttgtgaattttgggccatttgaaaataatcaatctggtcaggcatggtggctcacaactgtaatcccagcactttaggcagaggcaggcagatcacctgaggtcaggagctcgagaccagcccggccaacacggtgaaacctcatctctactaaaaatacaaaattagccaggtgtggtggcacatgcctgtaatcccagctactcaagaggctgaggcaggagaatagcttgaacccgggaggcggaggttgcagtgagccaagatcgcgccactgtactcta

SEQ ID NO: 667749 - DNA, 328 bp, Homo sapiens
acagaggctgaatggcagaggctgaatggcgtgaaccccggtaggcggagcttgtagtgggccaaaattgcgccactgctctccaacctgggcgacagagcgagactgggtctcgtaaaaaaaaaaaaaagatgcaatttttaccaaatttaaaaaaggccaattccgtgtgatgttttattctctaaaaggtctcactatgacttaaatcctttattaaagcactatggaagcgggtttacccaaagaaaatattttggatacagggaaattcagctttttaattatttccagggaagttcacgggttctccacattttcccatttc

SEQ ID NO: 667750 - DNA, 102 bp, Homo sapiens
aatgtctgcagcctcagagcactgcatcatttactccatctcctgtcatggctacaactggaccgttcttctgtagcgacttaataattttcatcttgtgcc

SEQ ID NO: 667751 - DNA, 250 bp, Homo sapiens
tgagcgaagtgcactaggctagcccaccttcgacccttaccagcgcggggactatcgtagttcgggggggcagaaaatgtagcccatttcttgccacctcatgggctacaccttgacctaacgcttgtcactggccgctgttccacaactttgtagccttcatcagggtttgcatgaagatggctggtatatagcctgagcaagaggtggtgaggttgatcggggtttatcgattacagaacaggctcct

SEQ ID NO: 667752 - DNA, 881 bp, Homo sapiens
tggtcgtgctttctgtcttggtttttgtcgttttttttgggctcgtttcccttggtgcccaggtggagtgcatggttcaatttcggcttccctgtctgccctccatctttatgtttcctgctaattgtcgtgcctcagcctccctagtagctgggattacaggcaccatgcccagctaacttttgtatttttagtagagacagggtttctccatgttggccaggctggtcttgacacctggcctcaagtgatctgcctgtcttggcctcccaaagtgctgggattacaggcatgagccaccatgcccagcaggtcaactgtttttgcaagcatttagccagagtcatgctgtgctgttaatcagtgtcctggagaatgggttgcttggaaatcttggcgccccctcagtagtaacagccttggtttaagggcgcagagtggagagtaaatgcaagggctataacaagggcattcatgctgtgggttaagatccacaaatcgctaggaatgtgtatactctgggtagtaagtttgtagtattagaaggtttaatgacaagtatttgaagagctgaagttaagtgttgggaggccatcccttatgaaggacaatgaatggcaagtaaaagaccaagttctgttcctgggtccattaatttagttaaaaaggcaaagttctttcagcacacatatctgcatgcagtcacgtgctgcctaaggatgcttcattcaacaatgagcctcacagccgtgctacacaataagattataatactgtatttttactgtaccttttaacattgtgttacaatggcctacaagaagcttgtgtggatggctttgaatgtggcccaacacgaactaataaattttgctaaaaca

SEQ ID NO: 667753 - DNA, 355 bp, Homo sapiens
ccccgacgccatggggtctgtacagaggagtctaagtgagaggcaggccttttttttagctgggcccaggctctctgcagccatgcgtttatggtgtgcctacggggtagcacgcccagatggacaggccagggctgcccagagctgggggtgggagcaaggtaagcagagaggtgagggaaggagggtgctggcttagcaggagctgaatgaatgggcctggaggggaaaagctaagggagatggggtggcttgagtggagtaggtgaggcctaggtgaaggggagctgtggaccttccaggacggacggatgtgagcagtcctgagtggggactggagttagggtggggaagg

SEQ ID NO: 667754 - DNA, 974 bp, Homo sapiens
tggtcgtgctttctgtcttggtttttgtcgttttttttgggctcgtttcccttggtgcccaggtggagtgcatggttcaatttcggcttccctgtctgccctccatctttatgtttcctgctaattgtcgtgcctcagcctccctagtagctgggattacaggcaccatgcccagctaacttttgtatttttagtagagacagggtttctccatgttggccaggctggtcttgacacctggcctcaagtgatctgcctgtcttggcctcccaaagtgctgggattacaggcatgagccaccatgcccagcaggtcaactgtttttgcaagcatttagccagagtcatgctgtgctgttaatcagtgtcctggagaatgggttgcttggaaatcttggcgccccctcagtagtaacagccttggtttaagggcgcagagtggagagtaaatgcaagggctataacaagggcattcatgctgtgggttaagatccacaaatcgctaggaatgtgtatactctgggtagtaagtttgtagtattagaaggtttaatgacaagtatttgaagagctgaagttaagtgttgggaggccatcccttatgaaggacaatgaatggcaagtaaaagaccaagttctgttcctgggtccattaatttagttaaaaaggcaaagttctttcagcacacatatctgcatgcagtcacgtgctgcctaaggatgcttcattcaacaatgagcctcacagccgtgctacacaataagattataatactgtatttttactgtaccttttaacattgtgttacaatggcctacaagaagcttgtgtggatggctttgaatgtggcccaacacgaactaataaattttgctaaaacaggccaaaacgggtggatcacgaggtcaggagttcaagaccagcctggcctagatggtgaaaccctgtctctactaaaactacaaatattagcc

SEQ ID NO: 667755 - DNA, 120 bp, Homo sapiens
tgatgggtcacaaaattagcatgttaggcatcagccatgtagagctaaggaatttaaaggcaccagtaacataaagatcaatacctgctttcctcctccaccaagaacagtagataagtt

SEQ ID NO: 667756 - DNA, 438 bp, Homo sapiens
gctcgactacagtggtgtgagctcctgagctcagaggcatcctcctgtctcagcctcccaagtacctggaacaacaggcatgcacctccatgcctggctaattagagacgagggtctcactctgttgcccaggcttgtcttgaactctggggttcaaacaatctgcctgccttggactcccaaagtgctgaaattacaggcatgagccacctcatttgactttgttcacattctttactaatctgtttgtttgtttgttttttgaaacagagctgcactctgtcacccaggctggagtgcagtgacacaatcttggctcactgcagcctccacctcccaggttcaagcaattctcccatctcagcctcccgagtagctgggattacaggcgcccggcaccatgctggctaatttttgcgtgtttagtagaaatggggt

SEQ ID NO: 667757 - DNA, 535 bp, Homo sapiens
  misc_feature (130)..(130): n is a, c, g, or t
  misc_feature (141)..(141): n is a, c, g, or t
  misc_feature (143)..(143): n is a, c, g, or t
  misc_feature (197)..(197): n is a, c, g, or t
  misc_feature (231)..(231): n is a, c, g, or t
  misc_feature (358)..(358): n is a, c, g, or t
atagttagatggatccatgccagggtccaatgctctataagtggaagtcactgacatcacctctagtgtacagcttttgagggcttgggaataactatctcattctctcatctcctggtgcagtaactangggagaatccntncattaagatggtagaatttccatcattctaggtctttgagtggccatatggagnacaccatacccagccaacccattgtggacatggnatgtaagaaatcaaccttggttgctaagctgctgagactctggggttaatttgttactgcagcataacctagtccatcctgatgcatgcagcatgcaaaccacttacgttgacccttagtcatggtnagtgctccacagatgttggttacttttggtaggaagatagattgcctctgaaagttttgttagctgatctcatgatgccaatgttgctattttgtaattggataaattggacttggctctccttccagcatgtgggagagacagatgactgagagacaataaagcactattatcttc

SEQ ID NO: 667758 - DNA, 190 bp, Homo sapiens
cctcgtcccttatcaaaaattaaaaatagttgggcatggtggcacacaccggtacgtcccagctactcaggaggctgaggcaggagaattgcttgtgagccgggacacggaggttgcagtgagctgagatcacgccattgcactccagcctaggcaacagagcaagagcgaaactccgtctcgtaaggtc

SEQ ID NO: 667759 - DNA, 794 bp, Homo sapiens
ggggtgctcggaaggccacaggatggggctcctggctggcctgaggctggccggatgggaagggctagcaggtgtgtaaacagagggttccatcagtgctgtggtgcagtgatggacagcttccgcacacttgagtgaagcctcccctctccctcggtgacatcttgtcccgaccctcagaaccctggcttgtctccagtgaggtccgaagctctggtgggaactcttgaggggcaaggtggggtgcaggccgtgcggagtaccggaggtcacgcgtgtctgaaacagcagagagcaaggaacgaagcgatgaacacaggatcgttgccccaagtcagaaaccaagggttgcatatgcagcccccagtaatgatgccacaaggatcgtgagataaattgcccattaattacgttcacggcaccctgttgagtgcccctaaagtgccttggcgcgcaagcggaacaatccaagcacatacatggacgaagtgatatacctcatcagaccatcacagacactaaggtatgacacccacgcgaaacattcggaggaacacgcacatcaattaaatttgacacagacacccagcacatgttgacaccatcccaataacaagaaagcagtgtcgcgtaataataattgaaggaatctccggacgatttaaccaagtgcgcacatgagcaaagtagaaaaaaccagccggtatagagaaattagaatagaacaaagaggcgaacggacactgaagtctgtgcaaattaccgaccgacgaagaggggacaaccgcacgcag

SEQ ID NO: 667760 - DNA, 430 bp, Homo sapiens
  misc_feature (62)..(62): n is a, c, g, or t
ggccgtcttcagaaccaggcagggagccgctgcgttggggtttatgcttggatggtggacgnccgtgggtgtgtctggggggccgcactctggggtctggagctgcgtctccatccttccctgtcagggaccctctgaagggcctgcgggccaccagtcaccctcccttagccaagggatcccgggagatgggggcggggacgctgggttctgggttgtggggctggcagggcagagcccgagagcggccagacctgccctttgcacggcacagaggcccccaggaaagggcctgcggtgagccgggggcagatggccccttgggggccaggacctcaggtgggtgggcttcgcgggggagcagtcacctctgcggtatttagggcaggcggacagaggtggaggggccgccccgtgttcgccgcggccg

SEQ ID NO: 667761 - DNA, 278 bp, Homo sapiens
cgtatagcctcgccagtgctgggatcacagaccgtattgactccaattttgaaacaagttctattgtgggtaaaagtgttacccagcatcatcacatggtacagagaaatcttttgtgaaaggaagttgatacagccaacttcgtggttgtcatattttaagaaatttccacagccaccccaacgttcagcaaccaccactgatcaatcagtggccttcaacatcgaggcaagaccccctactaggaaaaagattacaactcactggcaggctaggac

SEQ ID NO: 667762 - DNA, 424 bp, Homo sapiens
ctaaaagtaaactatacattacatacttccaagcatgcatgtatggctactataacagatcagcacttctaaaaacatgtacatcctatatcagtaaaaaataaaagcaaatagagtaccacagcacagaatatgtctgaaatttagttttgtttgatatctgaaagttaagtttttgacatttaccagcagtcccacaacgtgctgaccctgtgccgtcgtggcctggtgccagcctgatgtagggccatgctaaaaatagcagctaagcagcagctgtaacacataggtccttctgacctcaactttatttccctaaagggtgattggaggaagagggggacaactggagggaatgagggaaatggaatatactctcagtaggtattacttatctcttctgattcgtcttcttttctaccac

SEQ ID NO: 667763 - DNA, 1496 bp, Homo sapiens
  misc_feature (350)..(350): n is a, c, g, or t
  misc_feature (375)..(375): n is a, c, g, or t
  misc_feature (397)..(397): n is a, c, g, or t
gagctttttccgcaagctgggcagcgaggggcctgccacccagttctttttccaattacatgcgcgactgtgataccgaagcatgtgcgtacgatagtgtctgtctgctttcggtgccgtcgctttccggctgctgtcttactccatcgggcgtctccgtctattgcccctcttgcctttctctccacgggacggccattacttttcgtctggtcaatccagcgcgggatgaaaatgcactcgatcgcactctcgttttcatatgtcgccgagaatactcgacgcactggggcggagacatagggggacccactagttacgaccgataaatccatgtacatagctggagnggtccgtatctataggacttcttcnatacggctgcctcagagtcacntagcgtgcgcgtgcatgcaagcgtcacctgcgtggcatcttacgcggtcacacgacacgcctactatgcacaaatgtctgtggcgcaccggcacactaacgcggcgacctcactatgggtgttgctccccgctgtcatttgcccttggccattgacgaagggtcacccagacattgtcgcaggcgtggaatggcatcgagcatatactggtcgatgattgtggacacggcagccacacgaacctataatgccttagactgtattagctcgcaggcgaacatcgagggatgcttggcaggtgggcatagtaacttgcgcagaagtgacactggtagcccccccagagtagtgatcgtcacgctggacggtgcagagctaacgggcgtggaagtaacgcgctattaaccaaagtgtgctccccaaggcccgaggttaactctgcggagtggtatcccccacaaactctttgagaggcttatttcattgacaacacgactacaaaaaaaaagcaaggaggcccaaccctaggaggaacagtggcacagacggggagcgaaaacgctggaaagggcggccatttcctgggaagggcgtagcttgggcgttggccttctacttttggaaagcttaccatagcgggaggttttcccctacgggtctgggggcggacatcggatgttgaacacattgtggaggcatgtctctgtgtcccccatggtgtcgttctttggttaccgccttggttttgttgggcttctaaataacagcaagggttcttaagaaggcttgttcctttcccgagccaagggccatgtttcccaatttgacacaaaacacgggccgggggattccctcaacccagtggaggttatacccaaggccccaagattacccggggcagatgagcactgcggcggggaagctggacacctggtgcttgtagacaacggacaatgggcccaccgacatgagtacgcgctgaaacaacagggttgaagagagagagcaacccaatcgttaaacaacgtagcagaacctcaacgcgaacatacacaacagggggtgcagcgagaagcaaaagaatgacaaaatgagcata

SEQ ID NO: 667764 - DNA, 271 bp, Homo sapiens
ctccagatccaagacttacaatatagctagagttgagagtcatctgatcaccctattgctccctgtgatggttaattttatgtgtcaacttgactgggtcatagggtgcccagatatttaggtcaaacatttttctgggtgtgttggggagggtgtttctcggatgtgattcacatctcaaatggaatgagttggcagtaaagcagattgccctcaccaatgcaagtggcctctaaaaaatcagctggaaggcctagaatcagagccaaaa

SEQ ID NO: 667765 - DNA, 444 bp, Homo sapiens
gctttcagtccagatgaactgagggacatctgttgtactatgtataactttgaaaacttggtatagtatctacagcagtgtataatctacaactgacatccactaaagcttaaatcttcatactgcactgtacgatagtagaatcataacagttgaaaggaacctagactccctttcacacatggagtgattataagtttcaatcctggtatctgtgcgtgatttttatcagtttagtgtagatatagatgtggcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggcacacattatg

SEQ ID NO: 667766 - DNA, 381 bp, Homo sapiens
ccaacgccgcagagagtgtacaaccagtgccgtgggtgtttttggtcataatgcgcggtgcggtaaaccgttgttcacctcgcgggtaaacagccagtccgggctttgctcatcatccagatgaccacctttcattagcactgcgccacagcccatcgccaacagcgatcgcccttgttccagcatttcctgttcggtggcccgtgtggcgcgtcgagcaaggcggcagcttcgggcaagtttggcgttattaatgaaacctgtggcaataatcgactgcgcagcgtagcaaccgccgaaggtgaaagcacgggtcgccgctttttgccagcataacggtgtcgagtaccacgttttggatctgataacgttgcaaccgtt

SEQ ID NO: 667767 - DNA, 373 bp, Homo sapiens
ttcactcctttaacctcaaatgtattcctttgttagaatttacccctagattccttatttaatgtctgcagtagactgaatgtttgtgtgcccccccagaattcctaatgttgaaatctcatttcccaatgtgatggtatttggaggtggggcttttggtaagtgataggtcaggagagtaacagcgctcatgaatgtgattagtgcccttatataaagagacccagagagctccatcaccccttctgccatgtgaaagggagaagacaaacatccacgaaccaggaagtgggtcctcaccagaaaacaaatctgtaagcaccttgatcttggacttcccagcctccagaattgtgataaataaatttttgat

SEQ ID NO: 667768 - DNA, 214 bp, Homo sapiens
  misc_feature (16)..(16): n is a, c, g, or t
  misc_feature (37)..(37): n is a, c, g, or t
  misc_feature (84)..(84): n is a, c, g, or t
  misc_feature (88)..(88): n is a, c, g, or t
  misc_feature (107)..(107): n is a, c, g, or t
  misc_feature (111)..(114): n is a, c, g, or t
  misc_feature (128)..(128): n is a, c, g, or t
  misc_feature (155)..(155): n is a, c, g, or t
  misc_feature (159)..(159): n is a, c, g, or t
  misc_feature (174)..(174): n is a, c, g, or t
  misc_feature (176)..(176): n is a, c, g, or t
  misc_feature (197)..(197): n is a, c, g, or t
  misc_feature (208)..(208): n is a, c, g, or t
  misc_feature (213)..(214): n is a, c, g, or t
ctaatactttctcccnaatggaagccctgatcccccngagagctacaggtctgctcccgacgggcctggggcctgacccgtccncacngggccgtgtcaacagcagnggcnnnngggacgtgtgtacntatgtaaatgagaaatagagacgtgtnaacngatgcattcatttcncntggaatgtgtattgtttttantttgcgaaacnaaggnn

SEQ ID NO: 667769 - DNA, 776 bp, Homo sapiens
  misc_feature (23)..(23): n is a, c, g, or t
  misc_feature (128)..(128): n is a, c, g, or t
  misc_feature (141)..(141): n is a, c, g, or t
  misc_feature (146)..(147): n is a, c, g, or t
  misc_feature (190)..(190): n is a, c, g, or t
  misc_feature (192)..(192): n is a, c, g, or t
  misc_feature (216)..(217): n is a, c, g, or t
  misc_feature (221)..(221): n is a, c, g, or t
  misc_feature (226)..(227): n is a, c, g, or t
  misc_feature (249)..(249): n is a, c, g, or t
  misc_feature (258)..(259): n is a, c, g, or t
  misc_feature (265)..(265): n is a, c, g, or t
  misc_feature (276)..(276): n is a, c, g, or t
  misc_feature (288)..(289): n is a, c, g, or t
  misc_feature (291)..(291): n is a, c, g, or t
  misc_feature (295)..(295): n is a, c, g, or t
  misc_feature (299)..(299): n is a, c, g, or t
  misc_feature (302)..(302): n is a, c, g, or t
  misc_feature (307)..(309): n is a, c, g, or t
  misc_feature (312)..(312): n is a, c, g, or t
  misc_feature (325)..(325): n is a, c, g, or t
  misc_feature (330)..(330): n is a, c, g, or t
  misc_feature (350)..(350): n is a, c, g, or t
  misc_feature (358)..(358): n is a, c, g, or t
  misc_feature (364)..(364): n is a, c, g, or t
  misc_feature (366)..(366): n is a, c, g, or t
  misc_feature (369)..(369): n is a, c, g, or t
  misc_feature (376)..(376): n is a, c, g, or t
  misc_feature (388)..(388): n is a, c, g, or t
  misc_feature (391)..(391): n is a, c, g, or t
  misc_feature (396)..(397): n is a, c, g, or t
  misc_feature (411)..(411): n is a, c, g, or t
  misc_feature (417)..(418): n is a, c, g, or t
  misc_feature (444)..(444): n is a, c, g, or t
  misc_feature (464)..(464): n is a, c, g, or t
  misc_feature (467)..(467): n is a, c, g, or t
  misc_feature (478)..(478): n is a, c, g, or t
  misc_feature (490)..(490): n is a, c, g, or t
  misc_feature (493)..(493): n is a, c, g, or t
  misc_feature (501)..(501): n is a, c, g, or t
  misc_feature (505)..(505): n is a, c, g, or t
  misc_feature (521)..(521): n is a, c, g, or t
  misc_feature (594)..(594): n is a, c, g, or t
  misc_feature (639)..(639): n is a, c, g, or t
  misc_feature (649)..(649): n is a, c, g, or t
  misc_feature (655)..(655): n is a, c, g, or t
  misc_feature (712)..(712): n is a, c, g, or t
  misc_feature (761)..(761): n is a, c, g, or t
gggtgggtctttggggtattgtncaggaatcacaagcatctgtggaaaaaactaaggtattacagacactacacggaggtcatgttcttacattcaagacactaaatacaaaccgaagcaatgcaatnatgtatacttttnttttnnaaccctttttttgttctcatcttgaaaagggatcacttttttntntcacaaacaagctggtcggttggnnttcnttttnnctcacttgtcccgcgctacacnctggttctnncctccnctccccctttntctttttttttnncngcgntctnggnggtgnnnttntgccgctgcgggnttctnctgctcactccatgctgctnactttgtncttggngngtngggtgcnttttagctctgngtngggtnnttgggggggggggngggggnntgggggtggggggtcggtggtttgtngggggttgttttttgctggnggnttttgcttcgngggttaggggcnggngccttgcnaggngctgtgttctggggcnctggcctcatggtgtgctcagcgggttgggcacgcggcccaggaagtgcagggcagtggcgctttgatcatanacagccaacaggaatgggcggttcagggtcactccaagacctcangcttgttaanctgttnggtagactctgtgggctctctctcatccgcttcaagctcaaaaaaaatgctgttcancacctcccccaccctggatgcggtcattgctcaatttttgcaggttcanctcggtgtgcagaat

SEQ ID NO: 667770 - DNA, 226 bp, Homo sapiens
gctgttccagaggatcccggtcaagacgctgatactatgttgtaagctttgaggagcttatgctaagtgaaatacgccagtcacataacagcgaagtactatatcattccagtcatataaagtacctggaggactcaaacccattgagaatgctgcttgccaggggctgggaggaggggaaaatagggagttcttattcaaaggatgcacatagttcagcgtctga

SEQ ID NO: 667771 - DNA, 100 bp, Homo sapiens
ggcagagactcgaggattagcaagcatctgtaagaaagtctctggatgcacagggtgtaatttgtgcatggaaaatggctggggtgaagaggagactagg

SEQ ID NO: 667772 - DNA, 868 bp, Homo sapiens
cgaacattttactatgacctcctgttccatctgagaatgcaccctctagccaacatggccaggcaacacctatcaacccctggagctcacaacaattccccaacaccccacttctactcctgcctatctgttctcaacgcgggcttttcgcatcctagctaacctgtcaaggagcttgacactaagaatcgtctggcaggatccccttttaccagttacaaagcttttcaggaccctctaactttctcaacggtaactttgcttacatatcggcgactctgggatggacctttcctgttgcccgtttctggtaatctgtcttgagcttacaatatagagcccgttgcagtaaaattgggctgttagggatcaatcttttaaagaataaatgctatatattaggaaaatctcaatattctagagctcatagttaacaagtacttcgagcgaagacatgctagttgttatgcaggggattctgtattccaaatggatactatccgacatatataaaagttgacagattcttaatctattgactcttatttagcaaatgcaacagacaagaatatccaacttgagtatgtataaaaggtagactttttgccaaaagtgtataagctctaaagagcatatatgcaacctgttgcaagttaatatagtactatgtaatatatattattgtgtatttatgattagccatcattaatgccctatgtgcttggcctttaagagataatcacaaaatattgatattaatttatacatatttgttgcagaagtgcctgtgagagaaatcttcaaaagacaaagcctggtcaaatatattattattgtaatataaacgatgggtttggtctgaaacgtt

SEQ ID NO: 667773 - DNA, 480 bp, Homo sapiens
  misc_feature (185)..(185): n is a, c, g, or t
  misc_feature (313)..(313): n is a, c, g, or t
  misc_feature (317)..(318): n is a, c, g, or t
  misc_feature (385)..(386): n is a, c, g, or t
  misc_feature (457)..(457): n is a, c, g, or t
gagctcatcgggcagggctagccaaggttgttcctccaaaaggagtggaagccacgagcatcctatgatgacattgatgatttggtcattcctgcccccattcaacagctgagtgacggggtcagtctggcctctttactcagtacaacatacagaagaaagccatgactgttcggagagttccngcaaggatatgccacatagacgagtaacgtactggtaccccacgctatagtgagtttgaagagctccgagcggaaattactgggcacacagaagtctgtgacattcagagtcctccaatcctactggntggnncagatgtgaatggtaccctctatgaaaagcatgttgatgagtggaatattcgcgccggctgagaacnnaatcctggacttggtggaaaaggagaggggatcaccattgagggctgtgaaacagcctccaataaccctgntaccttttgggcatgtggaagac

SEQ ID NO: 667774 - DNA, 928 bp, Homo sapiens
gaacaattgtgccgggtcctccctgtaaagaagtgggggaaaccgccgttttttaagcggagtcccgcccacacgtggttgtgtgggcccacgagccccccctagtttgtgacaaggggtccaccaccatggtgcgccgtcgaagcacgccggtgtaaagcctttggttgtgtccacgccccgctgggcgcatactatttttcgcgcctggtagtcgctcccggccgtaatatatgctcccgcactcacctggggaggcagttcagcggaaccattcatggcccgcagaacacaagacacaatggtgcgctgcgcagcatgcttggtggcggacacacactgaatgccctacattttcgctcacggaggagaaaattttgcacgaaaacaaaaatttccttcaccacaccacatgttgggacctgcaccaccctgaaaggttacgccacgcacaatactgtgcgggcaagaatatagcggcgattatgcaactcgatgttcctcacgaagagtcaccctccatgtgtgataacatcccctttatctccactgaaaccccctgttgaagataacaaagagcgtagtccccacacaagatacgttattatcatcacacaataacatagagcacctattttcacacaccgagggtgattcttttgcgagcagccattgatatttcgggctgtcatctccaccggaggtcgtcgccgcacgccagtgcccccatcgggaatgaattaagaggaggcagccaccacgatgaactatacttgtttcgcaaagcggtgctcgccaaacaagaacaatgagtccgcgaggggacaataatcgctgtagaagatgacattcaagacgacaataaaaagcaacggcccgcccggagtctccctaaaccactgttccaacaaaaaccccaaacataaca

SEQ ID NO: 667775 - DNA, 493 bp, Homo sapiens
  misc_feature (472)..(472): n is a, c, g, or t
  misc_feature (483)..(483): n is a, c, g, or t
actatatgagaattgacaacaaaatgctatgggaactttaagctcaggccatgatagtgatgaagaccagctgacttgctttaaacaacaatagaaccagacaaaatatatacatataagaaatattgattttcagacattggacaacagactgcataggacaggcaatgatccctgagaggagaaaataaacaaagtaggctctgaaaatgccctagcacatggttgccaaaccacagtgcagggaagggaagcccaacaaatcatagcattcttactaaattgaagaaacagaaattgaagcttggggaagccaagatgtctggaatttgttgagcaaaatactggagagtagtaagatacacagagggagaactccagaggtctgcagaagaaaccttctagtctttgatttgagcatgcatttgaagaaactactgagggcaggggggagaccaccagaaagtggcangcagaacaatncttggattgg

SEQ ID NO: 667776 - DNA, 576 bp, Homo sapiens
cgggaagtagacaaacagtgttgtaggagttagaaaaggaaggaaatttcataagggatattttaaaaacttacccttggccgggcgcggtagctcacgcccgtaatcccagcactgtgggaggctgaggtgggcggattgcctgaggtcaggagtttgggaccagactgaccagcgtggcgaggccccgtctcactaaaaatacaaaaaaagtagctgggcgtggtggtgggtgcctgtggtcccagctgctcgggaggctgaggcaaagagaatcgcttgaacccgggaggtggaggttgcagtgagctgagattgtgccactgcactccagcctgggcagtagaagtggcactccgcccccaaaaaaacaaaccaaaaaaaaaaaacccaataatgtgtgaccctttggggggcccgagcagatttaaacccaaccttgggtgggcatggggccacggggaggttcttgaccttgggcacacatgtgccccaagggaatcgccggcaggagcgatggtggggtatcctcgcaacaacaagaaagcccggggggatccgcggtttttaggcaac

SEQ ID NO: 667777 - DNA, 1267 bp, Homo sapiens
agcggggcggcgcctgcttgtgctgcgacgctctagcggttacctgctgcgggctggctggtgctgtagtgttgtggcttgctgctggctgccactgtgagctagatgtggcaagtgttgctctgtgcccagctgtgcatgtggaactgctgtgtgctgtgcatgacaactgtgtgcttggtgctcctgtgtgtgccatgcgtgctgctgtgtgctgcttgacgcttggccagtggcctgtgtgtctgtgtggctgctgtgtgcttgctatcctgcagtctccttccagtctgccttgcgatgtaatgtgtgctgtgcctgctgtgcggatgccgtattgacgtggtgaaactgacgtttgtctgtgatggcccgtagaccagtggtgttgtcatcttgatgcccttggttgtggaatcaccactgtgatgctgtcaacaattcacatatatccctgaatcacgttcgacagacggtacaaagcaaggagccggatggggacacctgtgctttgtatcaccccagaatggacgcagagggccttggtttggcgcctttggaaatggatggcccaaggaagcaagttgatcgaagtgcggtgactcggaacactggcgcagccaggtcaaggcggaccccagtggagagagttaagcgagttgaagccagtgggcctttgggcagttctaacggtcccccttcgtggtggaacgcaatgtcgcggaaaccgcgggcccaccggagagaaattggtttctgaggctgaaagggcattccatacgcgtgggtgtgaaacggctggttttggcccgagacgacagttaccaacagcgtgatcttgggcaatcgctccctctcagcgggacagagtcagaaatcgtggcgcatttaaacgccccatgtcttggcagagacaccagttctcatctggggaaagaagcggtatgggccgacccagacaaagtggggttagggcggcgtgcaacatcgtacctcccaataagtcgtctccccacaacgtgcaaagctttggagcaaagacgacgagcgactggtcggctggtctatctagcacagaggaacagcgtagtccccgttagaccgcgcatcaacggttctaaggtctaaccgtttaatcttttccggagatccagctagtggacatgagggggaggacggcgaggaagctagcgggaaaccgtttgcgtattcccagaggactatagtatcgcgcaggtggctttgatcagcaagtgtggtttacagg

SEQ ID NO: 667778 - DNA, 206 bp, Homo sapiens
tcgtacaggcggaattatacacatgggccaccacacccggcctctcttcttttttttatgtaggcacttgtaactataaacttccctcttaatactgctttcactgtgtcctataggttttggcatgttgtgtttccattatcatttatttcaagaaatttttcagtttctctcaatttcttcattgacccactggcgactaggac

SEQ ID NO: 667779 - DNA, 554 bp, Homo sapiens
ggacagcaacccggaccacaccgcaaagttcggcctcacccaagaattcaacacgactcctcgtttacaacctgagctgcccggctatcgtagacaccccgactcctaccaacaacaacaccaactccagccccagcggttctcccaccagcctccccagcaacggcaccacgaacggcaacggaacaagccccagcggcactcccagcagcaccccggctggagaaggcgctggaagcatcacctcggtctcgatggttaacgcttgcgccattgctctgtccatggtcttcgctgtggcaacctgggcggtctaagtcattgaaacattcgagctcgacggctgtgcacctttatctggatagacttgttgattcagtacaatcctgtattaatagtggcgtcttttagaaaaacctgacaccaaattgaatttacatgaaaagtgaagaagatatagtctgagcatgatgcgtattcatgagccatctgattatcccatttaatgttctcactgaagtccaagtcacctgatcctcttcgtggatcgattt

SEQ ID NO: 667780 - DNA, 363 bp, Homo sapiens
ctacggtcctttacgatgaaagctgcggtgctgaccttggccgcgcacttgctgacggggagccaggctcggcattactggcgccacgatgaacccccccagagccgcctgcatcgagtgaaggacctggccactgtgtacgtggatgcgctcaaagacagaggcagagactatgcgctccagtttgagaggctccgccttgggcaggtaaccctaatgctacttgacagctgctacagcgtgaccaccagcttcagcaagctgcgctgacagctcgcacctgcgacccacgagttctgggatcacctgggccatggtgcagtcctaccgggacgacttgcagaggtggcaggaggagtggct

SEQ ID NO: 667781 - DNA, 1202 bp, Homo sapiens
  misc_feature (473)..(473): n is a, c, g, or t
gaataccttgatttgctcgcgaactgaaggagagcaaaggtctatgcagagttcctgcttccattacgcgcactttctagccaatataccatgaactacataaatttgacaattatatcgtgctcgtatccttcgagcctaggattaagtgtgttgactcgaggatgtgatccatggctatgagcatgattatgcccactatcatatctatcgggcaatgatgcatcatgaatgacgcgccacgagctgtttctatttggaccttggacagacgacccggattttgcgacagattcctagtagaatagatgctggtaagactatgataaggcggtgatggcaagatgagtggccataccataggtaatcctatacgtaatcatgtattagagtatgaagggtaagtaaaacgctaggtaatcggacgcagtactcagacttgaaaatagaggggcctttttatgaaagatatntgatatatcccagattctctgctaggataagggtcttgcgaccttccctatggatatttatcacatctcgattcttgaggaccacagatcccacatcatatacaagaccgaggtaccattgctactcttcagtaaaccatatttgaagatccaaggatggaaacggagagtcttagcacaaagtaaacaatcgaggaaattaatattcgtaggaacacgcacgttcctcgctcgagggcccacaaactatgcacgcacttattgcatctgggaagggagtcctgcgagtaacttggaacggtatattaatcttatttacttccttggacatgtcacgggggcttgcttggagaaaagggtaacttggtggtaaaaccctgtgtaacccttatcaattccaattcttaccacttcaaggacaaattcgcagggtgagaggacttatgggaatagacgaaagtttttctaggtacatcgttctccccaaaatatggagtttcctttgaacattaccttcttcgtataaataacctctttgaaggggtaagaggcaccgtggtgggaaattccaagaagttgaagacctcttagttagatggctctggtgcggtggagataaactcccccctttggttcgtgacatcttttttctagaaccttctgtcctaaatttaggcatcggaaactaacttaaaggaactcccaggcaatttcgtggcctttgaagag

SEQ ID NO: 667782 - DNA, 308 bp, Homo sapiens
ggtccccccccctgggggcccgcgtgggattccgggatcgcccctccggtcctgccccaaaacgagggggcatggcctttgcgagtccctttgctacaatccagcttttaatccgccccaaaacggcagcccatcggagcgcgaggacgtggtttggagggccccccggagatttggggccccccagggcctcagggggggtggtttggtcccccttgcgggcccgggagggggatggtttttatggcccaagtttggttttttcccccccgtttaaatttggattaaaactttgaacttttagtcca

SEQ ID NO: 667783 - DNA, 299 bp, Homo sapiens
ctagagttacccagagagtctgttcaccgcgtataccggcacctgctgtgacggtttctacaccaagtacggcgacatcattaaagcatctctacactgcctgcgccagcgcctgctggacatggggtgtgccgacgattacatgatgaccctcaactccggcgtcatgggcctgacccaacaggatgcgcacatcctcgaccactccatcgagttgatggatgaactgttcccccacgcccagggcgcttataccctggaaggagttctggcttgtcatcgccgccataacgtaaccg

SEQ ID NO: 667784 - DNA, 140 bp, Homo sapiens
taattaattaagaccccaaccgagtctcttccccctcccccaatgggaaaatggatttaatattcccacccctcttgccccgggggcaaaaaattgtttggggaacccaaccaaaaaaaggttttttaaccccaaaaaaa

SEQ ID NO: 667785 - DNA, 412 bp, Homo sapiens
  misc_feature (274)..(274): n is a, c, g, or t
  misc_feature (391)..(391): n is a, c, g, or t
  misc_feature (394)..(394): n is a, c, g, or t
gctctgctggtcttccggtctgctcgggctggtgggattgccggtgctgatcatcggcttcgtcaccgcgcacgccattgcccggcgttttggccggcccatcgaggcgcttggccaaagcggcggacaacatcggccaaggcaatttcgaagtgacgctgccgatttcctcggcgatggaaatgaaccagctgaccaagcgcttcgggctgatggccgaggctgcgcgagcatcaggcgactaacgtggacgaattgctggccggtcagcaancctgcaggcggtgctcgacagcatcgacgacggcttgttgatgatcgaccgtgaagggcatctggaacacctcaatccagtggctcagcgtcagttgggttgggacagtgaccgtcntgncaaggcctgggcaccgcg

SEQ ID NO: 667786 - DNA, 105 bp, Homo sapiens
atgggggtcaagaattggccctggatgaagctctaattcaagatcaagcagatgatgaagagtgcagaaagagtgagggagatggcatcattatggtaggtggtt

SEQ ID NO: 667787 - DNA, 180 bp, Homo sapiens
gatccagatcccgttcttcatccagtgcaagcacattatagcatatgggtatgcccttactggagaatgaatctgtcatatgtctgattacgttcctcatctctttaaagtctcaattcttacactcttactgaggcccacccttaccaccctattaaataccggaacctctgaccttat

SEQ ID NO: 667788 - DNA, 294 bp, Homo sapiens
  misc_feature (170)..(170): n is a, c, g, or t
  misc_feature (235)..(235): n is a, c, g, or t
cagattatagtatccatcttaaatatggtggggactaacagcagggtagatggttaccttaatatttttggctggggaccatctaccggcctatatactacacttagagaaaaagtattacatatgggttaattttggaaacttcaagtatatatggccttaatggtctnctaaacccgtgtaacacggcggctggtagacattgttaatataggtaataccttaattgatatantggagtttaagggactaactcttttcctggtttaatcatggtatgctcaggcgcggggt

SEQ ID NO: 667789 - DNA, 317 bp, Homo sapiens
caggctggcctgtgacgtgataccaacggggcgagtggacctgaagggggacgtgggttactgctcccactggcacctgagccagatgtgccagaggttctatgcagggcaggcacgttcctcagctgggaggtttgcagaacatgtccctggaggtgcaaaccagatcagtcctgcccaggtgcagggatgagtcatacgggataaaagtggccctgtaggggcagatcacagtggtgagtctgtgaggaggtgtatcggggtgggctcagaacagctcttcctcctattgaacgataatgaagttcgacactgga

SEQ ID NO: 667790 - DNA, 605 bp, Homo sapiens
  misc_feature (99)..(99): n is a, c, g, or t
  misc_feature (528)..(528): n is a, c, g, or t
  misc_feature (574)..(574): n is a, c, g, or t
gctttatgtctttggatcttttgaaattaattttgactggaattattttcaaaacaaataggcaaaataacactttatcattatcattggtcatatacntagtgcatttgtctatgatatgtttttgagtatatgacactgaaatattagtgtatctatgatactaaatcatttttatatggctaaaatcatcttcagtaagaactctcttaggatatgaatttaagtgaaaatttactgtcttttttttaaaacatgatgaaacagtaatctatagagcaatttcattagtatatgtgagtaatgatggtttagttaactctacaggctgggtaagggctcataagaaagcttctaaagctctgtgctttgtgttcctctgtgaatgtccattctacttctctttctaataatgcatgcttttctttttgtaaacaaaatgttgacttcatggatcaattaaagagaattgtaaaaacctaaattggcttcagttaacagttaaaaaaaaccccttcaattggaagnaaaaaaatttaattcatagatttcaatccacacaaaatcatgtcgncttcccctggtttacacccaaatggcctaac

SEQ ID NO: 667791 - DNA, 162 bp, Homo sapiens
  misc_feature (36)..(36): n is a, c, g, or t
ggtgctaccaggtaggagggacgactggcgcacgantgtccgcagtgtctccagaccctggcctcatgctccgtgcttgcgcgtgtgccatttcgtctctccagaggagctttcctgcctaggatcatcattgtcccctccctgtgtctcttcggggatcct

SEQ ID NO: 667792 - DNA, 715 bp, Homo sapiens
ccagtcggctctggtgtgggcagcttggggctgtttttgagcttctcatgtgtagaatttctagatcccccgattacatttctaagcgtgaaaaaaaaaaaaaaaaaaaaaaaaaaaaaaaaaaaaaaaaaaaaaaaaaaaaaaaaaaaaaaaaaaaaaaataaaaaaaaaaacaagagaaggcggaggggcgccgccggcgagtaagaactctaccgcgcgggggcgaccagcaacatgctttgccactgtcattgattagtgattcaaaagacaggggcgccgcagataaaagggaggccgaaatatattatatgacaacgatcacagcgacgggggtgctttacaaacacagaggaggccgaccgaggagaagacaacagctacccatgccacttccaaggtgagatggacagaccaacacgacatataggccagcggggggggggagacaaacaaacccgagggggacgccagaaaatcagaaacccgacaggaaatatggaaaagcgccgtctcatcgagaggaataaagaaagacacccatggaaacgcgagtgacacaagacggcagggtgacaaacacaccaccagcccatatgatgagtggacttacggccgaagagacatcgagttgggccaatggagacgagaatgcagaatacaagataaaatcctgttatctacaagggagcgcaggaaaaataaaaaacga

SEQ ID NO: 667793 - DNA, 359 bp, Homo sapiens
  misc_feature (221)..(221): n is a, c, g, or t
ccagtcggctctggtgtgggcagcttggggctgtttttgagcttctcatgtgtagaatttctagatcccccgattacatttctaagcgtgaaaaaaaaaaaaaaaaactttcaaatgcttactgggaattactgtgtgccaggtgctactacacacacacacacagcatatagaaaccttgaccaacactattaaccaacttgacctagccaacatatgtngcacactctacatactgactagaatacacattcatttcaggcacacatggagcattctctcggatagaccatatggttggctgtaaatcaagtctgaaatatattttcaaaggactgaaattgtacaaagtgtattct

SEQ ID NO: 667794 - DNA, 266 bp, Homo sapiens
caagactacttttcccttaaactcctaggtgcacttttgtatcgtattttattagctatctgacagcctggggaaagacacaaagaggcggtaggtgcccatgacaactggtgatcaaaaagcccaacagaagctgggcgtggtggctcacacctgtaataccagcactttgggaggccaaggcgggcggatcacctgaggttgggagttcaagaccagcctgaccaacatggagaaaccgtctctagtaaaaatacaaaactagc

SEQ ID NO: 667795 - DNA, 522 bp, Homo sapiens
acccgaggatctcctcagcgaaaagatactatctgaatcagctctgaagatggatatgatctagaggagtgagtacaggcccactcacaggaggagctgtcatagagtatgtgtgatggaggatcagtgagacttagtctgctcagaatatgcatggagtggatctggatgtgatgtgtgagctatcattagcggcagattccaaatacagtgatgtccttctcctcaatagggcattcgcttgggggttctgccatcattgtaaggaattggccttcctcattcagcattctctgtaaggttgcatttggggtcagaagaaatctgcaatggtagaattgagggaggtaatcttgctagtagacagttttaccctgaagcttgtatgtcatttcatctcaagctctgagcagttcagtgcctggatgctctctgggcatctagacttatgcctccagacccctccgggcactggccatgtgtcagtttttaggccaccttctttctgatgatggtggttga

SEQ ID NO: 667796 - DNA, 1133 bp, Homo sapiens
agagggtgtgtctgctgtcgtcgtgttgtgggtctgttgcttctttgttgtatgttcgtcgttcgtttctgcgcgcgtcctttttccgtggttttctttctttttctcttttgttttctgtgtgttgtccatcgtgcggtccgctgtctcgatgtgtcccgctgtctgcttatccggtgaccctgtttccactgttcttttgttttgcgcctgattttggtgttatatccggtgcgccgggcccactgttgggcccctgggggtgtgcatcccctttgcgtgcctcttgtctttgtgcacagggccgttagcgcgccagtattgttcgttacccctgtggattgcccgcccgtacctgtggttttctgacatgtggtttgttcgctttggaactcctcctttccctcattccgcaatccgcgcgtgggtcaagcttcgataccgttggcccctcctattatttttaccccctcttgcttaacccgttttatcaatcctctgatcaagggtgagcatcaaactctaagtacgcctctgattcggccccactgcgagcagttagccccacacacatcttcatatggagagtccaccctagccatcattctgactatcgacattactaataagtggctcctttaacctttccgcccttttccctaccccaggacccctctgattactcctgccatcatgacccttggccataatatgatttatctccacactagcagagaccctaccgtacccccttcgaccttgccgaaggggagtccgaactgagtctcaggcttcaacatcgtaatacgccccaggccccttcgccctatttcttcatagccgaataccccaacacttattataataaacacccctcaccacctacacattcttcctaggagacacacatatgacgcaccttctcccctgaacttctacacaacatattttgtcaccacagaccctacttttaacctccctgttcttatgaattcgaacagcatacccccgattccgctacgacccactcatacacctcctatgaaaaaacttcctaccactcaccctagcattacttatatgatatgtctccataccccattaccatttccagcattccccctcaaacctta

SEQ ID NO: 667797 - DNA, 362 bp, Homo sapiens
  misc_feature (6)..(6): n is a, c, g, or t
  misc_feature (8)..(8): n is a, c, g, or t
  misc_feature (13)..(13): n is a, c, g, or t
  misc_feature (16)..(17): n is a, c, g, or t
  misc_feature (31)..(31): n is a, c, g, or t
  misc_feature (83)..(83): n is a, c, g, or t
  misc_feature (118)..(118): n is a, c, g, or t
  misc_feature (142)..(142): n is a, c, g, or t
  misc_feature (157)..(157): n is a, c, g, or t
  misc_feature (174)..(175): n is a, c, g, or t
  misc_feature (178)..(178): n is a, c, g, or t
  misc_feature (187)..(187): n is a, c, g, or t
  misc_feature (199)..(199): n is a, c, g, or t
  misc_feature (201)..(201): n is a, c, g, or t
  misc_feature (222)..(222): n is a, c, g, or t
  misc_feature (232)..(232): n is a, c, g, or t
  misc_feature (245)..(246): n is a, c, g, or t
  misc_feature (254)..(254): n is a, c, g, or t
  misc_feature (257)..(259): n is a, c, g, or t
  misc_feature (261)..(261): n is a, c, g, or t
  misc_feature (277)..(277): n is a, c, g, or t
  misc_feature (300)..(302): n is a, c, g, or t
  misc_feature (312)..(312): n is a, c, g, or t
  misc_feature (321)..(321): n is a, c, g, or t
  misc_feature (345)..(346): n is a, c, g, or t
  misc_feature (348)..(350): n is a, c, g, or t
tgttangngcctntanncctttcatttactntcatgtccaggggtgctatttacctagaaccattgtctactacaattaccanttacattacaaagtgtgtggttttctttttcaagnaggttcaattaaggcaataagagngtttgctggagaagnctattgtttactgaaannacncaatgaagncaaagtactgangnttttgcctacagcttggtctnttatgtaaanaggttaaatatannagctaagnaannnanccaacagtataagtangtgtttgccattgtcatatcaannntgctttgtancatactaangttacataacttatcgatcaatannannncatttcaatgtt

SEQ ID NO: 667798 - DNA, 341 bp, Homo sapiens
cactcggctccctaccggctctgatagtgaagcatctttggtgataggagtgctatcttgcttggttttgtttcctttctccttagtgactcttctggattcatattcactttcaagctctgactctgattcacaatcggaagaactgtcgtctattgaactacatccttcctttgaagaatccgaaggtgtgcatttgtcattttccttctccccatctccagaatcactttttccttgggcttttgagctcctgtgggctgccctttggttgtctaggcctgactaccctccactctcactgttctgctcactggaggagtcctcactgctggactcat

SEQ ID NO: 667799 - DNA, 538 bp, Homo sapiens
gggtggtcctctcttactttcagtgaatgccctactctgtctatggagtagctattctttcactactttcttttcttttctttttcttttttttggagaaggagtctcgctctatcgccgaggctggagtgcagtggcacgatctcggctcactgcaacctccgcttcctgggttcaagtgattctcctgcctcagcctcctgagtagctgggattacaggcacatgccacacctagcttttttttttttttttttaagaccaggacggggtttggcatggtgggccgggggggcctgagagtcggggcctatggtgatctggccggcttgggcctcccaagggggggggatggaccagttcagcccaaaggtcaagcctcttaacattcttttttcttatgccctctggggggatccctagggggggtcctggcttctcaatgttggaaacaaattggcttatcagggtttggagtgggaggttcagaagaaaaggagcaatttacaagaacattttggtttcatggttggctgggt

SEQ ID NO: 667800 - DNA, 323 bp, Homo sapiens
  misc_feature (248)..(248): n is a, c, g, or t
gtctaaatccccttgtaaatttaactgttagtccaaagaggaccagctcttgacaccagaaaaactgtaggggggggttaaaaattttacaccccttggtagggcttaaaggaggccaccaattaagagagcgttcaagctctaacacccacctatcctcaaaaaatcccagacatatatctgaactcctcacacccaatgtggaccactctatcaccctattagagaaactaatgttagtatatgtnacatgaaaacattctcctccgcataagcctgcgtcagattaaacactgactgacactaacagcccagtatctaca

SEQ ID NO: 667801 - DNA, 362 bp, Homo sapiens
  misc_feature (30)..(31): n is a, c, g, or t
  misc_feature (73)..(73): n is a, c, g, or t
  misc_feature (99)..(99): n is a, c, g, or t
  misc_feature (112)..(112): n is a, c, g, or t
tccttctcggggggaggggggggttcccgnnttgctctttggttctggttgggggttttggccccgggctccnccgtggcccaaggcttgttagtgtcnaggttttcccacngtgcctcagggccttggtttaaatggcccgggtagggggtgcttcctccctggagaacagtgtgggcctggccattttcaacagccacccattttcccttacctccggccaggacaaggcctacctgcaggacttggtggaggggatggattttcagggccctggggagacctagcccttgctcctcatggggggcctcccccccccctgttcccccccccctcaaccaataaattggttcctggtatga

SEQ ID NO: 667802 - DNA, 542 bp, Homo sapiens
  misc_feature (22)..(22): n is a, c, g, or t
  misc_feature (24)..(24): n is a, c, g, or t
  misc_feature (61)..(61): n is a, c, g, or t
aattcccaattaattccattanangtaaccttttttccgaagccccaagggttcccacttntgtcccccaggcaaatggtccaatccaatggtacgattcatatcctcactgcagttgtgaacttcctgggctcaagagatcatcctcctgtctcagcctcccaagtagccaggattacagacacacacccaccatgcccagctattttttttttttttttttaaatacacagggtctcactatgttccccaggctgatctcaaactcctagcctcaagcaaccctcccactttgggaggtcaaggcatacgtatcacctgaggttgggagttcgagaccaacctgacgaacatggagaaaccctgtctctactaaaaatataaaattagccaggtgtggtggcgcatgcctgtaatcccagctactcgggaggctaaggcaggagaattgcttgaacccaggaggcagagattgcagtgagccgagatcacgccattgcactccagcctgggcaacaagcaaaactccatctcaaaaaaat

SEQ ID NO: 667803 - DNA, 660 bp, Homo sapiens
gggcttaatcctggtgcagggggcgagcatggccgctccggcgtagtagttacccacattttcgctgtgactggttgtcatgcgaggtaagtgtcctggcggagaaggatggggtctccaagctagcgaaggtggactgctggcgtgtgtgtgccgagcatgtgatccactggcccagatcgcacgaggacaaggccttatgcagagttgtggatggggactcacccccgaggggatgccaagatccttgacaatgcgcattctcagcagaaggacccgtaagccagtggattgctgagaatccaggacagctttgggctcatgatggtcaaggacgacctttaatggtcaacctgtcccttctctcttcaagagtgctctcagttgtaaactacccctgtccgatccagggacaacctatacacaggagctggcagagaagctgcgatctccaggctccgcagccactaccccgatgccaaccagaagccagagatggtcattggcctcagccccttccaggggcttgtgtggcttccggccgagcgagggagcatgtaacctttctaaagcaaggtgcctgaagtttcagttcctgatcggcagctgaggcagcaacacacctggaagcagagcatgagccatgactcccaggctgtg

SEQ ID NO: 667804 - DNA, 402 bp, Homo sapiens
acgaattgttcttagtatttccttttgaacattttcctctctcaaggaaaatgtttgagaaggtggctagaggggaataaaacttaccagcaggcccaagtgtgcccgtgacaggaactcttctccgccacttgagttgaacccctggggcagctgctggctccggtggcccgccccaacctgtgcgtctccccaggtgcgtgagcatctgctccctggccttcagaatggacgggatggttctttccgctccagaaacactgaaaccgggcccatttcaaaactcggaacttgtgaagaaaagtgagttgcaaatttaccgttttttttaaaaagatgcaaaaaccttttgcccccattggttgccggaatgaaaaggaaagcccgggccccgccaacctt

SEQ ID NO: 667805 - DNA, 283 bp, Homo sapiens
ctactatcattaaggtggtgatggttgggatcgaagatgagggaaaatctgtaatgctccctggtccctaggctggttgtagagtacagatggtggtatcattacacaggacagtgtacaagtggaggagggtcatggctttggagagagagagagagagagagagagagtgtgtgtgtgtgtgtgtgtgtgtgtgtgtgtgtgtcttctctcaaggatcctgtgagatattctgatataccttcttatcctctgtatatattggagtaacatgatggcgcag

SEQ ID NO: 667806 - DNA, 1010 bp, Homo sapiens
  misc_feature (805)..(805): n is a, c, g, or t
acaacaggcttatggtctgatgctgcgttttaatcggcacgatggagttctaacgctctgttgcccagtgctgagtgcatgtgatgctgaggtcatgccattgcactccagcctggtgcttgacaatgagcaaaactctgtctcgaaaaaaaaaaaaaaaagcaatgggatgttagaatgaaataggtgtgattatcaattgctatattagttccctcttgcttgctcataactaatgttcctcatgcaacacatcaattgcacttgaacaacacagcacaagaatttgattgcttgcttacacagtctctctgcagtgtctgtgaaatttttgcaaatagagcttggtattggcacactacaaacattgaaagcaagttgtgtcggtggcttcaatgagaatgtgggacagcagtgctcaatgtgacgtgctcatagagacccatataccatggggagggtgcatcaatgtgggagacagactccgatattgatacactttgtgattattttaccatgcttatccaaagaactcgcttgcccatccatccccttttgttgcatcattgtgcgacatattagctcacgccattcttccccctttatctctctctcgtgggccgccgccatctctcttatcttcagcgtttgaaaccccttttttccccactcccttttgaggtcgttctcgctctgtcgctttctcccgccctctttatatttaaagcggtggcgtgtacagtggcacgatatcaaaccattagtctgtgttacgtaccgtcgaatttcactaatgaatatattngctggtgcgtgatataaaactcctttcccacaatcctatttgataactgcactcccctattaatacgctttttaaacacacaaacgccattaatcgttggcagaaaagagtatcccctatatcaaatttgtgtgggcaacaccacaactagcttgccaaaaactgtgtcgatgatggtttgtttaccccgtttataattacccct

SEQ ID NO: 667807 - DNA, 170 bp, Homo sapiens
tgaacattcgtgtcagaagcaaggggtggagtacgtgcctgcctgcctggtgcaccggaggaggaggagggaggaccactgttcctgttcttctcagaggcagacccttggatggcaggacgccctcagcagctggggacatgcttgtggttggaggacacgaatgttca

SEQ ID NO: 667808 - DNA, 134 bp, Homo sapiens
tacgcatttctctgcgctccctttgtgacttgaagaaccctgacttgtttctgcaaaggcactgcatgtgtctgtgttcgtgtaggcataatgtgaggaggtgtggagaccaccccacccccatagtcaccatg

SEQ ID NO: 667809 - DNA, 648 bp, Homo sapiens
cctcaaaagccccaaaataaaggctcattcaaaaggaggtggttcattttggtgtgccacccgtcaatacgcaacccaacgtctaacgggcttccccagaataaatggtcccagcgtcctcttaaaagatgccttaatccatcccttgagggccgcccttagttgaaataaagcagaaatgtggttctctttggcagctggccttctgcttttgaggtgcacattaatcagaatagcccggattcttttcagtgaattttgataaaggcttccagactctttggggttggaaacgcctgttaggattttcaagtcccatcatagaaaattgaaacccaaagttgttttgctgatagttttggggaaacgtccatctttttaagggattgctttcatttaattttggcagggcctcccccaaagatccagcctcatacctacatcagacaaaaaatcgccgttgttccttttggactaaaggattgggttttgctttggaaacaccccctccctttgcaaaagccgggcaaaatgaaagcagattaccctgattttatgggttaccaaattggagaaaggatttaataaaacccgttaatttttaaactgcccaaaaaaatgtttttcccgatattaatgtttcccaga

SEQ ID NO: 667810 - DNA, 278 bp, Homo sapiens
ctctgaccgtgctctgtcggcccgagacatttggaagtcctgggggatgctggcaaatctcagctgttgctgaggagggggctgggaccccttcccatcccaaccttgagccccaggagataccgcgcccacacccaatcttggacactccctatctggttggaagagagtaaccagtttccagagagccagagagtgagagagagaaagaaagaaagaaagaagaaagaaagagaaagagagaaagaaagaaagaaagaaagaaagaaagaaagaaa

SEQ ID NO: 667811 - DNA, 175 bp, Homo sapiens
ggtttaaaatctgtaaaattagaggattgcactagagaaacttgaatgctccattcaggcctatcattctcgtagagtgtgttctgacccatgggctgtgtcaatcatacttaataaaatgataggcctgaatgtagcatacacgtttctctagtgcaatcctggctaccgagct

SEQ ID NO: 667812 - DNA, 1364 bp, Homo sapiens
agcggactcgagtcacttcgggtaaggcgggagcccgagcaaggtcaagggagggaagtgctgcggttgcctacggtagcgagcacagttcgctctacgcatctgagcgctcgcgacgtccgcgcgctcacgccggatccctgtagcccgttcgctttcgccaagcctggctcacgtggaatgggtagtgaggctcggccctgcgggagctcccgatggcgtgcatgcggcggtcgattgagggctggtggtccgggatcgtgcatgctgcggcgacgccttggcgcgacgaatagtcccccatcttggcgtggacagagaaacccccacgcgtgtattgaattctcctctcgcaacaggaggcgccaagctccgatgtaagaaagactgtagaagatcaaagtacacgcatattcccttgatacgctcgagcagtcacgcgggggacaccttgccgatctgcataggcatgacttgcacgattctcaaaacgaaaaacgggcagactccctggttggcaaccttacgtaatggaccactgcgcgtgatggaggtagggttctagcacttgcccactcttggccccgtttccacccatgggcatccttttgagtggcgggcgccctgaacgagaattccacagccggagaattcatgactcgggggcgccgcgagatgtaaaaccagtggtctgtgggccccaattacattggggttgatagctaaagccaagctctttccgttgttacaacggaaccacccttttcgagctccgctctcaccttcagcttgctttggcgcgcccgattaccgtggcttgtgccggggaggccaggggggatacggggtaggctcaattaggaaccctaggtcatttggtgtcccggggtctggctcgccacattgccctggggttccgcccattcggactgggttaaactgccccgggcggttggcgaagggtgtttgggtcccgcaaataacaggagttgaacttaggaaaagagagaggttcccaacgtgtgaaacccaaagcgccttaggccccaaccacaaagtttggccccctattccggcaggacatccactggccctggtggaacgctccggattcgcggagctccttagagagggacgcaattgcccgccatatacgaaatcggggggaggggccccacgtgataaacacacacgtttatcttaggctccaacgcacaatctcccactggggacacaagtttgttagaaagccgagaaaatagtcccgagcgtgtggtcacaaaccaattgggttcgaggggacatatggtgtgaaccacggttgtcgtgtgaagacccctcggttattgaccgttggaccccca

SEQ ID NO: 667813 - DNA, 431 bp, Homo sapiens
gaactggctgctttctgtggaaatgctgaatttatgccacctatttttctaatttttgtcctggatttctgcccttctttcctaaaagggggtaagcaagtctcatgaaataatgcacttttcagttagcctgaaatatgcaaataggagggagataccatgactaggcagcccagcccgacattcgtgttatattgattgccctgcctggttggtggctgtttaggggaagcagccagagaggtcattttcattaattttaacatgaagttagaatgtacccatttccagtagtctcttttgtagaaagtatatggaagttcataacaccaaggaatgttgcctccttctctggccacagttttctcatgaggggacataagacactcttaacagcatctctagccaacaagggtgcagttcatgggcag

SEQ ID NO: 667814 - DNA, 112 bp, Homo sapiens
ttagacggtaactccgagatatctggtccccggggacaaatgaagaagtgtaaggccggtggtcggcaccctggagggactctggagacggatcctcctgctagccgagcag

SEQ ID NO: 667815 - DNA, 250 bp, Homo sapiens
gcagccctgttccaaccccttaagcttcagaagctgcaggtgaatcagctttgccagcctcaacctaaggagccatgcatccccaaagccaaggagccttgccaccccaaggggccggagccttgccacccaaaagggcctgagccttgccagccaaaggtgccagagccttgccacccaaaggggcctgagccttgcccctcaatggtcactccacgccgagcccagaagaggaccaagcggcggtctg

SEQ ID NO: 667816 - DNA, 175 bp, Homo sapiens
gtgctggaggagcctgctgcacacaccagtgcacctgccctacgccgttgtgtgcgttctcatctcttcctccgctccctgctgctggagagtcagtgccccatactgagttttactgtgaaaagtgctgacatgatgaatcagtgcgtgcacatgccatttcatgtgttgacag

SEQ ID NO: 667817 - DNA, 140 bp, Homo sapiens
tccagtagccgagcatacatgcaatgcctgcaggtctgacgtgtatacaccaatgcggtgcatgccatcccatgaaaaagttccgccgacacgtgagcaaccgtgctgagcttcaaaatatcgttaagctggagcctggt

SEQ ID NO: 667818 - DNA, 229 bp, Homo sapiens
  misc_feature (66)..(66): n is a, c, g, or t
  misc_feature (152)..(152): n is a, c, g, or t
  misc_feature (198)..(198): n is a, c, g, or t
  misc_feature (213)..(213): n is a, c, g, or t
ctggggtgaaggctgcatgatttgggaatgtgtacacacccctgcttcggcctcaggctgcccgcntcgccgcagcaggctccctgtgtcggcatgctggggctggggtcagcctgtccctcatggtgccctcagccagccacgggcaactnactgctctgtccaagggggcagcgtctgggctgggaagtggctggnctagaggtgggcctngacgccgccgtctttt

SEQ ID NO: 667819 - DNA, 366 bp, Homo sapiens
gattacgtgatcttccgtgttgctcgagtaggcggcggtaggtggcaatcttctgtcaccagtcgtgacttgataaacacttagcggatggtactcctgattctgccgctcactatcagctcgcacatcgcccagctgggcttcaataccgctgatcagcgcctgtatatgcgccagctgggctccaaagcgcgcctccgtttctgtcagtgtgtcttccaaggcagctttcatgctcagctgtgactgcagatcactctcgcgaccctgcaagggtgcgccgcaggtcagtcacctcggacctgctcatctggagctgctccgtgtggccagcgacctcccggttcaattcttcagtccggctgg

SEQ ID NO: 667820 - DNA, 181 bp, Homo sapiens
cccttccccccccccgtttttccgccatccggaagggcgctgggtttttttgggttttttctttttccaaggtcccctttggccaagggccctttccgttttttccccctggttccgttgttttttggaaggggtgccttttgcccctttccggaaataaaaccccccccttttttttgga

SEQ ID NO: 667821 - DNA, 1004 bp, Homo sapiens
gagtggtgctcgaaagtgtagcttatacctaatgatcagggccaccattgatcctcaccgagatcaataccggatatcaaacactgggcccgtcagactgttgccccggaaaatctgtgtggcagctgtggagagtgatcactcgctcagcaatgatcatcattgctggaactaagctcactatctcttatccacattcgtattatccaaatagcaacccgtcttcgtccaggatagtatgaacgtaaccacgctagacatgccattgttaagctagcgagtgcgggctggcatcaatgacataaaggccatcccttgtactgacgtaaagtaaaccacgaagctacgcaagcactagtcactagttgcgaatggtgaacctatgttggagagcccgatccggttgttatgcaagaacgatgtctgtcttcttgacctgatacacaggcaatttaatgccagataattccttcctggaagatgtttggctagacgtggtgagtacattgaacccacgatgaatccacaaccctatgcttcaaaggattgacgtgaggtgtatatggactcagatcatatagtgcaaaccatgattcggtctagatgcatggagcgtgtcctgtggttattgtaggtctcagaaatgaacgccatcatatatggactgtatacattggtctcatctggtacgatacttagtgtgctgcgctcgtgaccagtccgccttgacccgctacatacgagtaagacctgatggtcatagatgtgactgccgggcatggaacacctcatttttgaagaaggaagaactctgaggattgcccggaaatcagcaagctggggtggaaccttagttcctttcaaagggcggggccaagtgtaagcaccttcatagggctgcaaaggaagcactaatcaatcgttactataaggacttaaacgaggcctccggttgaaacgcgaaaaagagggccaaacgggagaacatttatggtcgcgaaaac

SEQ ID NO: 667822 - DNA, 212 bp, Homo sapiens
cgaggatccccttcgtcgaacaacaacggcggagttcacggaggcttccagctgtttgaccgaacaggtcatggcagatcctgtacagccagtgtggggacttgatgagggcctgggacaaaaccctaccaacgccgagatgctcaaggtcctggggaaccccaagaggtatgagatgaatgtaacggtgctggacttagagcacttatctg

SEQ ID NO: 667823 - DNA, 206 bp, Homo sapiens
tcagagctgcataatgaagtctagaagataatcaaggcaacaattactgagaacttggctgcttgcttaacctggcaagtctaagagcctctctttaacctttaggaattagagtcataggtttgctgcaacatgttcattgtaaacaaactaagtagagctcttattgcccaggctggagtagctcttattgcccagtctggagt

SEQ ID NO: 667824 - DNA, 246 bp, Homo sapiens
ctcttccaagaagttcccgggtctctaacaggtccttcagtaacacctccttagcaggctcaggaccgacatttcagcttgttctgcagctcgcccctgagttagctgctgctcgcccctgagttaactcaggggcgagctgctgtggacgcgtgtagatgcttcaacgatgcctgagcttgtggtgctgtcagggacgagtgtcgtgtgagtggagcctgggctgctgtggaaggttgtagattc

SEQ ID NO: 667825 - DNA, 108 bp, Homo sapiens
  misc_feature (1)..(1): n is a, c, g, or t
ncgtatctctacaataacggcagtatgcaccaccatgtaaaagtgagctcatacgtctctaaaaaaatgtttcctttataaaagcacattgcggttgaatcttaaggt

SEQ ID NO: 667826 - DNA, 4666 bp, Homo sapiens
gctcagttttttcgttttgatggctggctgatcaacatcgagaactcgctgagtctggccgctgtggggaacatgcctcctttcctgcggtacctcaccacacagctgcaccggcaggtcccagggggcctggtgctctggtatgacagcgtggtgcaaagtgggcagctcaaatggcaagacgaactcaaccagcacaacagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaaggtgggtggtggctttcgtccaagggccagcggcccagtgcctcccctgggacctcatttcctcatggaccttccattcccgtctgcacctcaaaggaatgacagcagctgttcttcccagagtggggatcccgtggcactgagaaacaggtgtcctgccccggccaagctatgtccccactgaaacccctttcccggctatttctacaatcagataatgtatttttgtgtgggtgttaccagacagaggcgcgtcgttcccccgctgtccggtcctcggcgggcctgggcctcctgtcccagctgcgttccttgatcttccccgtgagggaagcctgcggggacgcacaggggcctgcagcgcctctcactgcggctcaggggcgaggacgggggaggtgcccagggtttggggatcggtaggtgtcatgacgagggagcattttctggcaaggcaggtcacaccagcacagaggaaggagcggggccaggccggtgcccctggcgtgggatgcgcagggctctgcctgcctctggtctatcagtcctgcccgttcccagagccccagggatgttctcagcccttaatttagctttaaatgagtaaattaatccaataactaaagagcctctttactgcccgtgattctgataatcgaatgagaggtgtgccagaggacaatgggaccgcgcagccacagccagttggggcccagcccctgcccccctgcccttgcagcagcgctgaccgcctctcccgcgccctcttctggcgggcttgtggaacgacgggggtgatgcccagcagcctccagtcgttggagctgatccgaaagcatggcttctccgtggctttgtttgcccccggctgggtgtatgagtgtctggagaagaaggatttcttccagaaccaggacaagttctggggccgactggagcgttatctgcccacacatagcatctgctccttgcctttcgtcacgtccttctgcctgggcatgggtgcacggagggtctgctatggccaggaagaggcggtagggccctggtaccacctgagcgcccaggagatccagcccttgtttggagaacacaggctgggaggggatggccggggctgggtgaggacgcactgctgcctggaggatgcctggcacggaggcagctccctgctcgtccggggtgtgatcccaccggaggttggaaatgtggctgtgaggttattttccctgcaggccccagtgccacccaagatttacctgtccatggtgtataagcttgaggggcccacggacgtcacagttgctttggagctgaccacaggggatgccggcagctgccacatcggtggcatctcagtgttgaacgaaacaagctcaagacacagcctccgacccctccgggtgccccccaccaagctggccagatgggtgggccgctgcggccggcagctgagtgggggctgggtccagcactgctacgaggtgagcctgcgtgggtgcctgctgctagacctcctcgtttgtttctcacggccgccgggtagtcgggaggaggagagcttcacctgtcggcttggagagatccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccacccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcaggtcagtccaggcaggaagcagcacctgccccccgcgccagcccagccccagcctgagtgcaggagctgcaggacccgcgggggcttttccagctactctgttccttcacgtcctcccttctcagcctcgtccaagcaccgggaagacctccaggctgaccccttgagcagcagtcagcacaggtgcgtgggggcgtgagggaggcagggtcttcaccacaggcgccttcctctgtccttcctgctctttcttctctgcccaggccgctgcagctgcacagcctctgctacacctgggctgcctgggaggcttcctggtgtggtgtctggaccccacggccttgggtcatcctgtggctggtctggggtggggtctgttgtggtccttccacggtgtcagtggcctgaagtccctcgcttttggggggggggtctctcacccccaggccacatagggccagtggtaggggttccctctatgtcgggcagtgctgagggctgggatgctctgtgaccccagctggagcccacacctaagggctggcatccacatcatttcaccctgcagtgagggaagaggccaccaggtggcagcacagccacacccgttcccacgtcagaggagggcaaggctgggtactcagcagccactctgagccggggctccttccaggagctgaaatccacctgtctccatcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccggggactgtcctgggtggagggcaggtgaacacaagctgctgccggggactgtcctgggtggagggcaggtgaacacaagctgctgccggggactgtcctgggtggacggcaggtgaacacaagcggctgccgcatgtagccactcactcgactttttttcagctgtgaccattcctgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtg

SEQ ID NO: 667827 - DNA, 247 bp, Homo sapiens
atcaacagatagctaagatgcaccacgtcccacaggcaggacgtaactctaggaattggagagttacacacagactacccctaccgcaggacgatcgaatgcacccatcacagcccctactgaagtagaagtcatggatgaaaccaagtgctgctgtttttacaaacgaaggaaaaggaaaaccagtagagcgccacaaatgactctggacacagacagatccgggggagttacttacatgtgcatc

SEQ ID NO: 667828 - DNA, 456 bp, Homo sapiens
gaacaggaaactcttgtctctttagtgaatatggtacactttctttcatttgacaccccttctttattgtatacagaggactcgttttgatataaaaggagttctgcgtgtaacagctcaagggatggatctggggggttatctaatttggggttgaatatggcttcattcttgaaaaaaattattgccgcctgccctgaaggggactgttccctcacttcactccaccaggaagggagggtaaccttttgcccccgtaactataacatccatccaaatccgcatggtttctggcgatggggctaccatataataaattttgtcatgagtcttgaccctaaaggtgagtaacggtttaggactcttattagcattcttgaggggatcataatagacttcttaaatggcttgaaagtctcgggccgaattcggcacgaggcaagatcctgtttttcc

SEQ ID NO: 667829 - DNA, 531 bp, Homo sapiens
  misc_feature (186)..(186): n is a, c, g, or t
  misc_feature (414)..(414): n is a, c, g, or t
  misc_feature (516)..(516): n is a, c, g, or t
tgtaaagcagctatatccatggactgcacacagtcctcaaaagcagtcatctgctcctccagcatatctgtgccaactttatcatcttcaactacacactgtatttcgcacacgctttcttaattccgctcatcccactggaactagtttagatgagccccagactaagccgtctgcttgaatgcntctgacgcactcctctaatttcgccatatctgtctcatcatcccaaggctctctcacatctcagctaagcatggaaagcactctgagacaacaagttgacaggttctctctataggtctttcctcttgtatttcataattgtggcaagtacgttccttacccttgaggcgcttctttggctttctttctatcttttctctcccttcattcatccaggatgccaaagcnagcgcttcaaatgcttcattcattcattctttttacttattctgcttagcctccccaactctccctgctcaggtggtgctttcccagcattagcgcacaggnatcccattatttttg

SEQ ID NO: 667830 - DNA, 755 bp, Homo sapiens
ggccgggcgcggtggctcacgcctgtaatcccagctctcagggaggctaagaggcgggaggatagcttgagcccaggagttcgagacctgcctgggcaatatagcgagaacccgttcctccagaaaaagcaaaaaacagaaacacacaaacaaaaaaaaaacaattggtgggtgggccgccgtgggaccctctgaaaaaagagtttcaaagaacacccatctctggttggggcgccggggtcccaaaagtgtggttaggtggacaacgtgtggccaaaatagcgggtggtccccaaaagggaaaacacacgtggcaatgagaatgtaggggcgttggggtttccccaccccgaaaaaaaaaacacgcccggggggaaccccgggtgcggttctgggaaacaatctccaagagggtggaggtctccgggaggggcaaatcagggggcgcccactaacaacacggggaggccccaaaaggggaggaggcatgcgagataattaaaaaaattataagccgcccgggctcgggggtgggagaagaacacaaagacgagcaacaaagaaacaagaagcaagaagcgaagccgaagaagcgaaaccgaacagaacaacagagcaagtacagtcagcaacagagagcaacgagccatagcaggcaggcacgcgaacaaggcgacagcaagcaacagtagaaggagagaacaggaaacagaaacaacagagaaagcaaagagaacgacagaagcagagcgacg

SEQ ID NO: 667831 - DNA, 226 bp, Homo sapiens
catcccttaggtacgagagacataagatgactgtaaactatggtcacaggcatggttctggcagtactatgcggactttatactaacataatgccaaataaacatgcagtctcagtgtgctctcgcatgtatgaatatactagtactttctgtggtactcagccaagacataacaactaggacacagagcacatacaaaaccagatatgtaaacggaaagagggaa

SEQ ID NO: 667832 - DNA, 157 bp, Homo sapiens
gctcactagtggatacagctctgtgtccagtatggttcttctaataaaaacaagctttaaatgtaaatgccaggacaacaacaacaacaacaacagcaacaaccaccaccacccagtgcattgtgcttctggtccacagagattttcaagatggagc

SEQ ID NO: 667833 - DNA, 649 bp, Homo sapiens
accatgcacaatgggctgagtgagagacggctcgcaagctgcaagcctgtacatggatagtcggcaagtagggcacgcattaccaggtactgagtgaggtgccgagcgacatcaccactgggcaaacacgacggaatgagacgtgtacaccccgactgtcaccacagagtatgccgccgctgccggagcctacatgagccaccctaacgggccgtccattacagatcacgcccatttgtgatgcactctctgtacttccgacccatcgtggctccaccaactgtcgagctcaatatcatgctgtcacctgtagcaaggaacacagcatggagggactttgccggacaggagagacaagagatccgacatggatacagacttggcataagtacctcatgctaaccactgccatccatatgagtgcgtgaccccatgagccactgtgttgagagccacattcagagcctgcattggaccgtgctgtatacatacgctgacatctaggaagaggatgacgattattaggataaggattcgggtacgacacagactctagtgcgagtcaaatcgtgagaaccacgagaccttgtgtgatatagcatactgcaggggaacccgtgtgtagagtgctcgacacacgcttttacgt

SEQ ID NO: 667834 - DNA, 243 bp, Homo sapiens
  misc_feature (228)..(228): n is a, c, g, or t
cggttacgatcgttgtagataaatcccagcatcggtgcatcggctaatttcagtatatctgctgtacgttgtagtgcacctttcgttgtatgtcccccactcacaacaataaccacaccatccatcttgctcattaatacttgtgtatcaggcaccatcaataatggtggcacatcaaagattatccagatggaattgctggcgcaactcagtaatcaaggtttgtanccgactagaggccaa

SEQ ID NO: 667835 - DNA, 480 bp, Homo sapiens
cagctctaaattttttgaagaagatggatccttaaaggaggtacataagataaatgaaatgtatgcttcattacaagaggaattaaagctctactccttttctgaatgtcatcttcatccaggatccaggctgaaggagcagcccttatttgggacatgtcctcatggcataaggcaaagagcaagaaagctagtggagccaggcgcggtggctcgcgcctgtggtcccagcgctttgggaggccgaggtgggcggatcgcgaggtcagggggtcgagaccatcctggctagcacggtgaggccccgtctctactagaagtgcagaaaaaattggccgggcgtggtggtgggcgcctgtggtcccggctactcgggtggctggggcaggggaatggcgtgagcccgggggatggagcttgcggtgggccgggatcgtgccgctgcactccagcctgggcgacagggcgggactccgtctc

SEQ ID NO: 667836 - DNA, 100 bp, Homo sapiens
ctgcctcccttctctgagtagcaggtgaggctccttcagctgctggcctggatggacagggaacaggcagggctccgggagcgtccccgcagccctgggg

SEQ ID NO: 667837 - DNA, 444 bp, Homo sapiens
aaacataaaaaagctagaagactataggttccaagaagaacaataaaagtaaaccaactgaggtgtaaaagtgaaaaagaatttggtatgtttactttacaaacaaagcatatctgtgtagaaagaattcagttaaaacattgtcattaatataacacaaatacagcaataaggtctatgatccatataaggaagagatgcatggtggaaaatttaacaaactataaaaaagaacacttccatatattttgttttttaaaaagaaaattcaataactaatgtgactgagaaatacacttatgattgaaatgtaaaacaattgcccagacataagggcaagttcataaaagggagtcttgtgagtgcagtagaaatcgtgtgttctgaatagagagaagtatttggaaatgtgaacctaactagaaacctgctgttccgtctgtg

SEQ ID NO: 667838 - DNA, 1378 bp, Homo sapiens
ggcctcagcctccctcagcagtccggagtagctagagactacaggcgccctgataccatgcccggtgctaaatttatattagtgtagttaatcagtagagacggggttacaccgtgttaagccaggatgatctccatctcctgacctcgtgattccgcccgcctcggccttcccaaagcgttgcggattacacggatgtgagccaatcgtgccctggccggtcacatgtgtccatgtaacctaactcctggttacggaggatatggaatagacaggcacatgttcaactatctggacttctgtccttgaaaccgtgtcgctgatcccatcctttgcttgtcttccttcccgctgactggcactgtggaccttggacagtgcagcacccttacactactgtggcatgcacgcacaaccgatcacacagtgacccaaaggcactctgcatgactactgtagaagaacgaggaacccggagcttgctcaaaccgtcccttgtgcaacgacgacttacactatcaagatttacgcccactgctaatacggggtcctccgtgactaacccacgtggtcaccaatatacctacattcaataattcccttaccatttctacggttcaaccgatgttgaactccactaatacgtggctctaacgtggcgaataaactaacaacacaacagcacacaacacatgtgcggcggccgcggccacagacgagtctaagaacactaggtctggggcgcgccccagagaacagcatgcgactcgcggccacaggaccgcgcacgcaaggggcggcctcaccaaaaaaccgcagggcaagcggtcaaccccaagcgttggtgctacggacacaaggcccgacttactcaccggtgcggtacagcaaacgacacacaaacacgacacaccccaccgaacaccgcacaagacactgagacactaactagcgcaacgcgaacagccgccagcactgaacagaaccaacacagagcccaacacagcacacagcccgacacagacagcacgacagcaggaacaacacacacacacacaacaccaagacagaacacacagaacacaacaacgcacagcacactctataaactgccaacaacaaagacaaacaatcaaatagcatcagacatacaacagccactaaacagacagactaaacagcgataacatgcacacatacaacaacaatcacaatataccactcacaaacagtccaagcacccacagaacacacactcctagcaaatagaatataactaactacacacaacaaagacatcaatacaaagacaagatatcagacatccaagctaaacgacatataaatacaagctccagagacaatgatagaataacaa

SEQ ID NO: 667839 - DNA, 309 bp, Homo sapiens
  misc_feature (126)..(126): n is a, c, g, or t
  misc_feature (154)..(154): n is a, c, g, or t
  misc_feature (169)..(170): n is a, c, g, or t
  misc_feature (179)..(180): n is a, c, g, or t
gaggaatagcatggtttgcatagctccatagttatacttcccgtgttccatgttcctctctgtgggcgataaactggtatccatgtgtgtgacggaggaaagaaggcacatgacgtgttcctcatnacagggcagctgttaggggagttctcangctaggggacccagnncagccgtcnngtcactgtgtatgtatagaagaccacgtgtaagaacttgcattgctcctgtttagtgctgaggcccagtgtactccgaggggaaggattgctatacaggggaagcagggaggtggcacttccacagatg

SEQ ID NO: 667840 - DNA, 978 bp, Homo sapiens
gccacttaagtaatgtatcttaggtgtatttatccgtcctcctcctttctgcctctcctcaaccactcttctcctagtaggaaatcacttttcgttcatgttatatcgagttgtgaacactgtgctttactctggtgcgtagactggggcagaccactttacgtcactggagccttgtgctctcctggtttgtacgatggaagagaaactaatactacctgccatacctctttacaggactgtgtaacgcttatatatccactgaatcttctcttactttctccctttcacttgtggtgtgtgagctctcagacatctgataccattttctcatgcttttttactttataagcaattaggctctaaagcctcccttttttgcacaaaagtctgtgtattaagaaaattaagtgtagcttgggattaaagtgcggtgagccaaccgggacccgagtttacggtatacaaattcaacataacggagaattagggggcttcttggaatggtgacaccaaagggtgggagtgggcatggtgccacaaactacttgtggtttcaagtggacaaccatacaatcatccggtgatcaaagggggaaatctctcgaggaccacaggctcacccaaaaaattctggctattacacggtgctacggtccacccatactgccctcggtgacccaacagttcacacccattatggctccagcagttgcccctctcccgagaccaacaactacgctgtgccaacaacattacgcgacaattgttgccggaaaaataatgttgccgcccgccaacactatacacgtgcccacgttcggcactcggcacacagctgcacaaccgttccctaccaaacacaagtggcttcgcgcggcaccatactagcacccgttagtgcacccataaataaccctccttgttgtgcacaggcggcaccgtcccacgtcctgagagggaacaccaccgatgtca

SEQ ID NO: 667841 - DNA, 274 bp, Homo sapiens
gagcgaccgtggttctctattatcgaccttccactcccgttgtgttgtttgaaaacaacatttcccagacttgtgtggcccaacatttaaaaataagagtcggggagttcctgaccatcctggccaacatggcaaaaccccgtctctactaaaaatacaaaaattagcctggcgtggtggttcatgcctgtaatcccagcactttgggaggccaaggttgttggatcacaaggtcaagcagcatccagcaccatcctgtcgataatagcagcaa

SEQ ID NO: 667842 - DNA, 287 bp, Homo sapiens
  misc_feature (100)..(100): n is a, c, g, or t
  misc_feature (110)..(110): n is a, c, g, or t
gggggctgcctggggggctgatgccaccattccaggagcctcggtgaagagaggatatccatctgtgtagccgaaaaaataacctggattccgggttcanggcagcccgnctgctcctcctgggcatctttctcctgctgctgcccctgcccgtccctgccccgtgccacacagtcgtacgctcagagtgcaagcgcagccacaagttcgtgcctggtgcatggctggccggggagggtgtggacgtgaccagcctccgccgctcgggctccttcccaggggacaca

SEQ ID NO: 667843 - DNA, 210 bp, Homo sapiens
tggcgtcggctggggttatattgatattggtgtgatgaaattgatggccctaaagatagaggagacactgctagggtgtaaaggagaagaatgggtaggtctacgggaggctccaagggtggggagtagttccctgctaaagggaagggtagaactgttcaaccctggtccttgctcctgggcttccaactaatatgcagaatgcggagc

SEQ ID NO: 667844 - DNA, 242 bp, Homo sapiens
tgcgctcggtggaaatgcccagccgagggacgcgaccagcaggacagctctgttgtctgaatccccaccgacaattcgaccccacacaaggaggatctacagcagcacagatcacaagaacaacaacacattgtgtgtggatgaactttctacacccttacagcaagaataggccacagtatataggcaacaacagaacagcaatatattctttcttgcagaccgaacagaaatgctgtctg

SEQ ID NO: 667845 - DNA, 118 bp, Homo sapiens
aataaaggggctgggtgaaggccctgctgggagccattagaacccagatccaaaagaagccagggggtttatgatggtggcgatttttaaaatcaggaaataaaagattttgcctcta

SEQ ID NO: 667846 - DNA, 112 bp, Homo sapiens
gtgccccatgtctgactaaatttggtattttactagagacgggctttcactatgttggccaggctggcctccaactcctgatctcgtgatccgtccaccccgtcgggtggag

SEQ ID NO: 667847 - DNA, 824 bp, Homo sapiens
  misc_feature (12)..(12): n is a, c, g, or t
  misc_feature (63)..(63): n is a, c, g, or t
  misc_feature (72)..(72): n is a, c, g, or t
  misc_feature (87)..(87): n is a, c, g, or t
  misc_feature (91)..(91): n is a, c, g, or t
  misc_feature (103)..(103): n is a, c, g, or t
  misc_feature (112)..(113): n is a, c, g, or t
  misc_feature (120)..(120): n is a, c, g, or t
  misc_feature (127)..(127): n is a, c, g, or t
  misc_feature (147)..(147): n is a, c, g, or t
  misc_feature (154)..(154): n is a, c, g, or t
  misc_feature (164)..(164): n is a, c, g, or t
  misc_feature (166)..(166): n is a, c, g, or t
  misc_feature (169)..(169): n is a, c, g, or t
  misc_feature (182)..(182): n is a, c, g, or t
  misc_feature (218)..(218): n is a, c, g, or t
  misc_feature (235)..(235): n is a, c, g, or t
  misc_feature (249)..(249): n is a, c, g, or t
  misc_feature (260)..(260): n is a, c, g, or t
  misc_feature (265)..(266): n is a, c, g, or t
  misc_feature (300)..(300): n is a, c, g, or t
  misc_feature (306)..(306): n is a, c, g, or t
  misc_feature (312)..(312): n is a, c, g, or t
  misc_feature (330)..(330): n is a, c, g, or t
  misc_feature (340)..(340): n is a, c, g, or t
  misc_feature (342)..(342): n is a, c, g, or t
  misc_feature (357)..(357): n is a, c, g, or t
  misc_feature (359)..(359): n is a, c, g, or t
  misc_feature (366)..(366): n is a, c, g, or t
  misc_feature (369)..(369): n is a, c, g, or t
  misc_feature (374)..(374): n is a, c, g, or t
  misc_feature (398)..(398): n is a, c, g, or t
  misc_feature (410)..(410): n is a, c, g, or t
  misc_feature (422)..(422): n is a, c, g, or t
  misc_feature (436)..(436): n is a, c, g, or t
  misc_feature (472)..(472): n is a, c, g, or t
  misc_feature (608)..(608): n is a, c, g, or t
  misc_feature (650)..(650): n is a, c, g, or t
  misc_feature (670)..(670): n is a, c, g, or t
  misc_feature (672)..(672): n is a, c, g, or t
  misc_feature (675)..(675): n is a, c, g, or t
  misc_feature (725)..(725): n is a, c, g, or t
  misc_feature (758)..(758): n is a, c, g, or t
  misc_feature (763)..(763): n is a, c, g, or t
  misc_feature (819)..(819): n is a, c, g, or t
atttttgctttnaaaaatgaattttaaaaatgaaattatgtgtgtttttgcttttctttaggnagtggtganaaatctgtgcctgcnagtnttttatttgaanaattaaaannatgtaanaaaaaanaactttaatcccaatagaanaaataanctttgggttnanaanggaataataaaanaataaaaaaaaaaggaaattaaaaaaattcccaaanaaaaaaaaaaattaaangaaaaaaaaaaatntaaaaaaaaangtggnnaaaaaaaaaaaaaaaaaataaaaaaaaaaaaaanaaaatnaaaagnaagaaaaaaaataatttntgttaaaaanantaataaatgaaaggnanaaaaaanaanaaggnaaatggttgaaaaaaaaaaaaaangtttggaggagnaggtttttaatnggggaaagaataanggggaatttttttgaatggggaaaaaaaattaaaantgtttgctccatttatagaatctaaaagaatggagtaatttttaaagaaaagtatttgaaaaaaggatttttttatttgcactttctttgtacgcctgcacaaattcttaatgaccttagcttccctattcataanatgggccacttcttcaacggggcacaagggcactaagggatnggtcgctgggaatcagccantntantttgggataatttgagccacggcaggcaccagaggaacctgggccaggcnggtttcaccgcagcctcccttagttttggaganagcanacacgggtgggagagggagacagcacaatcagtcctctccctgaaggcacagaaanatctg

SEQ ID NO: 667848 - DNA, 421 bp, Homo sapiens
ggggctttgttaacgaggaagacttggcaggaagggctgacgatccatggaccggacgctcctgctcctgactcaccgctagacgctctcaccgaggaacaagccggtcgggacgcccgcgcgcagcagccatggctgttaaggataccggaaaaacacccggggagccggaggagacaagggaccggattggaatagccctaacaagccgcaacgttaaagccatgaaaaaggtgtgtgcagactcgagaagaggcgcaatagatgcgagtctcatagggggaccagttcgaatgcctaccaggactttgagaatcactacaagactccaaggggtgaaggttctaagacgtgggacctgttccagatgagaattcacaagcgactcattgacttgcacaggccagctgagatagtgccg

SEQ ID NO: 667849 - DNA, 215 bp, Homo sapiens
  misc_feature (3)..(3): n is a, c, g, or t
tgntatcatagacagatgtggtcgaaacccagtcgatggcatgtcttgtctagatgcttggcctctctcgggagcataccttccttctgggtatgtacaggaccgtctttggaatgggggtcttatgacctacaatctaaaacaaagtacgctcagatcatttattcagagccagatttttacacaaaagcaaggcggacgttagagctagtttt

SEQ ID NO: 667850 - DNA, 954 bp, Homo sapiens
gagttcaacccctcgtggactccgtaccttcgtggccgttggctctcacagggcccacgcgtgatcaaacactgtgtcgtgccacagtgtgcccccccggggggctcccgcttcagggtgtgacccgaggttaccgcacgtatcctgtttaaagggatttccctcttgcatagagcgggatgagtgtcgccccacgtgggaaggggatgcacccgtccttggccagctgtgtataccccccgggtctttttggtattcagcctctgctggaatgcccggttttctgctgatggcgacccccaagctgagcggtcacaatagttctctgcgcaaaaaatcggttgttaccaaacttacgaacaggccccacccttcttcgccccgaaatgttttcaccagaaccccttctgcgagggaccaaaacttttctcgaaacatttaccagtatgttcttaccccgtttgcctgtccctaattcactgcagcaccccacaaatgttatcacaaaacaatgagttgtccaccacagttgtttgccccctcttaaaacatatgtcgtaactattatggcgccgaatacctgtaagtgcttccccaccaccgcgctgtgcccccacactatatattgtcacggcaccaagccggacattttttcttccggtggagaagaaataaagatcttctatgaaagttttgtctgtttaatactaaacaacccaaattactcctctgatttgcccctctgaatatataaaaacccaaccccatgaccttctcccggcccgccacacgatatacacaattacagcggcctccctcgtatctcccagctttttaatataaatcattggcccagaaacgcactaatctatctctctctgttcattgaatcaccactttgaaacaaacccaggagccccccctaaccaatttttcttttctacccacaaaaca

SEQ ID NO: 667851 - DNA, 1093 bp, Homo sapiens
  misc_feature (428)..(428): n is a, c, g, or t
  misc_feature (470)..(470): n is a, c, g, or t
  misc_feature (483)..(483): n is a, c, g, or t
  misc_feature (488)..(488): n is a, c, g, or t
  misc_feature (934)..(934): n is a, c, g, or t
agcgggatggcgtaggcgaggcagggcgcagagaggctaggggcaacggccaggcgtagagtgcgtcggtggagcggccgcagctgcgaggagctcactagcggtcctaaccccagccacagcaccacaaaagcacaggggaagaatggtctagcattatagtctctagatgtattactgttgtgatagtgagaggtaaccttgctagtagctagcgggacattgtatcagagaggattacaccgacattaagacccttgcccgagcagatagtaattcccataatatacaaccacatatatagtcaaactagcatattctaatgataagatcatcctaaaaatagatcatcaataaggcattcaataaatacgatttgagcaaaggcttaaattttgacctatacttccgggacctgaaccgaatanatagaaactcatggactagatgggggcaaaaagattccattnaggctattaatgncatgntatgaactcggatataccatatctttgagataaaatgaatcgcagatagagatgtctcgtaaaacggatgaattagcagaataaaattctacatgtatagtcaatagtgatgggatcccaagcttgcgaaatttgggatccaaaatctaaattaaactggaaaccacaatttgcttatactctatcttgccaaatcgaaaatcgaagcctcaatgttgaaatactcggaattaaattaaaaaaaacctaagagttccattgaaaaccaaaattttccgagactcggaaaagtattcctgcataaagcgggcattctcggaaaggagaaaagagctgcccattggagatttttgcccagagatgatcctgcccaaaagagagaatgcttggtcaagaaaaagaatgaattccctctgggggcaaataaggtcgctcaatatttgtgnaagaattaccggaaagctttggtggttcaagagccgaagaggttttttggaaaatccttgcaggatttttgaggatgacgaaaaaaattgtaattaattataaaccaataaccgcatttcacgagtaaagtgtgggacggggtaataaaagggaaagct

SEQ ID NO: 667852 - DNA, 148 bp, Homo sapiens
  misc_feature (58)..(58): n is a, c, g, or t
ggctcagtcaatcgagctcggtcccccactttatgccggggcaccatcagactgctgngtttgtctatgggtttgtctattctgaacatttcatataaatggagttatgcaatgtatggtcgtttgtgactggcttcttttagcttag

SEQ ID NO: 667853 - DNA, 424 bp, Homo sapiens
ctgagctagcagtggctctagctgctccttcctctccactaggaggtacatagcgatctgctttgatttgtctatagtcagtcactccatttcctgtctctgtaagagggaggaatggcaacagctttgggttggggagggcatctgtggttgtttctaatgggaaatctctttcaagagatgttcatgcaggctccctagggccccatgccagtgccagactggtttccatggagatagggcactgaggcacctgtgaggttggaattgattccaccatgggaggtcccttccaccagcccccaaccccaatcctagcagcaagtgctgggatgccatatttgcacctaattctgggtctatcagtgtgtcttacagaatcttggatcattaaacatatttttactgctaaaaaaaaaaaata

SEQ ID NO: 667854 - DNA, 451 bp, Homo sapiens
acagctatcatcgagctgcgtgatacacccaggagaaatctatgaccggcatacgctaaacaaccgagaaacttgctccaccagacaaccggaaaaaaccatccctatccctgatgagaaactagacatgatctatcatatacaaagagatcaaaaaagccccaggagaactccaaataatctcgaagctcagatgtgctgaacagaagtctacccagaaaaccttctactcatcagcacttcagaaattatcacaggacgcatgttcagaatctcacaataagtttattaaaaatgtaattcaagaaagtaccaacagaaaagacttactacgttttcttctctcactacatcccaatgtaacaacaaaacctcaaactcctggagaacatggttacttattgattccattttctttgttcactctcagacataaatataaacaaaattt

SEQ ID NO: 667855 - DNA, 612 bp, Homo sapiens
  misc_feature (76)..(76): n is a, c, g, or t
  misc_feature (78)..(78): n is a, c, g, or t
  misc_feature (86)..(86): n is a, c, g, or t
  misc_feature (95)..(95): n is a, c, g, or t
  misc_feature (97)..(97): n is a, c, g, or t
  misc_feature (106)..(106): n is a, c, g, or t
  misc_feature (120)..(120): n is a, c, g, or t
  misc_feature (284)..(284): n is a, c, g, or t
  misc_feature (304)..(304): n is a, c, g, or t
  misc_feature (328)..(328): n is a, c, g, or t
  misc_feature (334)..(334): n is a, c, g, or t
  misc_feature (336)..(336): n is a, c, g, or t
  misc_feature (339)..(339): n is a, c, g, or t
  misc_feature (344)..(344): n is a, c, g, or t
  misc_feature (405)..(405): n is a, c, g, or t
  misc_feature (489)..(489): n is a, c, g, or t
  misc_feature (491)..(491): n is a, c, g, or t
  misc_feature (513)..(513): n is a, c, g, or t
  misc_feature (520)..(521): n is a, c, g, or t
  misc_feature (549)..(550): n is a, c, g, or t
  misc_feature (568)..(569): n is a, c, g, or t
  misc_feature (588)..(588): n is a, c, g, or t
tcagaggatctcgagtgtatcctttgtctggggtaaatacgaacaaaatgatacttattgaatcctgaatcataantnacactttntttttcaantncacaaaatncacagtggtgctgnctgtgtaataaccactattgggaaacatcccgtaaacctgcctgttgccatgccaatggagtgactgaactggtgacatactagtttaagcatgctttgtgtggctggtagaatgccaccgctgtgcatacactattgtacatcagtgggtgaagggagggttntctagataattgggggaggntaaaattgggatttttttgttgtncctttntnganggggngtgggggtatagtactcagcttatgccctaaaataacatgtataaaaacccctgaagtatngtgtgggtgtgtacgtgtgagtgtgtgtttgtatacgtctggcaattaaagctttgtcttctggaacttagtgaattcttttcncnttttcctccagaagtatttgtnacaaganntgtaaataagagctctacttagtttgtnnaccatgaacatgttgcannaaaccttatgcatctaatncctacaaggtaacaggaaggctta

SEQ ID NO: 667856 - DNA, 200 bp, Homo sapiens
ccgtagcctcatacatattctgaaatacctcctggagatgtatagttcacagggagaaactttctggtgctgtctttgttctctgaattttcagagactttttataatgttattcatatgggcgactgtgtaactttctcttaagacttaattttctctttgtatgtctgttaccttgttaaataagacttaaatacatg

SEQ ID NO: 667857 - DNA, 913 bp, Homo sapiens
ttggggaacgtcggcgtcgcccaggaacatgtactacgtatagggccgggggcttctagcgccagggctcccgtgggaccaggacgccaggtagggcagggaacctcagtagtcgctccacgccagccattctcagagatgaatgcgtcaataacctcgctcatagccaagtccggggatgagctgctccatggctacagggggctcacggggtcacggggtcaaaatgacccacacgcctgcagccgacaagaagggacagacgggcagtcataggggcccaggaccaccgccaactggcccatgctcccccagcacgtcagcctcacctgacaggtgctccatcgatgtccattgcggtcgtaggtgatgccaactgggcgttgatgcacggctcccgcatcagtctcaaagcgtgatcttgccagcatcaggtagatcgcgggatgtctcgcattcttcgtggcacaggggcacacggtcagaggctgaaaaggggcactgcacgagcacctgccagccatcggcagcaagctgacacacactcaccttcctcgttctcatccacctgagaaaaatagctcgtccatgtccgccatgtacttgtcctgtgaagagttgatgtgctgtgcttgggggagacaccccacgctccctcctccatggggcacagacccaacacaaggcggggatgctcccacgccagcgtgcacacacacaagacccacatgtgggtggggggcaccctcacgtgcttggcctcaatgcaggcctgactgggcccggacgtggctgtcgtcctcatcaccctcgtggtttcgctggcactcttccagctcactgggggttgaccaggagccggtcagagatggacctggccagatgtctgatacaccccaggtcagcgtaagca

SEQ ID NO: 667858 - DNA, 373 bp, Homo sapiens
cctatcaactaatttggcctaattgacatttgcagaaccctcccccccacaacagcagagttcatatttttttccaattcaaatggagcatttatcaaaatagggtccatttttaagttcaggttttcaggtcttttgtcagctttaaccctaaagtttttaaatttttgatgaggtcaaatggattgttaagtttcatgttctgattgggggtagtttatagaaagccaattgatatttgtgcccggcatttaaatcccgcaactggtaaacccaaattaagtttaggccctttttttatagattttggaacattatcggggcagttgataatgtcatttgtgaataaaaaaagtttactttttcctttcca

SEQ ID NO: 667859 - DNA, 591 bp, Homo sapiens
aaattgaaaaaaaaggacaaagagtcggtggcgctcctctgcagggcgttctgtgcagagcgaggcccagggcgcagccctcagagggctgcaggcccaccctgcccagtgcccgccgccgtgcttcaccccagctccagcttctgtgttcccttccgcccatgtgcccagccctcccaggcgggcacagcccgggtgcggcggccgtggggggcggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcccttccgcaaagacaa

SEQ ID NO: 667860 - DNA, 116 bp, Homo sapiens
gatctttattctgcaccacagcttccaaggtgctgggattacaggcgtgggccacatgcccagccgaagcgggcgtcttcttatcaatactgtatgacttttaaaacctgttattt

SEQ ID NO: 667861 - DNA, 707 bp, Homo sapiens
ctgtgattcttttacttattttttgtggtttttttttttaaaacaaattttagcccaattttctggagttcattctcctctcttgcagcagcagaggaagggccgtgtacctccctaccaagtgactgggtgtccttattttctaccccaagagcagggatatatagcgtggtgtccaaaggggttctgaattctacagactcatcaacatgaggcagggaatcatgtgaaaaccaccgtggtgtctccttggggagaatgacatatcttaaagtattatacgtagctatattcttctatatctagcatatgcaaagctttccttaacaggtaaggggtacatatgcatagggggaggagatcagacctttacaaggtgagggaaacgcaacttcagaaatgaattattttcttggctttatatatttttaccaagacagagaagtatggtatggagagataatctatttcataatcaatatgggcctaaattatttttaacatcatttcactcggttactatattttcaggaacttacagaatgtggtattcattcagcttaaggtacctctgtggaaataacctaaaaatgcagacggatctgagagatctaaccctggtgtgcttaagaaactggggatctaggatctaaggtatactggctactcaatgatcttacagtgtttcgtcgcgaaagggggtcctc

SEQ ID NO: 667862 - DNA, 850 bp, Homo sapiens
cagcattttgggaggccgaggtgggcagatcacctgaggtcaggagttcaagaccagcctgaccaacatggtgaaaccccatccctactgaaaatacaaaaattagccgggcgtggtggcacgtgcctgtaatcccagctactcgggaggctgaggtagaagaatcgcttgaacccgggaggtggaggttgcatgagccaagatcatgccattgcaccccagccggggtgacaagagtgagactccatctaaaaacaaaacaaaacaaaacaaaacaaacaaacaaaactaaaaaacgaaatcatgctatgaacctcgaaatatacacagtaaaatttattaaaaacacaaaaaaacacaaacacacaaaacaaaacacaacacaaacacggggcgcgcgccccccctccgggcgaacaccccaccccacggcgcgcgcgcggcacaacacacgcggccctccccaacaacgctcggtccgcgccccccacctcgcgcgccccctctttcccacggtctctcacacgcacacggatacacacacgaccgcggggctatcacaaggcgagatatacacaccacagcgctcgcccactcctgctggtataacacaacacccctcctccttttccaccacaccagtgtgcatcgggcgagcacaaaacactgtgtctttagtagcggggttggaagccacacccccacccatccttcgtggcggacgccagatacctcatcaccaggattaacacaacagcgcccccctgtgcgtggcgcgccgccgcttcaccaaaacacgcgcgctattactataacacgcgtctctgtcctacaaaaagatctcctcatt

SEQ ID NO: 667863 - DNA, 194 bp, Homo sapiens
ctgtacagtagtaatcgattgatgatgatagtaaatgattatcaggctttggaggcgactaaagtgctgtagctccttagtctttgctgttgttatagtgtagctcgagccatagacagtaaagttagttagttatgagtgagcacagctgggtgccagtacaattttaatgatcattactcttgtacagccgg

SEQ ID NO: 667864 - DNA, 858 bp, Homo sapiens
  misc_feature (65)..(65): n is a, c, g, or t
  misc_feature (84)..(84): n is a, c, g, or t
tgctgctgcagcggctggccgagcagagccagcgtctggccgatggcgtggaggccctcaaccgnaccctcgagaggctggtgnaagcacgccctacccgggaagcctcaccctcactccaggacggtggtcctgccagtggagtggcccaggggcctgctggaggctcccaggacagccccaagggcacccactcggggctcgaggtcttctcagggatgatcttgaaggtggaggaggagatatagggctggtcgggggtgctggcagagccaaagggcaggagcagggcctccagtctttcccctgctgagtccaggcaggggagaggtggcagtgactgggtctccagggcaccgggacaactccagtccaggagaccggaaggatgagaggatgtgggctgtctacctgtgatgtcgcgtccttgccattgcctgtagagggtggtgacctgcagggaaaggctgcagagagccgacctgtgggactcagtggaccaggtctactcagggatgatgctgttggaggctccaaccccatgtggcagcagctgcgaagtctgcagcccagcgtccctggaagcaggggaggtggggaagatgcactgaggggccccctgctcactggaactctggaaagggtggctcagccaggctctaaaaaggtcccaagcgtgatctggtgtgactcctgaaagcccctgtccctttggtgggcatgcacacttggagggcagggctcctctgccctacgtggttctggcccaggggaaccacatcccatatgcctggaataatttctatccaattttctgttataaatacataaatatatatatatatatatatgcctata

SEQ ID NO: 667865 - DNA, 1117 bp, Homo sapiens
  misc_feature (65)..(65): n is a, c, g, or t
  misc_feature (84)..(84): n is a, c, g, or t
tgctgctgcagcggctggccgagcagagccagcgtctggccgatggcgtggaggccctcaaccgnaccctcgagaggctggtgnaagcacgccctacccgggaagcctcaccctcactccaggacggtggtcctgccagtggagtggcccaggggcctgctggaggctcccaggacagccccaagggcacccactcggggctcgaggtcttctcagggatgatcttgaaggtggaggaggagatatagggctggtcgggggtgctggcagagccaaagggcaggagcagggcctccagtctttcccctgctgagtccaggcaggggagaggtggcagtgactgggtctccagggcaccgggacaactccagtccaggagaccggaaggatgagaggatgtgggctgtctacctgtgatgtcgcgtccttgccattgcctgtagagggtggtgacctgcagggaaaggctgcagagagccgacctgtgggactcagtggaccaggtctactcagggatgatgctgttggaggctccaaccccatgtggcagcagctgcgaagtctgcagcccagcgtccctggaagcaggggaggtggggaagatgcactgaggggccccctgctcactggaactctggaaagggtggctcagccaggctctaaaaaggtcccaagcgtgatctggtgtgactcctgaaagcccctgtccctttggtgggcatgcacacttggagggcagggctcctctgccctacgtggttctggcccaggggaaccacatcccatatgcctggaataatttctatccaattttctgttataaatacataaatatatatatatatatatatgcctatatattacttggtactgtatggggctgggatgacatttgtacctgtagatttttcttgcaaaaagtatttttttacataagcataaaatgacaaagcaggcagcagtgcggctgctgacgagcacgtgagttggagcctgcttctcgggcgtggcaggcaccgctgctttcagcctccctgcgggggcctgggcacttccctgcgtcttcagatccttcttcctccattacctcctttgactcttgggagatcccttggcg

SEQ ID NO: 667866 - DNA, 1026 bp, Homo sapiens
agcatactttataaatcagggaacttgaagctaggtagaatcactagaaaagactaaatctataggaggcagcgacaatggtcgcccgaggtaatatgtagcaggaagaaaatttggaatcaacgtaactaaatcccgtgtggccgatggtatgaatgacaatgtattttgagatgtgaccatgagaatcaatacgccctaatggatggctgcctgcatgttggcatcgaagggcaaaaccatggcagacagtcctaccagccagaggtccctcaacatcctttcatattctgaggatgacaaaacaggaactctgcatctcgaggtggctatccagatctcgaacaacatggatatgaagcccacgaatgtatcagtgtcaccacggtgtgcaagagaaaccacaaatccaaaacaggtggaccgccggatcctggagggcgcaagcagtaacgtggccacagatgccgcctggatcgaagcaaagctgcggtatcatccaggcgtggcagtcactgcctggagattcggcctcaactactaacattgtcaagatttaagaggaagcaaaccaagatgacattctgggaagtcacatataacacggtatgcttacacaatgagtgcagacaaccgagaataccagatgacacaccatggaagaatacacaaaagtatcgaacaccgccgggacatgctacagagtgggagaaacccgggaaggctgagccatcgcagattcgaacaaagaacgaccattaccatgctaacacccatgcacatgaaatgcagaatagcaaagacatagaggccacagaagataaaataggacaacggtaacaatcaagttgaacagaacacgaaaaccaaaggaaccacaaaacagaaaaacaacacgataagaaggaaagagtacacagcaaaagaaggaccgagcgaagcagggaaaggcaaacaaagcacaagcaagaacaggaccacaacaaacaaggagacaaacaacgagaagaccaaccaaccagaaga

SEQ ID NO: 667867 - DNA, 805 bp, Homo sapiens
  misc_feature (65)..(65): n is a, c, g, or t
  misc_feature (84)..(84): n is a, c, g, or t
tgctgctgcagcggctggccgagcagagccagcgtctggccgatggcgtggaggccctcaaccgnaccctcgagaggctggtgnaagcacgccctacccgggaagcctcaccctcactccaggacggtggtcctgccagtggagtggcccaggggcctgctggaggctcccaggacagccccaagggcacccactcggggctcgaggtcttctcagggatgatcttgaaggtggaggaggagatatagggctggtcgggggtgctggcagagccaaagggcaggagcagggcctccagtctttcccctgctgagtccaggcaggggagaggtggcagtgactgggtctccagggcaccgggacaactccagtccaggagaccggaaggatgagaggatgtgggctgtctacctgtgatgtcgcgtccttgccattgcctgtagagggtggtgacctgcagggaaaggctgcagagagccgacctgtgggactcagtggaccaggtctactcagggatgatgctgttggaggctccaaccccatgtggcagcagctgcgaagtctgcagcccagcgtccctggaagcaggggaggtggggaagatgcactgaggggccccctgctcactggaactctggaaagggtggctcagccaggctctaaaaaggtcccaagcgtgatctggtgtgactcctgaaagcccctgtccctgcccaggggaaccacatcccatatgcctggaataatttctatccaattttctgttataaatacataaatatatatatatatatatatgcctata

SEQ ID NO: 667868 - DNA, 127 bp, Homo sapiens
ttgttccttctctaaatttctcatcaacaatcgactaatcaccacccaaaatgactaatcaaactaactcaaaacaaatgataccatacacaacactaaaggacgaacctgacctcatgatctgccg

SEQ ID NO: 667869 - DNA, 418 bp, Homo sapiens
aaaagagctagtacagaaagtgggactctgagagaaagggaaactattatgaacgcggtggttgggagagagtaaggatgggatgtggagtgggactaaagagcacaacggcgtgtgataagacccccgggccacagacccggcgccaaagaaagcggaagtccacaaatacggccgaagtagccttggaggaatacgaggggtatggcctgcatgtgggggtgccctaaacaacgacggcgcaaaggaaagaaatacaaaaggtaccgtgtgtaccgtaataatgcatggttaatgttgtgtacagagaaaaccaggtgggttggggctgactgggcggcttggaacaattacagggggcgggcggcgatggggttgaagatgaccagcggttcgtaccccgattatagcgcatcgt

SEQ ID NO: 667870 - DNA, 241 bp, Homo sapiens
cccccccccccttttggggttttgggtttccaaggcctccccccccccattttgttttttgtttaaaatttttaacagggggggggggcccccccccttttttttttggggtttcccccccaaaaaaattttttttttttcccccgttttgttttcccccccccctaatttaaaggggggggggggggggggttttggggggtggtcccggggcccccaaatggggggggttttttcccca

SEQ ID NO: 667871 - DNA, 142 bp, Homo sapiens
ctacccagaggcagagtgcaagcgaaggtctccctcgatacctcgcaggatgcacatctccgggtttctatgcgtgaatcacagtgacagcaatgcgccctcaccacttcccgtcgtcctacataggcttggtctgggctcg

SEQ ID NO: 667872 - DNA, 125 bp, Homo sapiens
gtaaacagagtttaaccatgtgaccatgctggtctcaaactcccggcctcgggtgatccgcccgcctcgagttcccagagtactgagattacaggcaggagccactgcacccgttcctcatttgg

SEQ ID NO: 667873 - DNA, 284 bp, Homo sapiens
aacaagggatattctgtacctggtattgatcactactcacaacaggaacattttacaacatttgaagcccctcatgctcttctcactagcgatccctgacaattgccgtgacttaaaggataatgaagtatatgaacactgatttgatttgacttctgcatttgatgacattgtcgaaatgggataccgaggacaacgttaacttgccaaacatcagatccatcacagatatggaatctcatcaagataaagtgtccacacccgtcagaaagactcaagaaagt

SEQ ID NO: 667874 - DNA, 1371 bp, Homo sapiens
acagagtctcaccctgtcacccaggcgggatggagtgcaggggtgtagatctcggcctcactggaaggctccggcctcctggggttcacacttttctccggcctaaagcctcctgagtagctgggactacaggcgcccaccaccatgcccagctaattttggcattttaagtagaagaacggggtttaaccagtggtgggccgggcgtggtcctcaaactccgtgagtgttcagggtgactccatcgtgcctcagccttcccaaaggtgcgtgggatatatagggggcgtgtgggccacgtggtgtcccgcgggccaaataattgtggtatacatcttctatgaggtttataatatacgaagaaaagaggggattacaaaaccatatttcataacgcgtgggagttaaaatgtgcatgtggaagaaagggctcttataaagattcaggagtgtttctaaagtggccttataaagtgtgtcgtgtgtattaaaatactcaagtgggtttctacaaaatctcttagattaatagaatataagcgttttataaaagaggcccaaggaaaatttaacagtcttttctaaaacaacacatttgtggaacaaacacaccaaacacataccacacaaaacaacaagaacaacaaacatcaacacacaagaaaacaacgaaaaaaaaaaacacacaaaagaaatacacataacatcaaacaacaataacacaacaaaacacacacacacacaaagacaaaaaacacaacatcaacaaaacagcaacaacgaaagagaggcgcgcagcacccacaaaaaactaacaacaacgaacgacaggggaagaagcgccaccaacaaaagaaaaacaacaagaagtgaagagacgcgtaacaaggtcagagaagaaaagcacaggaccacacacacacacaagatcaaactggcacgccagctacaaaaaaattaccacagcaaccaaacaacaccgcacacccgacgacgacatacaaactctaaaacaacaacagcgtccgcccccacttgcccatacactaacccacagacgaccacacgtactacgtacacatctttcgacgggcaacacccccaccccactacttatgtgtggtggtgaggggcgcccaacatttgacagcgagaagcaaacgaaccgaccagcatgcgcgaatcacgacgaccagacccacgcccgacgagcaataatccaaaacaagacctaccacagacatcgtagctgatgcgcggggccaccccaacggacctcctcatgatcgtgcgcggcggacgggagacgaagagtactcgcggcgagtataatataaattaacggggaggaggcgggtcgcagccacggcc

SEQ ID NO: 667875 - DNA, 251 bp, Homo sapiens
caccagatgctcccaccttctctgcttcctccagcccctggcaaccaccgccccactctctgtttctatgaattaaactcctctaggtgcctcttttaagtggagccatgcaggattttttccttttgtgtctgccttatttcacttagcctcatgtcctcagggttcatccatgttgtaacaagtgtcagaaatgctttcattttaaggctgaacagtattccatgcacatgctgctttatcacctccac

SEQ ID NO: 667876 - DNA, 148 bp, Homo sapiens
ggccagcggtccgcggagatggaggttggtgagcggaatacgccactgcgctccatctcctgggttctagcaattctcctgcctcagcctcccgagtagctgggactacaggcatgtaccactaagcctggctaatttttatattttg

SEQ ID NO: 667877 - DNA, 468 bp, Homo sapiens
ggctctacctcagcctccagagtagctgggatacaagcactcgccacctgcaagtaatttttggtatgtaaagaggagatgggggtccaccatatagccgggagggtctcgatctccggactcggatctccggactcgtgagccacccgcctcggcctcccaaggggctggggataacagaagtgagccaccgatgccgggtaaatgatatttttaaacattctaatttccttctcatagtggcttagtacactgccacatatctagggggctctcgggacgggacggagtgagttctggtttctatataaaggcagattttctatcaggtagagagcctgggaactaatcactagagtgtctacagctcaaacattaaaaaaagaccggtcggggcctaaaagtagttgcaaaacagggacaatttattttccactaggtgggcggttgtgtccttactccttgaag

SEQ ID NO: 667878 - DNA, 1035 bp, Homo sapiens
  misc_feature (395)..(395): n is a, c, g, or t
  misc_feature (602)..(602): n is a, c, g, or t
  misc_feature (646)..(646): n is a, c, g, or t
  misc_feature (667)..(667): n is a, c, g, or t
  misc_feature (774)..(774): n is a, c, g, or t
gactgtaatcttgacagtggtgtcgatagtgatggaatggacgcggccggtactacactcctcggatggtgttgaggcacgttatctctgcccatggtgaacgccgctcggggtccgcggcgagtggttaacgacataatgcggtgcttcccaccagacgtcccgccctaattcttttgggaagcgcccggaaattttcgtgtgacaacacacttaacgaggtctcctgtgccggtccctggaattatcccggggtttgccactctctctcgcgtgcacacgcataatacaccacgtggtggtgggtcacgagacgacaggtaagagactaaagagctggtctctaagaaaagcagaccatttaagttgagctgcacactctattcatgcgcggngcaagttgggtcaatgttcaatacgcacggtttcattatggtgggtatagacgataaggacaccgtttggttctcacaacccgccggcggaaacaatgagggttgcatgatccatcaacaagacaaaacacaggtgtgctggtgcgcaccaatttccccgcggcgactggttcatgctgttagagtgtaataaccacgcgggtaacncacaccgcgtgtgcggtgtttgcatttctgcaccccagaagcgnctgctctacgaagaaggggtntttgtaccaccacaaagagaccctcgtccacaatcgtgtggggtcccacaacagggaacccgctgggtgaaactgtgattaacatagagggacaactgcagtctgtngaacgccgtccgtgcggcctgaaatttcttgtggcgaggtacaaaacaggggggcgggcattaaaaaccctgagatttcattttctggagtaccagaaatttcttgttccactttgaggagaacgggtaacagccaccccaccgtagctatttagggggtcaaataatgctagttgtctcacaccccgggtgtgaatccccctttttccccccctttctttccccctggggcaaaaaagggccctttcccggaaaaaaaaa

SEQ ID NO: 667879 - DNA, 805 bp, Homo sapiens
  misc_feature (587)..(587): n is a, c, g, or t
tcttgaacccgtccagtgctgccagttcaaccaagggtctgtgagttgtcagcgtgggactcaggcagcagagcttttttctcccctttgtgccttgatccttcgcaaggcttgagccacgtgggctgtgggggaaggggctcaaggccatatcccaatacgtgtagggcgagggtccctgttgggcactttcaggctgtgctggggaagaagagaccggggtctgggaaggaaccggtccccgagggttcctgggtggcctcgccttttccccctttggtcagtctgagcagttgggggtttctatgcccgcaagttctcaggaagtattcacaaaagaaaacttactttttttcccccaggggttggggcaaggacagtggagcagagtgctaggaaagtgagtcccctgtgggaaaggggaccgggccgtgatgctaaatatctccggatcccaagtgacgggattggcctaggaccttcagatcaccagatttcagacccttcagaacctgccccggggccaggtggagaacgtgagggccgtacaaggaagtgaaatctgagtcgagggggctaaggcctgnaccccttctccatgctcccggaccaaattccatttgggcctcagtagaatattataccaagtggatggttggttgccaaggcttgaagttgcagtggaccaattggggtcacgtgaacttccacttgcgggggcacagcgaatcacaagccacaacctccctgatagctagagactgagtggtcacaaagccgggaactagggattgaagcacaatcg

SEQ ID NO: 667880 - DNA, 142 bp, Homo sapiens
agcggaccgacgcagggacaccacacatgctggcaaattttctatagagtcaggtttcactatagtctccaggctggtctcaagaatataactcagaatagtattattttccacatgcattagtaatcaccaatagtttatg

SEQ ID NO: 667881 - DNA, 558 bp, Homo sapiens
aggagtgataccagtctcatggaatctacagtcgcggtagtcaagtgacttcatacagtccatgttcatgaagagagtcgctgctagtgattgatagcggggtcggacagacatgtccattgtataaaaagcagcatccatctgaaggactcacttggattaaatgtacacctaaaaaaaaatacagtggcacctgcatgcagtgcccgaggatgggtgtgctgtaataactagatctggtgtctgtgggaggtgcacctttggtagttcattgttgggttggtatttgtctccataacctgtttcagcctcaaggtcatttacctttgatcagtgcttcaagcttagcggtaagtttatatacatgttcatgtatgaattatattactcagtctgatcataatatatgcccagtgcaaatcatttcattaaagcctcagggatacacggtgccaccgtttcctcattcagggacacgggaatagtggtagtgtgtcttcagcacgacatggggaaattcaaaggcagccatccgtgaaagagccaacggcagcccgt

SEQ ID NO: 667882 - DNA, 300 bp, Homo sapiens
agtcgttgagagtggaaaccccgcgagctgtttctctagctctcgaacgcgcacgtactgcgccggcgttctgcagcaaactctggtgtttcttgcgatctcgcctcgccacgtgacgacacctgccagctagaacgccgactccatctctatgtcgtgagtaggcacggacttggtgtacttacaacaggtcagagagggcccgagaacagcttcatggtcttcttctgccgggtcagcccctcggctctggactcccaggggagtcctagaccctcatactccctcctccacagctgg

SEQ ID NO: 667883 - DNA, 417 bp, Homo sapiens
ggcacgagggtccatgagtcagccccactgcctgagattgcggtccaggattgacctgaagaatggaaccagtccagaggcgggggatgcggctgccctcgggctcatgactgacggcccaggcatcttcagaggggctttcctgggattacaagcccccagcagagacagctagggcgtggctaaacccactgccatgtcaggaaacttagcagtaaagccttctcccactccccacaatgggacacgctggtgacagcagcctcggtcctgggcaggctggagaaggacgtggcccctcagtcctgctggaggcctcgggaatgacccccgcctaggacacagccagctccactatggggtcaccctgagtcttctttaggagactcttaagagataacatccctgaaaaaaaaa

SEQ ID NO: 667884 - DNA, 122 bp, Homo sapiens
atcttttcaacacatatagatcgagtatgaggctacaaaagtaatacctctgtgagagttttaaggtacttttcaagtctttccttcggtgagagatatggccccgcacaggggggactcgt

SEQ ID NO: 667885 - DNA, 1713 bp, Homo sapiens
  misc_feature (857)..(857): n is a, c, g, or t
tttgtcgtgagtgtcctcggcttcttctgcttgctttgctgtcgtttgttcatttggtcgctcaattgactcatcgttggttcacgttgacttttgctgcccgctgtgccgacgcccccctgtctggtgtggcaacaatggctgtctgacagacggaggtgttcgggcaccctcgttggtagtggttgctccttggtggcacactttctggtgaagagaccccttttttcatgtcgggcgttgtgctgtgtgtgccaagatgactcttcgtctcgtcccccgctgaacgtcttgtcccggggctgagccatctcctttgtgaccagttctttcttttgggtttccacgggcgggatccccaatggtgagcgtttgtaatggacgttcgccggcgggcgcccagattctctgctggagcgcacagttgttgttccagcgcccgcccctgttgggcccaagtgtcctcgttgtgtgtccaccagaatttcttgtggcccccccactttgatggccgtttcgccttggatggtgtactcataactcggggggggaaggcgccccacaaatgtgggggcccaaaggcgcgccgcacctgttttccctcaagtggtgcagagatccgcctctgtgcttggttatgagaggcctttttggtgacagcctcctccgcaagggcctctcgatccccccccccgacatttttgggtggaaaaagcaaagttgttgtgtgttgagaaggaagaacaaccccacggcgctgccttgtggtctgtgtagacctgtgtgtgccagctctcccaccgcggagaagtctcctccgcagcggtataacgtgaggctccacaacgagtagtttncctctctcctcttcgcacaacgggggcttaaattgttgccgcgccacgctacgctgaatagattatacttcttgggagaaataaattggtaggggcacccaccgcagatgggtatatctcactgcatgagggtgtataactctccccacaggggggggaatatacaccttcgtgtggagataatatagagagagccttcgttgggtgggaaatatatatagagaattgagtctatagagaggctaaacacacacccaacattgttcttggggagactctccacaggctctcctcgtcgcacactgttttgggcacaggagttcaccgcccacagatctcgtgcaacagcgttcgcgcacacagattggcgcactgatatgtccctcgcaccgtctctctgggagtgtctcttgagtatatctcgcacagagtgatgtgtggcgtgcgcacacactctctggtgtgtgtctcgagagagtctttggggtccccctccggtatattcgaattgttctccacggggactcttgtgagagggtccttctgagacacccacatggcttcaccacgagaactgtggctccacagagaggctccactctttttttgccacagagagcgtgaacaccacggtgataggagaaccacgctatgtaacacatgtgttgtagacacctctggttatgaaagcttgctgcacaactgcccttcttcccactcacttattaacactcttcacaccaccacgaaccacccacttctgtcggtcgaaaaggctcacgcccttctttacacacatgaaagttctgtggaccagtaaggaacgcagagattaagagggaaattttatttttta

SEQ ID NO: 667886 - DNA, 1419 bp, Homo sapiens
gagtcagatctcgccgacctatgacgttccacctcgtgatgtcctgcaagacagccgtctgcattcgctcatcctaccgccgaccgcaggactcctagccgagactacaaagattccacacagtgatctaatttactcgaagagtcgcatgcgcacgggagatcgtttgacatgcttcgccgggaactcacacgagcctgctggtagcgcttgaatcgttctctccacctacagaagagtctcttcagtacgactgtcgctgcccaatggctgcgtgtcaagctgggtactcgtaatgaagtgcccccttagaacgctccgtggcactagagtgactagatcattcgcctactactggcggaatgagggtgtctgctagacacggcgtagtggaacacaatgcacactaaaaaaacataatagagctgccctagacaccctaggctttcctggcaacggaaggactggcactcggttgcagcaagaaaaccaaagacgcacaggacttcgaccagacaactggcactttattgctgatgcatggggactagggaaccatgaaagagagtaccacatacttacaagtgtctggggatcgacagaacagcagcacgcaatttcgtggagtgggagattgtccgcactatggcccagtacattgcctagaaggacctagcgcctgcactcgtccgaaagcaaacggcgcggtcccccccccaatgggtaccccgcgatcaacactttccccatgggtacattatgtgacgatttggtgccaagacttcctaggaaaggacatcacgttccccatggcacccagaagtcttcgcgcggcaggtttccaatcttgtgtccaaatcccaaactggggtcggggagtacgtgcaactggcatgaggacaaaatgaaaggcccagggcgccaattgtcacggagaagtttcacacgatgaatcccttccccccagaacggtgtcaggcatgcccagaatcgtcccagccgagacagccccaattgccgacgatttgggaagaccatcaaggggtttaacgcagcgaaaccccctggacccaaatggttgctcaccgcgtgacacaatcatgcggtcaccaggaatgccgcaccttagtgttgccggcattagacaaccacggggaatacgaccccagaaagctgcgtgaacgacaacacacaaccggcaaggacaccctgaccgagaacaaagcggcacatgggaaaaagtgtgtgcgacacagtgacaaacgaagggagcacacgaaatggacaaagtaggcgcaaacacaagatctcgaacaacagacaacactatacccgcacatacaagcgagcccgaaactacccagcgaggacactgtgacgagaaccaatgatgaagcactcaacgacacccacggaagc

SEQ ID NO: 667887 - DNA, 148 bp, Homo sapiens
  misc_feature (124)..(124): n is a, c, g, or t
ggggagtcgggagctaagcagagcgccagtaaaaatgcgaagaagcatatttcctctctgcgagcttctacttctaagtctggaatccagatcagaaaataagtattgtttgtgaggtaacaanataaaataagcatctagactctgg

SEQ ID NO: 667888 - DNA, 1691 bp, Homo sapiens
acggttcggaccgggcccgcgaagattgctgcagtccattcgcggctctcattctgccttcccacatcggacatcattgctcacatgttcccgtgctgtgggattatacattgtgggacaacgcggtggttgggcgacattgtactcatggacatcagaaactaagtgatactacccaaaaccgtgggcctcaccacacaactgtgacacgaacatattaacacacacgggacctgtgtgagttggccaaagaaaggaaaaacaccacctaagattgcagttgacgactgttggctttcaacagccaatttggccattacaggaagacttataataggggattacacataatgtgcatactatagaagggagccctacaggtataaaaaataatcagttggaaacgcaaaaaaaggctatagaggggtataaagcgggatctttccgatggcatctaagaggagaactatatacttactattcgccattgtgggccatgaggaacacccacggtggcatggatatatatgtggaggggccttattaaacaagggcaagcggcagaaaacaaggtgggggcagccacacacaaaatttgttggaagaaaagtgttacaccgcaggcaccatatttttatccacaaaggatattaatgtaccaaacgctttcataatcccccaaattacaatttcccccatatagcccaaaaagtgtgtgacatgtatgggagcgaggcgcttcaacgttacacgtaatcttttgggacaatcattcatagatggaggtatggcactgaagagcaaatttgagtgaataagacaagcatgttggaacgattataataaacgtgtgaagtattagatgtggaatccataccattaaaaaagatgacggataaggggccgaaaatataataaaagatgtaacggcttttgttagttttcccaaagcgaggaatacaatatttggtgatattgaccgcataagtgggtaattaagggcaagtggtggctacgaggcaataccacaatcaatttaagtttaacggttgcacgcttatcgacacaaggatgtaaaaggaatacagtttacttacacagggggggtaacatctgggttacaacaatccaatttgtagcggcaacgcaacacaacatataattgattgtggattgacaacacacgtaataagttaaatacattgtaacgcgtattgataacgagcgatcaagcttatccggtggcggaacagtaacatgcaacatgtcacatcatgacgacaacgaggaggataagagcgaacagcacatgggcaagactcgagaaaaatttgaagcccacaagagagcgaacaattgtggcaatccaatggacgaaacagccgcgtcagtggaacaactggctcaggagactgtggtagtgtgaacaaattaacaaccaatatgagtttgtggccagagaaggataacaaataaaaaggtgaggggtacctaaagtaggtatataatcagaggtcttctaaaaaactaattgttgtaggcaaaatgatgaatagctgatagaggatcatgcggaagtaatactagaaggatattagtcggtcgtgaagaccaatagttagaatgtaatgtggtttttgtagtagatgttgattttattagtagtaactatgaggagagtagcggacgat

SEQ ID NO: 667889 - DNA, 351 bp, Homo sapiens
gactttcctttaaaaaaaaaaaaaggacttctgcaatgggagagatatttccattaaagattaaaggaaggccgggtgccatggctcacactgtaatcccagcactttgggaggccgaggcgggcagatcgcttgagcccagcagttcaagaccagcctgggcaacatggcgagacctcatctctacaaaaaatacgaaaattagctgggtgtggtggcatgtacctgtagtcccagctatttgagagactgaggtgggagaattgcttgggcttaggaggtcgaggctgcagtaagcagagatcatgccactgcactccagcttgggtgacagagtgagaccctatctca

SEQ ID NO: 667890 - DNA, 106 bp, Homo sapiens
ctcatacacggatcccccactgctgatcctggagcctgggccgcatcgcacgccccccgtgcgtcggcaacaacccattcgtacttctgcccctatcaacttccga

SEQ ID NO: 667891 - DNA, 1194 bp, Homo sapiens
  misc_feature (448)..(448): n is a, c, g, or t
  misc_feature (531)..(531): n is a, c, g, or t
  misc_feature (565)..(565): n is a, c, g, or t
  misc_feature (567)..(567): n is a, c, g, or t
  misc_feature (586)..(586): n is a, c, g, or t
  misc_feature (640)..(640): n is a, c, g, or t
  misc_feature (648)..(648): n is a, c, g, or t
  misc_feature (650)..(650): n is a, c, g, or t
gagcaagatcaccgtaagtttggtttcttctgttttctggtggtagtaaaagtgcctcttcccaggctatggccttgttggggttggggaaaactgagatggcagcggggactttcccaggagcctggtctgtacccagttctctcccacctcgtctttttccttggctgaccaaacacaagttgaactgagagtctgagtttgaatcaagttcaaggggaagttcatggagcgtcccctttgtgcttcctgggagggctcccgatcagtcatgtttcgggtgattctgggatgctgattcagaatgtggtaggattggaaaatggattggtgactgtgaaaagtcaagtaaggggaaaagcatatggggagggaagtcagaactttttcccagcttgggggatactcttcttactttcagaggctgcctgcagggtcagtccaagcnatccgcctccctgtcctagaaaagccttctgtttaaaagcatcacagagctagttcatggactgtcctacgagtgtgctcttnttccttgagttggctaatgaagaattcctttctntntccttagagatatagaaanagaaaggaagaagggtaggaaggatggagaggggaaactatgttttggaaaaanctagactntnaatcaataagacaggcagactcctggcttatatagatcatggcttctttgctgaaaagtttgtttctgtatcatacagtcagaaatgcttatgtttgaggggcttccagtagtgactattacatgctgcagcaaattatcctcccagatttctcagggttcctgtgaacaactgtatagaagaaatttgtacacgtatatagtattcatattgctagacccaacctgagtgtaattgagtctcctataagcagttttgctgattagcttcttattctgataaaccttggtaaacccgtgaaaagagagtgatgaaaagagagaggatggatggctgggtgcagtggctcacgcttgtaattccagcactttgggaggccgaggtgggtggatcacctgtggccaacatagtgaaaccccgtctctactaaaaatacaaaattagctgggcgtggtggcacacgcctgtagtcccagctactcaggaggctgaggcaggagaatcacttgaacctgggaggcagaggttgcagtgagccgagatc

SEQ ID NO: 667892 - DNA, 808 bp, Homo sapiens
gcaccgctctggatatcccggctctacgtcgcgtcccataatgggccatcgatccaggtgctcgtgctcagctaatagacacaaatcgtgaatccgtgacacgtaacaatgttcaatctggacaagcatacaattgcttgctcgaaagactattgcacgatatcaatcccgaacatagtgtagtggacccagacgatccatgatcgaacgatagctattgtggatcccagatgcgtgagtgctatatgtgatagaccagatgattggcccatgaccattctatcctagaggagttcgaagtccagtcatccagcggtcgcaagttccatgcagtcgaagagttagcccggaacccagtggatggcaagtaggcttggaagcatgggtgaccgacattccagataatttagtacatctgccgaggggggcaaccattgacttgctcctgttatgacctgtaagacactgtcgcgtgagaatgccacgacacggaatggccactcgcaaagctagatgttgatgtaggtcagatgtcctttaacgcgtggcaaaggggcactccgtgtacttgtactatatgaaactctgaggcagccacttaacacgatcaaagtcactgtattccgcaaggttctggaacaatctagattgagcaagatacacttatagattgcctggacagcaattcgaattcaacaccagggcgtcgtaattaatacataaccccgaagtggctcatacaaagtccgtggtggatccatcccttttgagacttttgtcccactccataggacgctcgttggccgtg

SEQ ID NO: 667893 - DNA, 238 bp, Homo sapiens
gctttggtgcctctgatggtcccggtgcgtggggggcgctcttcttgaatgactacttgctatgcctgggagtggctatggggtgctctttccaacagcccacgtggggtccactccttcgcccaccccctcacatacacctgcttccctgttttgccctattgggcgccccttcgtacggctgcttcacccattggaggatgtaccgtctagtttgcccgcacattcccgggatacc

SEQ ID NO: 667894 - DNA, 112 bp, Homo sapiens
ctctacatgcagactgctctaagaagcacataagtttttatctctcttgaaggcagcacttatacctgagaaggctcagatgtggagagagtgtgcacgggcaaacctcctt

SEQ ID NO: 667895 - DNA, 325 bp, Homo sapiens
tagctattctagagtatcccggtcggactatctagtaggggtcggaccatcttgtagtgaagaagcggtgaggataagaaagtggtgaatcccgctgtaagagcaaagtgactaagaattgtggcattggacaggacatccagtcccaaaagagacctcacccgctttgtgaaatggccccgctatatcaggttgcagcggactagagccatcctctataagcggctgaaagtgcctcctgcgattaaccagttcacccaggccctggaccgcccctcagctactctgctgctttagctggcccacatgtactgatcggccgagc

SEQ ID NO: 667896 - DNA, 222 bp, Homo sapiens
agctctgtaccccccgtactagcccgacagtccccgactagcccgacagcatctcagcaaacctcgcgcgggcggcgcgggcgcggggaagccccccaagcgcaagccttctaccgcaagctgcagaatttcctctacaatgtgctggagcggccgcgcggttgggcgttcatctaccaggcctacgtgttcctcctggttttctcctgtcgggctagtggg

SEQ ID NO: 667897 - DNA, 207 bp, Homo sapiens
tgacggagaggatacaggagctgactctatccggaaggggaactgttgagaagccgagttggctatatcactgggtgcaggtgatggtaggagccagtccagctgttggctgaaggggcaagggtgtctacctaggtatgcctggttgcctgccgtgtatacgtacgcccgtggctcggggtagttcatctagggtcctcgtggtgg

SEQ ID NO: 667898 - DNA, 159 bp, Homo sapiens
aagagtagacatgatttcttggcctctgactttcagtgatgacaatgcaaccatgcagtcccccgtttgcagagggcagttctcccaggctttctggaagcagggcttccgaggaggtctccaccacctaacagaacactcacttatgagccctgcaca

SEQ ID NO: 667899 - DNA, 116 bp, Homo sapiens
ccggagcgcggatggcaatggtcctctgcatcttcatcttggtcaccacgttagagaggatccgccctcgaatggacacatgaccagtgaaggggcatttcttgccaatgtaggtg

SEQ ID NO: 667900 - DNA, 152 bp, Homo sapiens
cggcagggtgcacgctgttagcaaggctgtgagagacgtatggcagcctgggcactgtcgctgcgttgcagccgtgagagtagctccctccgttttctatctgagctgttcctcctccagcctcacaggagcgacgacagctccagcgaaca

SEQ ID NO: 667901 - DNA, 863 bp, Homo sapiens
  misc_feature (47)..(47): n is a, c, g, or t
  misc_feature (93)..(93): n is a, c, g, or t
  misc_feature (103)..(104): n is a, c, g, or t
  misc_feature (131)..(131): n is a, c, g, or t
  misc_feature (221)..(221): n is a, c, g, or t
  misc_feature (223)..(223): n is a, c, g, or t
  misc_feature (227)..(227): n is a, c, g, or t
  misc_feature (232)..(233): n is a, c, g, or t
  misc_feature (242)..(242): n is a, c, g, or t
  misc_feature (248)..(248): n is a, c, g, or t
  misc_feature (290)..(290): n is a, c, g, or t
  misc_feature (302)..(302): n is a, c, g, or t
  misc_feature (318)..(318): n is a, c, g, or t
  misc_feature (350)..(350): n is a, c, g, or t
  misc_feature (428)..(428): n is a, c, g, or t
  misc_feature (458)..(458): n is a, c, g, or t
  misc_feature (608)..(608): n is a, c, g, or t
  misc_feature (672)..(672): n is a, c, g, or t
  misc_feature (678)..(678): n is a, c, g, or t
  misc_feature (696)..(696): n is a, c, g, or t
  misc_feature (735)..(735): n is a, c, g, or t
  misc_feature (801)..(801): n is a, c, g, or t
  misc_feature (803)..(803): n is a, c, g, or t
  misc_feature (850)..(850): n is a, c, g, or t
aacgcaacgatcaaaaacattaagatctacgacaggatgcgatattnggacaataagcattacaatgtcatttttgccaagccaaattttacntgatgttccnngaagcaaagggtaactagaatgcagangttctctcatcatcatcttcaatcagctgtcacagaattccccactactgaacctcccttacaattcttacttctccccacccctccagncntctnaaatnnaaaagaaangcaacnattctccctgagagaataccgcctccttcttctttcttttcnacagcaacctcnactgtcgacagaggtnccttaggattcaaagaacaattctgaagctgnaaacagaatagtctgtttttgaataaatcctaaaatattttcatttcacacccttgttccatgaggaaaaaatttacntagagaccaataggttttgttcaggcagtntgcaataataaagtttaggccaaattagatttataattagatattaaatgctgcgctttggtactatagtatagggataaaatgaacccatatccacatatgtacttatagacaccaaagcacagaacagaaaatctagctggcatccantgtatcttgactgtggctgcaatctctgttcccagaacagactgtaagcgccaaaaggtggggncatgtnttggtcagctttggattnctccaacaccttgcacagtgttcatgcaaagagccactnacagaaattgttgaattcacttaaaaaagaaacaattttggctgggtacagtggctcaagcctgtnancccagcattttgggaggctgaggtgggaggatggcttgaacccaggngtgcgagaccagc

SEQ ID NO: 667902 - DNA, 769 bp, Homo sapiens
  misc_feature (703)..(703): n is a, c, g, or t
atacttggcctgcctcttatcctggtactaagttgaagtaaagctcaccctttacttccctacttgaaagttctactctgagccttgactcttagccacagtgaggcatgttgaaggttcctgctggtttattcttttttttttttttatttttttttagacagagttctcactcgtgttggcccaggcttggagttgcaggggcacgatctcggttcacgtgcgaagcgtccgcctccggggttcacgccatgctccgttgcctcggcctcccaagatagcggggactacgggcaccggtgccaccagcgccggggctaatttttggtatttgtaagtagagagcggggtttcacgggtgtttagcataggagtggtctcgatctccgtgacctggtgtggggtccgcccacctcagcctcccaaaggtgcggggacttacaggcgtgagccaccgcaccgggcctcacatgcactttcttgtaaagtgcctccaagttgattattctcctagctccatatctcctgagtgtgcatgagggagcacggggtcaaataatggggggctgaaaaggtatcaagggtgaggtcagttttccccaggagtcctaaaaaattcgggtaccttacatggagggtgtgggagaagggtgtcatagttctgaaaataggcagttagttgaggccccagacctgtgtcatnccttataaatgtctatctccagttgacagagttgaaaaatgtgggtggaacattggatattcatgg

SEQ ID NO: 667903 - DNA, 767 bp, Homo sapiens
ccagcgtttaccccaaagcacaatgccctggtcacttggcaagcggctgggcctgacagaggccgaggggcagaccggggctccagccagacccctgaaaggaagcaggtgctcccccagcttccaggccttagttggggtgggggggccagcgtccatgggcctggggtcttctcaccgccgcaccgccgcttgtcctggggtaggccccgtgccttgcccctctctgccttttcctcgggtgtcccatccatcgagcccctgtggcattggcttgggtggcagagcccgacttgtatcagggaccccaggaggtgcccccgtggctcccagagacatgagtgatgaggtccaggaggggtgagagggggtggggagaagggtcgggcagaggggatgcaaggggaggaaactccgtcaccaggacgagccaagagaacagggatagagccataagacccaaggaggaaagacccgtgagaaacaacacatgaacacagtcaaagtgaaacacagacaaagcacagataaaaacagaggagagccaagaaaggcaaaaagcacatacggctaaccaaccacaaaaaacaagaaacaagaaaaaacacacacgaaaccacaggcgagggcacgaggcgaaaccacaaaacgaaaaccgcgacgaacaaacaaaaaaaacaaaaacaaaacaacaacgcagagcaggcaacccaaacagcaaaaaacgccaccgcgacaagagaacaaaaggacaccacaaagaaaca

SEQ ID NO: 667904 - DNA, 182 bp, Homo sapiens
acagcagactgcatcattgaccgcacagcgccatctctccctgagaataaaaccgatagccaacctccatccggctccgagacctgcttctgccacacctcgactctcagaatctctccacattatccatagagaccgtgtggtaatagtacacccgggccccccgtcttcctccctgtccc

SEQ ID NO: 667905 - DNA, 278 bp, Homo sapiens
  misc_feature (3)..(3): n is a, c, g, or t
aangtcggagtgcccaccacacacacacaaaaacagaatagccaaaactatcctaagcaaaaagaacaaaactgaagaaatcacattacctcaaattatactacagagcaatagtaaccaaagcagcatggcactggcatagaaacagacacacagaccaaaggaacagaatagagaacccagaaacaaatccatacatctaaagtgaactcattttcgacaaaggtgccaagaacatgcaacagggaaagggcagtctgttcagtaaataaagctca

SEQ ID NO: 667906 - DNA, 255 bp, Homo sapiens
aaaacataaaaatcatcaaaagatatttcttcgaagaataacaaaaaagcaaacacatcccgagtcttgtgcgaagctttttatagaggttgaatcggcccccccttatgttatgatactcttattaacatgctgcacgctcccaaagaccttgggactcttaggaccaaggggggccagtctcagagcctcccaatggatacaaataatatgcacctaatgtagcctgaacaggggcttttttttttttttttt

SEQ ID NO: 667907 - DNA, 1011 bp, Homo sapiens
  misc_feature (285)..(285): n is a, c, g, or t
  misc_feature (371)..(371): n is a, c, g, or t
gacgttccgaaatgggacctcggaaaggggaaggaaaagaacggaagaacaggtcatcaaccttcggaactcatgtggcttgaatgagagaatgtattttggtgtcttggcactatcttttggattcctttcaattgacacctttttggtccatagtccaattggatcctttccttggccaacagcaaacccatctttggccggtggtgacattggcttgggcatagcaaaggttcacaaggcgcagacccgcagcatatgaattcctctcaaccattattggtngcgttatagtttggcgttggcccagagcatagtgtgggcccaagagagttgcccaagggagcgttggtgtcatctcaaccgggcgntaacaaccatctcaaacatcccgaggggccaccagggacaggaacatcagagacaccaaagcaaccccgtgtgcaaccttgggggcgcccagagccggagccctccagcagagcctgtgagcccgcgtccggaggcatagaagcaaccgggccggcattggaagcatgtccaccccccgattcccctcttggaccaggcactcgcgccaggaaagggggggtcggcggtgggtcccgcggtctgggtgaacccaagaattccctccaaaactatttttcctggtttacttaacttgggccttctctggttacaacataccacaacatcactacaacaccaacactaacagaaaacaaactaacacacatatcaacactacaagcatcaacaactgtgacattacaccacactaaacacctagcaccagaacaaccccagaggggccggataacaaatggcccaaatgagcgcacaccaaacagtggcgccggtaacaacatggaagtggaaccccgcgtgcccagtatcgccctgaaaaatcccttttcccaggcgtaacgacccacggcgcccccaatgcgcactcagtgcgacgcagacggtaacccgacgagacagcctcaatccgccggcccctcg

SEQ ID NO: 667908 - DNA, 230 bp, Homo sapiens
cgagcaggaggatcccggaaggacagaggccatcccgcacgagccttcacaggacttctggagtccagggcagtcgtatctatcaagcagcggttagtggggatacaacatggtccaccggatcaagataatggggcaggagccaggcttagtggagactggacctttgactggctcttgcgctaagacttatatcttgacctttaactgaaacttgtccttaggccgaa

SEQ ID NO: 667909 - DNA, 628 bp, Homo sapiens
  misc_feature (628)..(628): n is a, c, g, or t
gggattttcaacttttaacatcaggactaagttattttattattagtttttctcccaaaatactggctttcaaatcactgtagctatgaaaacttgttatccctttgattcctttattacatttaacatcaaattttcctaattagaaatatatccttaaaatatagtcaagcagtgactgcttattttgaatgaaacaaattaaatgtagacaagcagggtgattgtatatagagggttttttcctttatgtttggtttagctttttcggtctatgagttgcccaaaattgaagtttatgttgcaggttccggtgtggtgaggacctacagtgtcaggttcttacaaagtaaatattgacaaaaggcaaatactgggcagttcaatcttgcatgatacctatggccatattacccaaaatatcatgacttggtttatctcaaaagctaagcaggattctgagatactaccaataatgtactactatttctaaaggagtaatttagtaattttgtaaagaaattcacaaacatggaatgacactgtgaattcctgtgaaaaagcagatatccattgcttagtatctaaaatatttcgcaacaattcactgatagctcaagtatgtgan

SEQ ID NO: 667910 - DNA, 320 bp, Homo sapiens
ctgatatttgacagtccgctgacgtagatagaggtggctctggcgtcctgcaggctgtaccccacgcaggcgatgttgatgcccctttctcgcttcctgtgctgtgtctccccagcaggacacaccgtcccccactcaccctctaaagccctggcatgtcctctgcccccatccccaccctggttggctgcctacctttcttccccaacctgatggctttgggctgaaatattcaagaaggaagcatggagactgggaaggagggagagagagaagttcactggctgttccaatgtctgggtggctgtattgcattgaac

SEQ ID NO: 667911 - DNA, 850 bp, Homo sapiens
gccttttttttttgtttttataagattattagtataaagggggagataggtaggagtagcgtggtaagggcgatgagtgtggggaggaatggggtgggtttggtatgtcaaagtggcatttaattttaacgtgtagatatggggagtagtgtgattgaggtggagtagattaggcgtaggtagaagtagaggtcacagggagggtgataggtggctatgatggtggggatgatgaggctatggtttttggtgaattcttcgataagggcccattggggccaaaagccggttacgcgggggaggcctcctagggagaggagggtggctggaataaagggtgtaagtcatgtcagctctgtttcaggtgcgagatagatagtagggctcgtggtgctgggagttcacgtggagtagtaggaatggggcagtagttacggataactataaactagttaaacttaaagaagtggtatatgtaagggttgtcccggtacaaactgggtattataatacctgtggtggggtaactagaggggtatgccacagacttttggcgtagctgggtttgggttaataagttccacacatgaaaagtgggcttggcgtaatgattgggaataacaatttgcgaagcagtgtgagaaagaaaagggaatagcgttctcacgtgaggggacgacacttgcgaaatatggagttgccattgggcgccatgatttgccatgtgtgaaaaacaggcgggaatgtaaaaagggtgtgctgagtaaacctaggggcccaaaagtgtagaagggacttgccaatttaatgtacaacaaagtgattgcaacatatattggcaaatggtatg

SEQ ID NO: 667912 - DNA, 257 bp, Homo sapiens
  misc_feature (244)..(244): n is a, c, g, or t
atgtagacatctgagttttaatccccgtactaagccatctaagcatgaatcatctgttgaactgactgttctttaccgaattatatctcattttcagttacaaacttcagctacacttgtaccaatataaaaagtatcatcagtatagcccaataattaagaaattggattctggaattaggttgcctgggttcaaattccagctctatcacttcctagctatgtgctatagactgaatgtgtncacacccaaaatt

SEQ ID NO: 667913 - DNA, 174 bp, Homo sapiens
ctttgggccccccgggttttcccttttaggtttcgggttggttttttggggggatttgtgaggggttaccattttcccccgggaaccagttttgccttgtttcggattttattccgcccccttttggggatttggcccctcgggcccaagatttgggcccgggccctggtccca

SEQ ID NO: 667914 - DNA, 163 bp, Homo sapiens
  misc_feature (51)..(51): n is a, c, g, or t
  misc_feature (57)..(57): n is a, c, g, or t
  misc_feature (59)..(59): n is a, c, g, or t
  misc_feature (76)..(76): n is a, c, g, or t
  misc_feature (78)..(79): n is a, c, g, or t
  misc_feature (83)..(83): n is a, c, g, or t
tctagaggatcccgagctctctcgtgtgggggtgcggactcatctctggtncgtgcnancagacctcttactggtncnnggtnggatgccattttctcacactctttccttatcatgcctcatggccccacccccattctaggcggagaacttttagccagag

SEQ ID NO: 667915 - DNA, 380 bp, Homo sapiens
cacttagcctcgacagttatgcctccctcggcttggcaggcccttcccgtcccttatccattatgcaattaaattttctatgcttcaaggcagcactttgccgacaacttcccccggggtgccgaggagctcgctcattattatgaagatgagcaatacagaatctacacattgatccagcctttccatccgagccaaatagttgacaatgggaaatatcttcacgactagagaaccttcggctaacaagtgcagaatgaatgatacaaaagcactacttggcagtcccctaatgagaagtggatctcagcaccaatcattagtgtacagaattttatcatgggtgccctatctggtggattaagtttaacaccagtaaa

SEQ ID NO: 667916 - DNA, 189 bp, Homo sapiens
cagggccaaaaaaagggaatgtttttttttaaaaaaattcattttcatgggggtcccctcccttttttgtgaaagtcctcaaaatgaaaaatttgtattttttatattaaatcccttactattgatttttgttgtgtttttaaaagggggtttcccccaaataaaattttggtttttgcccaaaacata

SEQ ID NO: 667917 - DNA, 596 bp, Homo sapiens
gagagagagagagagagagagagagagagagagagagagagagagagagagagagagagagagagagagagagagagctagagagtgcgagcgagatagagactgtcagagcgagaccttgttttttatactctcttaagagccgtcactgcggcacattgtgttctattctctattcgcatacttatctcggttcttatccttcacatacctctgtttctccttagccacatgcttgtcctggtgataccacgttttacacataggcctccaaattttgcctgtcttgaatgctctacatattttttagctacttatgcctctattccattttacttttatttcttgtctcctcctgtacattggcctttctacattgctattttatcactggcaccttttgttcttttttttaggtctgtgttttaaagtttaccttttgtctctaattggatgccattttgaccttctttctatgtatgttctttttttccattccgtctatcatttttttttttcctccctgtttagcttttcttttttgcatttttcgtatgcttttccgacctgcttattttacttagcttatcgctttt

SEQ ID NO: 667918 - DNA, 115 bp, Homo sapiens
atcacccctccgtgagaacacaagaaagggatcacactgccagagaaaccctatgcttgtacagaatgtggaaaaaacattatttaccattcaagcatacaaagacacatggtat

SEQ ID NO: 667919 - DNA, 379 bp, Homo sapiens
ccggctgtaggcagatcccatcatttgaacgtatggtgacatcaaaaaatataagcaattttgttttactttctgaacaaattcaacaagcaaattcaacgtgcctcacacggggctacagagatgagacatagtcccttctttcatgaagttaggaataattaattgtgtttgactgaggttagctggtataatagagattgtgtgggatcagaggaaaaggtgatcagaatttgtgttatgcaactattttagatgagctgtgaggaaatccctgctagagatttgctactctgtgctttccacaaatagctgacatagccagtttggaaataaatactttggtgatttattttattttactttatttcattttgag

SEQ ID NO: 667920 - DNA, 477 bp, Homo sapiens
tattttcacaggtgctggagctttgtccatgttcatccattgtttcctcagtggccagccatgactggcgctcgctggttcagtagtgttgagtaatggcgatcgtgtgctcctgtatccagcatcctgcttgtcgtgctttatatcctagatcatggcgcctctgtgtggattagagttagctttgcccaatggccgtatcgtacatgtgactgctgcctgtgttcttaatgacaggcagggtttgggatcccacaggttcactttgtaaaccattttcgtgtcttgcgtctcctgctattcttggtgagttcttgtcttcagtttgactgaaatttcttttgctgcacttgatagcatctgtctctggtcttctctgagtacacgcaaagtggctagtccctgttctctttgtaacaactcactgggcctcagaactggctcacagtctgactgtttcttgccctgtggacaagt

SEQ ID NO: 667921 - DNA, 257 bp, Homo sapiens
atactgtcctccgtgttctctgtgctcacgctagggtgggccctcgggtcttcctctgcgtaggtcagcttctgagtgagctctgtcatctttacatgaagtctccgaccacgtgggcctgtggatctggcctatcaaaagcgatcacgtgaagctgggcgctgtggcttatgcctataatcccagccctttgagaccaggggttcaaagccagcctgggcagcatagcaagatcctataaacaaaaaaaaagagtt

SEQ ID NO: 667922 - DNA, 901 bp, Homo sapiens
gaaatggtggatggacgccggtgctgtcggggtggtcctggggttccctggtgggcctgggatggggaaccgcggtggcttccgcggaggtttcgtgcattggcatccggggcctggggtcgcgcgcttgtgtgacggggcgcggggcctgagggccgcgttgagctctgcggagtgcgaggttcggatggataaggagtggatgcccgtcaccaagattgtgcctgcttggtcaaggacatgaagatcaagtccctggaggagactctatctcttctccctggccgttttaacggaatctactagatcatggatattcttcctgtgtggcctctctcaaggatgaggtttcgaagattatgccagttgcaataagcagatccgtgccggccagcgcaccaggttcaaggcattagttgctatcgaggactacaatggacaatgtcggctcatgggtgttaagtgctccagagggagggtgtacaccgactatccgtggggacatcgatcctggcaatgctctccatcgtccccgtgtcggcagaggctactgttgggaacaagatcggtaatccccactactgtcccttgacaaggtgacagggccgttgctggctctgtgcttggtacggcctcatcccctgcagccagggcactggcatctgtctccgcaacttgtgcctaaagaaagctgctcatgattggctgtatctgatgactgtaacactcagccgggctgactgcacctgggcaaattcgccaaagacaactttgattgcatttctaagaactacagtaactcaaccccgacctctgaaagaatgtttcaccaaggtctccctattcggagagttcttggcaccttctaaaacaaaccagaagtcccgtgaagagatccaag

SEQ ID NO: 667923 - DNA, 291 bp, Homo sapiens
gactaagggaagctgcggaaggatgatccactcacaaatctgaatacggctttagacgtgacagagaagtacctggtacatccccacagatgctggtatgccgtaagacatcgtgtggaatctgcccgtaccggcatgagtacagccatacatgagcttacgctgtctagacttctaccagcgcctatctctgtgagcccagcaaggcggagtacagctagccaactcgcactctgcgacggtgttggcccgtcaaccacggagaacgcagcagcattatggcaagactac

SEQ ID NO: 667924 - DNA, 144 bp, Homo sapiens
tgggctgggaagatgggcagtgtagctcagagggtccaggcttggggggctctcagacagtctgggtttcatctctccaggaatgacgatgaagcctctgtgtgtgcaatgcgctgacctcatcggcaagctgagtcaccccac

SEQ ID NO: 667925 - DNA, 114 bp, Homo sapiens
  misc_feature (3)..(3): n is a, c, g, or t
  misc_feature (52)..(52): n is a, c, g, or t
  misc_feature (54)..(54): n is a, c, g, or t
  misc_feature (78)..(79): n is a, c, g, or t
atnggcacccaggtttttgaaccttggtcctgtgaaatgcttagaactatgnanatcttgttattcttttatctaccnnttgggcttttaaaaaataatttcattctcagatca

SEQ ID NO: 667926 - DNA, 118 bp, Homo sapiens
gtgttagcacagaggaggtggacagcacaaggaggttcggctggagcagcagagcgtgccagccgcaggtttgggagcctgaaggaagactgacccgtccctccccccctcctctgtg

SEQ ID NO: 667927 - DNA, 943 bp, Homo sapiens
gttgtgaggtaggtgcatcgacgagagaaaaagggcgcggttatactggtgttcagatggcaaaacctgtcgaccgcgacgttgtagcgcgcaacaacgtgtgggcaacgcttatccgggtgcctgtgcccgtcaacggtggtggttggcaggcaagaaggaaccggtggggcctataaaaaatgttctgcatcagtgtttcagacagggaaagtttaaatagacacattgcttttaatgtcgaacacccggatctgtcacgtgggatagcccgcccagacggaaaatgtttttgaaaggtgcgtaaacagatggcgagcacctatgtgttttgacgaggctgggcaccggagaaatttttgataccgtgaaaatgtgggttgccacgcactaatagaagaagttctcttggcgaggttttatttacacgttgctagttgttcgtgaattgtattgccgctgcgtctataggatgtggtagccccgctaaggttaaaaagtgtgtttcgtaagtaggcgtgtaataaccggccagcaccgtgtgccatggtagcgcttattggtaaatggggaggggaattatccccccgcgggtctatatttttttttggcgttaatttaaaatttctcgagaccccccggcccatatataggttatcctactccattagtagccacggtgtgcacaacgaccaaatataaggaagagccttttataatcccccgataaaaatttaatgaaatgttggtgatacgtctttaaatgttcctgtatttaaataattgtaatctcctttttttaaagtcccccacaaaacgttgattttgtagccttctatgttttgccatgagtattttctcctatattttttaatttgtattgagatggaaatttatttttttttgaaatttaaatttccccctttttttgaacccaaaaaaa

SEQ ID NO: 667928 - DNA, 160 bp, Homo sapiens
  misc_feature (105)..(105): n is a, c, g, or t
cgaggtcgggtccttggtatcaggatcccacgatcattgtcttgtgatatgtgtccaagtcgcgctagtaagtagtcagacgttttaaaccatatctctgatagnacatataactattaactataaaccctgagagtcagtgctttctgatagcggaact

SEQ ID NO: 667929 - DNA, 96 bp, Homo sapiens
  misc_feature (39)..(39): n is a, c, g, or t
gagtgtcaggatggccgagtggtctaaggcgccagactnaagttctggtctccggatggagcgtgggttcgaatcccacttctgacacgttccttt

SEQ ID NO: 667930 - DNA, 255 bp, Homo sapiens
aagtatattggatactagtcgtgcatatgtttttttaaaacagagagaaccttgaccacctctaccttacaacttcaacaaacgttatttcaaaatgggatcatagacctaaatcccaacctcaaaattaattcgagggaaacatagcagacaatctctcgtgagcttagattaggaaaaaagtttcttagatatagcttctatatccatgaagcataaacacaaacatatgcttaaactagatttcataaaatt

SEQ ID NO: 667931 - DNA, 326 bp, Homo sapiens
acttcggtcagaccatatacacgctgttgccatatctggattccttgatgcaaacggcccacacggagggagtcactgcagtgcgcgctctgctccatgagcttgtgtcacaccaggtgacatgggacatagacagtcagctcctgctgctcccagccttcctgggcagccctgtcctggagcgcattgccagaaatgacactgcatatttccctagagcccgatgctacgattactacacgggtgtggatattaatgcaagaggcgagagcaagaccttgccagccactcttgaccacattaatcttcatgtctcggggggctac

SEQ ID NO: 667932 - DNA, 298 bp, Homo sapiens
ctgtcaatcaacctcagtgcaatgtaatgtacaggaatggaatggaatggagtagaatgaacacgagtggaatggaatggtatggaatgaaacggaatggaatggaatggaatgcaatggaatcaatccgactggactggaatggaatggaatgcaatggaatggaatgaaatggagtcaaaccgactggaatggaatggaatggatggaatggaatggaatggagtggaatggactggaacgaaatggaatagaatggaatggaatgcaatggaatggattgaacagcggaccctaa

SEQ ID NO: 667933 - DNA, 1126 bp, Homo sapiens
agaactgggaggaggagttggatgtgcctggatgggagcccgcgctcggtgtgcggctgtgctggagtggcagctgcacctgagttccctgcgaggatcatgacctgactggggccccggagccgcgctgcctctcgggtgtctgggtctggtggtggagcccagtgctcgcatgtgcctgtgctgtgtgctgtggtgcctgtgatgtgtgcattgcagtcttccctcgctgtgatgagatgtgaagtgctggagtgagctgtggaacctgctggctgtgctgctctgctgctgtgctgccatagctgtgtggtgggaatgtggcatgttcctgtggcctgtgtgcctgctgccatcaggcagtggtctggctgtgcttcccagcgcgagtctcagtgggcccgtgtgtggctgtgctgtgccgacgttgtgatggaaagtcaagtttgttgcgtgtacggtgattgcccggagtgaggcggtggtgtgacctgggtgtcctcttgcaccgttagggaaggcaaacttcgccacgcatggcctgcaagatgggctgctcgtcgctgtgcctgaggatgtgcttcagtttcgggtttctggctgggcgtgctgtgcggggcggttgtttgggcttgatgtgtggacccctgggacgagccttgagattgccgccctgtggcccccgtgcttcctcctgactgcggattggggggacagtggtttgctaatcgcagaaaaatctttcgcggagacaacgtgaaacattgcgtgattcccttcattgtttgcgggccatggacgtcgtggccctgtggagagtaacagaccaatttccttgttacataagttttgcaaggcttggggcccgaagtcggggggacccgaagccaattttcgcccaagctttggttcggggggtatactgcaagaccggattgggcaacgacctgggcgttggaccgtttactagaataacatttgttcgaacgagttgccaaagcctggtaattaggcggacgttcgttcgacggccgggcgccataggggaaccaacgaattccgcgggagccaggcatactttaggcggcggccaatttaacgttacagcgtttggtggacgcaaaac

SEQ ID NO: 667934 - DNA, 567 bp, Homo sapiens
acgaaaaaagagagcacgaggagccgccatgggaaagccaaagcgcaaaagggagccccatggatagcagggacgagggaaaagagcgggaggagaggaaagggagcagaaggggagagggaagggaaggagaaaagagagaagaggaaggaggcgaaggggggaaagaaaaaggaaaaaggggaggaagaaggggacaaagaggaagaaaggaagagcacaagaagaagagaagagaaaaggaaaggaaagaaaaagggaaggaagaggagaaagagagaaaagaagggaaaaaagggagaagaaaggaaaaagaagaaggggaggagagaaaaagggaaggagagaagacgagaagaggaagaaaaagaagagaaaggaaaaagaaggaaaggcgaagaaaggaggaaagggaggagaggaggaaggaaggggggccaaaagagggaaaagacgggaaagaagagaagaaggaaagggaggggaaaggagaaaggagaggaggggaagggagaagaagaaggcggagagggaaagcaggaagaggagaagaaagggggaagacgg

SEQ ID NO: 667935 - DNA, 191 bp, Homo sapiens
gaacgagttgtcaggtactgatggaatttagttaggacattcagaccttaaatgccaaatttggttaaaatatctcgatgcagtcttattggccacctacattgtttgacatatacgtatgaacagttagaattgcagcctgcaggaatgccctgcattgttttcttttaattagaaataaaaaaaaaaaa

SEQ ID NO: 667936 - DNA, 511 bp, Homo sapiens
agcggacgaaatcggaggcacaatttcatcctcatctgttactatctcggcataattctcgtaaaaacacacgagctctccctgctgatcgtgtctgattaatctcccaaacctcaatcccttacaaaacaacaaactcctttccttcctaggcatggttaatgcagtcagaattcttacacaagagccaggaccgcaccctgtagcctttctgtccaaacaacttgaccttactgttttagcctagccctcatgtctgcgtgcagcggctgccgctgctttaatacttttagaggcctttcctacaaggtctgagaaggccaccgtagtcatttcttcccttctgtcagacataattcctcagtttagccttcccacctctatacagtctgataacagaccagcctttattagtcaaatcagccaagcattttttcaggctcttagtattcagtgacagactaatggtctattaaaaacacacctcaccaagctcagccaccaacttaaa

SEQ ID NO: 667937 - DNA, 397 bp, Homo sapiens
tatagggattaggagttgaaaacaccatcccggaagaggaagaggagactggacgtgagaacgagactgaagggccaaacccgatcccctacttagcggcagtagccaaatacgtctgcatcatcagctcgaaagtctccatagcgccacaggttcagcctggcgctctaggctgactctagggcattcaggtattctgtgatcactttctggaactgtttctccttgcgcacctccaccatgaccagcccttccttcaccaagcccagccccacatcgcccttggaatctgcaaactgcagggtgacatgggggcagccggcactcaggtgttccacgttgagcaggcactgagtgttctggatatcccgaactacgctgtccacggcgtccgtgc

SEQ ID NO: 667938 - DNA, 181 bp, Homo sapiens
acctaaataatttatcataatcccttaccttctctctcctgtaaaatgaactgtttctgagctacaacttcatagttcatactatgtattttagacagcacattttcaaggcagagtattttagacactaattaggacaacacatcatattattgcgccaatgtttgccatttctaaatgt

SEQ ID NO: 667939 - DNA, 172 bp, Homo sapiens
tctagaggatccgacgctactctctgttggggcgctctctctggggactaccccgacctccggtctacgccttacgccctactcccgccctgtcgtgcttggtcccctactgccggactttgctccccgcgtgctccccacttctgctctcactccctgtggcccaccgcgt

SEQ ID NO: 667940 - DNA, 223 bp, Homo sapiens
actcgtatgcagtatgggtgggtctaacatatttggaagacttaaaaagctaatagtttccaatgcactcaaattatttatttacaatctaggagtctctctgagctcagagttctgaaatcgttgtcacatgtaatcttttgtgatactgtaccacgttcggctgttaagtgctttgatagctcacgggggcagtgtcaaggtcagggagaaggcattcgtg

SEQ ID NO: 667941 - DNA, 1389 bp, Homo sapiens
gagggacatccctgagggaagggccgggagcaggagcgccccagcgtgcggcgggcgggcggtgcgagcggacgatgcggcgcggagccggccacgaggctgcagctgccagagggagcccccgtccaccggattcgctggagggcaccgccaagaaggcctctgcagagggtgggcagcatcccgggaccatgccatgagcctctccaggacgccaccgccccgcagtgagctttgaacctgccccaggacggtgaaccaaaagaacaggacctcgaggcgacggctgccgccgccagcctggtcccagggggaccctggcaccagcacccggtgggggactcggcgcggcactacagcgctgccgagttgatgccgtcccggcccggggggaacggggacaggacacccgggcgactcaaaggggctgcggcccaactcaaagaacaagccgtggaaattacggcggccccgtatccgagaggtcgcaggacgccaggcgactgcgagcccaagtgaggccggccagtaccccggcggaaagcccgggcagcccatggcgacaacggcccgaccatttggcgcccaacgaacaacaacgggtgaaccccgggggccctgcgcagggacccgcctattgccagcagtcccctggatactgacggaaccccctggcgcatggaccctctcaccgggaacgacttccaacccagtggagctgaacttcgggcagagaaccaagcggggacgcaaaccgggaccactgtggggcacaacaggccttcccgcgtgaacacgcacatctggcaaggaaaccgccgtacaggcgcgaacaggagaacaccggggccattccacagaggatcagccactccggaaggactcagcgcaacgaaattggcgtgcaaccgcggggtgcccatgacagggcggccaatcaccccaaaacagacctcggcacgaggaccatctaagtgcaacaccgaacagacacgacacacagtggccaccggccccagcggacagcaacgccacggaggcgcagcgggcaggacaccagacggcacagcggaccagcttgggccgcgacgcaccctagcgaacagagacagtccagccgtggggcaacaacgtcagcgcgggatcactacggcaggcagactcggagcgcgacaggcacacggaccagcccagcgtggcaccgacactggacacgtcgcggagccaccgggctgagcagtgggacacccatcggtgggtggaccaaccacgagagaagccacccacgcagaagcgtgacaccacgtcactagagaaccactaggagcggaatgaggagccaaaacacaccggcgccagaacacagggccgccccacagagcccccacg

SEQ ID NO: 667942 - DNA, 320 bp, Homo sapiens
aactcccattcaaagaaagattttaaattgaggtaattttttgactaagccttaagttatggggaagaagaaatagtattttcaaggaacaaaaatgagaaagggcctgaggtgtcagggatagactccaagctcactatgtcaacatggtgattatgggctttggacagagatgggggatgatgctgggttgtggaaagagactttaaatggaattgggatctatatcaggaagggtctttatgttaacattaagaagtttgggcttcatcttttgagcaacgtgtagacagtgcataagcctgaggggagcatgagca

SEQ ID NO: 667943 - DNA, 203 bp, Homo sapiens
gggcccccccctttttttttttcccagggcaaacaaaagttaggtttattttggggtcacccatgcccccctgaaggggcctgttttcatcaaaagttatgtttttgccaaactggagtttgttaagtgtgcaaaaacattgtgtttaaaaaaaacagtgggcatcccttaattaaaaaaaacttttttgttaaaaaatgcca

SEQ ID NO: 667944 - DNA, 188 bp, Homo sapiens
  misc_feature (61)..(61): n is a, c, g, or t
  misc_feature (90)..(90): n is a, c, g, or t
  misc_feature (93)..(93): n is a, c, g, or t
  misc_feature (109)..(109): n is a, c, g, or t
  misc_feature (130)..(130): n is a, c, g, or t
  misc_feature (137)..(137): n is a, c, g, or t
ccgggaccgcttggagcccgggaccccttgcacatcaaactttcctttcgacttatagtcngcaacatccttctcatacttctccttcanctntgccgccttaatgatntaaggctgcttttcactgtcntttaaantatgccacatctcagccagcttttttgccacgtctccaaaggcggtcccgg

SEQ ID NO: 667945 - DNA, 328 bp, Homo sapiens
  misc_feature (21)..(21): n is a, c, g, or t
  misc_feature (29)..(29): n is a, c, g, or t
  misc_feature (156)..(156): n is a, c, g, or t
  misc_feature (228)..(228): n is a, c, g, or t
  misc_feature (292)..(292): n is a, c, g, or t
tgaaaaagccacagcaaaagnctgtaggnaattaggcacatggcacatagctcagtttctcaggtttaaagtgccccagttctgtcttggtactcagggtgatactactatagaagaaattggtaaaatccattcacataaatgcattggtcattncctacttgtctcctccactgttacataagatttatggaggctgagattttgtctatttgttggatcccaggntatcccttagaagcatggtcaggcatcattaatctttgttaaataaatttaaaaaaagaatgantagcttctcccggagtcgggtgacttccctcatatt

SEQ ID NO: 667946 - DNA, 222 bp, Homo sapiens
ggctaagtaacaggaacaacaccacatgcctcctattataatgcactgaggcggacaccatatcgcttccaggagtatctcaccaaaaattggcaacctaaatttaatcatgaagaatcaccagaccaggccgggcacggtgactcactccttgagaggctaaggcggacaaatcacttgaggtcaaggagtatagagatcagcctggacaacatgttgaaa

SEQ ID NO: 667947 - DNA, 890 bp, Homo sapiens
  misc_feature (576)..(576): n is a, c, g, or t
ctggagtgcaatggagcaatctcggctcactgcaacctccacctcctgggttcaagtgattctcctgcctcagcctcctgagtagctgggattacaggcatacaccaccacacccagctagtttttgtattattagtagacacgggggtttctccatgttggccaggctggtctcaaactcctgacctcgtgatacgcccgcctcagcctcccaaagtgctgggattacaggcgcgagccaccatgcccggccagtgtcctttcttatacacgtacatacatgatgatggcttgagtcagctgcagggcagtgggcttaatgagagggatctttgtaaagacagctcttcacttcagctcagtagctttggtcataggcaagtttgttttccattatcataatttgatgattcttgtgatgaattcaatgctagttcttaaagaactcttttatttctgtatgtggagctaatgtttaccttggaaattttgcaaaatacatgtaagaaagaaataaaatatattttgaaaataaaaaaaaaaaaaaaaaaaaaaaaaaaaaaaacaaaaaaaaanaaccaaaaaaacaaaaaaaaagaacaccagcaggagaaaaggacagaaaagaaagaacaaaaacaaaggcacacaccagagagcaaccagagcagcgaaacggcagcaacaggcgaccacacaagcacagagcacgaacaataacacaacagaagagcggggagagcacgcacagagcaacgaaccacctgcgcgacagcggcgggacagacaagatacacacacgcgacatcatctggagaaaaaccaccaaaccacagagagcaggcaaacactacgacgcgagccgaccgaaggcgagacacccccacgtg

SEQ ID NO: 667948 - DNA, 659 bp, Homo sapiens
aagcatggtatcaacgcagagtggccattacgggggctatgtggctgattgaagagtatgcaatgagcgattaggtctgaggtcgagcagatgactctgggcaataacgaagcgcacacgacaaaacagtaagacaaagaacacacagacaagacagcccgcataaggaaaagcccaagagacaagcaaaaaacgcccacaagaacagcgaaagccgcaccacacaacgccacaaacagaggcgcaagcagacggaaagcaaacggagcagtataaaagcatacggcgtacaacacggaacataacaggcaatcacagagagaacaaggagacagcaggctagagaagcacaagagaaaagaacgacagaaaagacacaacgagcgacacggagagagcaagcagagcctgaaacacagagatgagacacaacaaaagaggagagacagagcaaaggaaacagaaaaaagaacagtagcacgcgaggcgcaggcagaatggacgccacagcgcgaatacctacgcagaggcagagcagacaaacacagagcatagcgagagaaagaggagcacacggagagacgcgacacgagcaagacagaaaagaggactagaagaagacagagagacaaggcagagaaacaagagaagcgcagcaa

SEQ ID NO: 667949 - DNA, 529 bp, Homo sapiens
ctggagtgcaatggagcaatctcggctcactgcaacctccacctcctgggttcaagtgattctcctgcctcagcctcctgagtagctgggattacaggcatacaccaccacacccagctagtttttgtattattagtagacacgggggtttctccatgttggccaggctggtctcaaactcctgacctcgtgatacgcccgcctcagcctcccaaagtgctgggattacaggcgcgagccaccatgcccggccagtgtcctttcttatacacgtacatacatgatgatggcttgagtcagctgcagggcagtgggcttaatgagagggatctttgtaaagacagctcttcacttcagctcagtagctttggtcataggcaagtttgttttccattatcataatttgatgattcttgtgatgaattcaatgctagttcttaaagaactcttttatttctgtatgtggagctaatgtttaccttggaaattttgcaaaatacatgtaagaaagaaataaaatatattttga

SEQ ID NO: 667950 - DNA, 129 bp, Homo sapiens
caggggtttgggaaatccaactttttccacagtgtgagtgcacgtgtgaagccccctcatttttccgctagggataaagcaaatgtggatgccctttaaaagatattaaatgcttttattttcaatatt

SEQ ID NO: 667951 - DNA, 1219 bp, Homo sapiens
ctctgaaccaggtggcggagacgcgctactgcgtggaccagaacctgctcaaggagtacttgccccgtgcaggtggtcacgcacaggtgctgctgggcatctaccagtgatgctccatgtgtggctggccattccaccacgcaggagttgctgccagtgcctggcatgatggactgtgctggctctacacctgcgatgggacgctggcctcgtggggagtgtggtcagtgaaagttctacctggacctgtacccgcgggaaggaaatgtacaggtgcacgctggactgcttatggcctgcaagccctggcatgaccttgcaggcaaggatgagtgatgccgccagatacgcacatctgctggccatggtaggcacaaacatatcaccaaggcccaacaaggactgacatgcgcccgacgcttgcatgacagagattgacggacggtggcagaccctacattccacatgagttacggaccacgtgactgcacccatgctcatgctacccaggacggacgatatcgcccattgttcaggacgaggacaccacacagtgagaagccgggacttatgttgggcaggcgccgggaacggcaggaaatgctgggaagacaaactgggggtaggtaggagacaggcagggaagaccatgcatagcatggcagggactggtacaccagggcaacatacccaggaacaagggcacgacgcacaggggacccacggggaaagccaccaatgggacccaaacgcatccactcagaggtcaccgagagaagagggcccaaaaacgcaaggggcactcatagcaaacccgtggtcgaccaagaactcagaacagacggcccaaaggggaggacccaagggacccaggcaacaacggcacgcaccggaaacgccagacgccccgacacgaaggacagaacgtgagcggcgatcatggacaacgagaggaatccatcgaggaatccccggaaaccagaccaaagaaaaccaaaccaccagacagaaaacaccatcacaagcgccatccttgaaaagagtaggaaaaacgaacaggcacccagaacacaacagcgaaacccaagaacagaagaccaaggacagcaaccaaacggcacagcgataacagcagccacacacaaaacaagaaaagaagcacatgaaaccagcaaaggacaggaaagagacaaaaacaacacgaacacacgaacaacag

SEQ ID NO: 667952 - DNA, 1009 bp, Homo sapiens
ggaccgtttactgggcggcggtttggagcaagcgcagatatgcatggcaaggcagtcttcactgcgtcaacatatcgagcggccatcgaattgcaccattccctgtgggattgggataccctgagagatatcccacatccacggggcatgggtgcacttgtatggccgctgatatgggttggaccatttgaacagctcggtgttacccagtgcgacagtctggacgtcgtgcccagtatgctacgcagcaagtgaacgaatgacggtgggcgggtgtagtgcgcatttacatggtgcagcaaagggctctagtggtacgccgaggtgattcgcgttgaaagctggtagaagagatgcctctttcacttctgtactatgctaatgacttgatggtttgcttcggtgaccagtgtagaagggggcctgggtgaatcggaggcctgccagaaaggacgcgtcaggcgaacctgcaagctgggacctaatcacgttggaagtctgctaaatcctctaggtttccatcttgtgggcagcagcttggtttttataaacaaagccgctggtggacaggggcaattctttttaccccgcattatgggaattggaggtcgggggcacaaattgtttgggttttccgcaagttggaacaacccaaatcgaatttcatggaagcaaccgaattggtggccgtgcccaatggggaacagaagcctgggtgggaattgaaagggggctggttgagaaaggctaatctgggacatactcgcaagtttcaaacccaattcttacccagggtggggagaattgacttctctaaaaggcgaaagaggcgtgggtcgttgaaagggttactaaacggccttggccaagttataaacccaggatttcgaagttggccaaccccaattaattcttcagctccagggaggaaaaggtaaatccccaggtaacttgggccaggtacccaaaaggccattcgggtgggtggaaccggcctaacagggcccca

SEQ ID NO: 667953 - DNA, 155 bp, Homo sapiens
  misc_feature (16)..(16): n is a, c, g, or t
ttatttttctatttcncctttaaaaaggaaaaataatctttttctttatttttcctttaaaaagacccacccataataacaccaaaccaggtagcaggatagagactcattttcatctattttggttaaaagaaaataaatgtatttcttcccca

SEQ ID NO: 667954 - DNA, 191 bp, Homo sapiens
  misc_feature (126)..(126): n is a, c, g, or t
cttgagtgcagcctgcccgctttaaccagtgcaacactgacacgcggcaacgaggtcatctccgtgatgaatctgggccaatgaaatgcagtggaagtcatgtgggacgtggtaaccaccacacgnagtgcagcacgcctcgccaggccggaacctacgcccacacggtgaaccgcaactggtacggcggg

SEQ ID NO: 667955 - DNA, 151 bp, Homo sapiens
ccaggagatagcttggactccattagaatatcagcatcaccccgcaggcattccagagtatacgccatgtttcccttgtggcggtcacacttaagttgccaccaactgcttcaatgtccacgggttatcgtgaaagatgaagctcctttgg

SEQ ID NO: 667956 - DNA, 190 bp, Homo sapiens
gctgccgctactactaccagtcgcaggggcacgtgtgtgtcctgcccccgtggtgcacgtgacaagagaatgaagcacccagtctcgtaccattttgagccctccagcgctacttatatttcccccgacctgttgccgtggctgtttgctaggaaggagctgtgctcgatacctcccaagagggacactt

SEQ ID NO: 667957 - DNA, 479 bp, Homo sapiens
caaacctaataaaaaaaaaaaaaaaaaaaacgaaataaaaaaaaaaaaaaaaaaaaaaaaaaaaaaaaaaaaggggaaaaaatccaaaaaaaaaaaaaaaaaaaaaaaaaaaacctttgtgggccccttggcccaagccacttttaacttgaacaaagtttttcattgcggccgaatttggacctaattggccaaattccccttatagggagtgttttaaaaataaatggcccgcggtttaaaaacttgggaatgggaaaaccccgggcgtccccaaattaaatcccttggaaaaaaatccccttttcccaagttgggaaaaaacaaaaagggcccaaccgaatcgcctttccaaaaatttgccaaccctaaaggggaaaggaaaattgaaagcgtaaaatttttgtaaaatatccgttaaaattttggaaaaacaacctaatttttaaacaaaagggccaaaatggcaaaaatccctt

SEQ ID NO: 667958 - DNA, 553 bp, Homo sapiens
cagcttcacggaacccaaggccggggcctgcaggtggccctggaggatttccaaagcacccgcccgtcatgtgggccttccaggagaccagtgtggagagcgccgtggccccgcccttcccagctggaatatttgtaaggctggaatttaagctgcagcaaccaacctgccggaagaggggttggaaaaaacccgggtgcaaagtcgggcccaatgggaggaaacggaaatgcttggcctgcatcaaattgggctttgaggacaaagttttgggcgggttggtcccctgccccataaagacccaagttttggggggggtttaggggccccaggagacccagtgcctcagggtgcaaggggttggttgggacccccccagtttttacttccctggacagtttgccttttccagggccctgccccgcagttaagccagcctttagatgggtggggcctccagggcccttggggggggtaaccagtggaagaccccagcccccagggggggggacccgttttttcccccgccttgtttataaaggtgttttcccca

SEQ ID NO: 667959 - DNA, 343 bp, Homo sapiens
  misc_feature (156)..(156): n is a, c, g, or t
  misc_feature (294)..(294): n is a, c, g, or t
cccgatcctatcgcgttattggcatccgctcaaatgccgagccccgggccgaagttgccggcgacccactgcgtgacggcattgacgtccgcgtagtcctgttccggcagccgtcgagcatcgacagcacctcgttgctcgcgccggcgtcgcggngcattcgacgatcgcatccttgttcgccgggtagcggacggccgccagcacgtcggcgatctgcaggtcgatcgtttcgtgagggatatcgtgagcaggggtagcgggcttgtcgttcacgtcggcgtctcggggttnggcgggaatcggatcgaagcggaaggggttggcgcacccgtttaacccc

SEQ ID NO: 667960 - DNA, 365 bp, Homo sapiens
accttggcgctgggattgataaaataaactaacaaatgtgagggaagacacaaacctcccacagagaattccaaatgaattatgtaaatattccaccctaactgaggaagagcacaactgtccattcagtaagcgtgggctctgcaaagtgacctccttccaaagagaacagtataaaaaggggtgggggaagtaactttacagtggataaatctaacaaacgctactccagaaggatgatcaaggtcagtaataatgtgataagtcaccttgatagtatgtatccttgatagcatgtgttgaaaagggcatcttacctctgtgatcttcccctgatatagtccgtaaggccattttaatcatga

SEQ ID NO: 667961 - DNA, 241 bp, Homo sapiens
tcacactactccccatatctccacaaaaaaataaacaaggttggccaggtgtggtggcgtgcgcctgtggtcccggctactcgggaggctgaggtgggaagagcacttgagctctggaggtcgaggcttcagtgagccatgatctcgcccctgtactctagcctgggcaacagagtaagaccctgtctcaaacataaatgggtgaactagagaatgttctaagatcattactttccttgtg

SEQ ID NO: 667962 - DNA, 977 bp, Homo sapiens
cgttcttgggcacttgcattatggtgggggaaatttggtattttttctttatatggcatatttcctgctcagggtatttctggtttttatggtcatgtgaagtcttttggggttttgattatctgtctttgtgtctttatgaactctcttgttagtaactttcctgatggtttgtggactttggagttattgtttctgttatgaagtatttgcactttcctgggtaaggatgattgtgcgtttcgccttgattctccgagtagcttctcgtgtagtgcttaagtgtgtttgtcatgcgccagttggtggtctatcgggggcctgtccagccctctcccgctatccttcctctatgtgacgtcctttgccttgtcacttagctgtacctgcctgtctatgcctctacccccttgaggatagctatggggtaccctttactatctctggtgccctgctacctagtactaggctgtggtcaggcccaggccaccggccgggttctgcctacagcttcccacgtgcttgctgtacatgcgtgtgcctgtgtgtggtgtctgttgctgtgtcgtgaatactgtgaccatcactcagtcctatactatagtgagtggccctcgtaggcctactagttatgctactttcagtgtgtgtcattatacgtacgtctactgctttttaaactcgtataactctgttattttagtaataatgcccaggagtcctggtaagctacgcggtacttgcagaggttttattttttggccttagaatctgctagtaatattaggtaggcactcgtagccctagcgcagcagcctcggacccggattgcgtttgcacttagacggattatgtttatacagatgaatattaaaatgttatatatttataagggacattatatgcttcatttttatccacacccaatcataactctattcacctatctggaaccggacgcaactacatcaaccaca

SEQ ID NO: 667963 - DNA, 121 bp, Homo sapiens
tgaagtttccatggtcccatgtacacaagctagttacatcgccacacgttctggctaaaggaatgctctcccgtcacctgtctcaatcacactgctacttcgtttcagtgaatccgtttcc

SEQ ID NO: 667964 - DNA, 138 bp, Homo sapiens
ttttggcatgcaaggagaaaatatggtgagctcacagaaggatataagggagtatctaacattctccatccagttcaaaccaggattctggttagcctttggatctggatagtagagccctggaagggagcccaaggg

SEQ ID NO: 667965 - DNA, 464 bp, Homo sapiens
agactacacagcgacatatcatgcaggcatatatatccctttggacaagtagtgtagatatactattgttaatatcaagaatacagtgcaaaactgtggatacaacttgatctgaagcctagatacacaccacctacataatctgagtaagctggatacatatgcttattaataaatcagaggtgagtcatttcctcagtcatgcaagtgaaattatccttgtatgtgttaaggttaaaagtatgtaggtcaagaaataaaagaaggctcggcacagtggctcacgcctgtaatcccagcactctgggaggccgaggcgggcggatcacgatgtcaggagatcgagaccatcctggctaacacggtgaaaccctgtctctactaaaaatacgaaaaattagctgggcttggtggcgggtgcctgtggtcccagctactcgcgaggctgaggaaggagaatggct

SEQ ID NO: 667966 - DNA, 201 bp, Homo sapiens
  misc_feature (177)..(177): n is a, c, g, or t
cgcatcgtatgtagtgacgaaccagttcgtgagtcgacagcgacgccgcgagtacgaggacggagccgggcgcatggatagagcaggatgtgcggatattcgaccggacacacgatttcagaccaacgacagactgccgagtgagctgcggaactggcggtatacaacagagcgagncaggtctcacatcatccagaggat

SEQ ID NO: 667967 - DNA, 348 bp, Homo sapiens
atacatattacgactcgagcttggtacctgtgggtagcacaacctagggtcagtttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 667968 - DNA, 451 bp, Homo sapiens
cccctccccgctcgtttgtctcctcccgcgcgccgggggctgtcgcctcttctctcgctctccctcgctcgcgcctccctctctttttgggtggggtgggtcggtcctttctctacaaccctcctctccctctccgtcgatttctgggtgctgcgccggtgggctgttagcgctcctctccccgcccgcctctcgttctctctctctctcgcgcgcgcccccccccctcaaaaataggagggggttgcggggctctattgggcgcccccgcacccccttcttttttttttcccccgccgcgcgggggcccccccccccccgcggggggggcccgcgcgggggggtgtcgcccccgcgcgcgcgcgtggtgttttttttttttgttttttttttttttggttgtaggatgttttttttttttttttggggggccgcccctccctgtttgtta

SEQ ID NO: 667969 - DNA, 198 bp, Homo sapiens
tggggccggggggggcctttgtctgaaaaaaaaggttcgacccggggaattggggaaaagccgggcccctccggaaaaaagggggcttggtttttttttttgggctcccctagggggggggaaaaaccttttttttaataaggtcccccggggttttaaaaattttttgggccccccgggggggcccccgcccccaat

SEQ ID NO: 667970 - DNA, 911 bp, Homo sapiens
agacaaaatgtcttctctttcaaaccagagccatatatatgtctgtatatatgggacctactgcttctctgaggaaatgcataatctgttaatatcagacaaaatgagcaattggtagtgctcataatatattccaatttttatggaattttcgatggaatgttatttcaataaagccatgtaaggtgaaactttgataacttttgactcttcaagttagggtgacattctgatccaatattcagattcatttgtgtactcccacatgcaaaatgctaaattacaatgcagacacttaagaaaaagtatcgactgcaggggttgaattccttgagaatgtacttttatagtctaaatcacaaatactttactcaatttagtctttcaaaaataagtaaacctgaaatattattgtcggtaagcctatcagagtcaatccttcagttggaatgttctcctgtttagccttacctataaatcatttaagaaaactgaattcattgtcttaagatggcataagtctgtctcttgagaaataagtaaaatactcctatcttccagtaatctgtagcacctgaaatagcgtctttgtatagccaggaacagttaatgttgcaagtcagctgacttgtccacagttggacataaaatctgaagtataccagctgattctactggccttcaactgggtcggagaaatcacccgaatctcaccttagggttaccagtctgctagagaggacataaccggattgtgcccgaattgggcattccgcccgtcgaaacaactggtgcgcgaggcccacgcgcaccctcccggtgcgcgctcgcgcaccgccatcacacgacctgcacaaggcaggcgcacaggtatgacagcgggataagcgggtaccctgatataataactg

SEQ ID NO: 667971 - DNA, 152 bp, Homo sapiens
cccgtgaagactgtgtgagtgtagggtctgtcgcctgtgctggcttcgtggtgtgcgtgctggaggtgggagagctgccggaaggacttatcacagtaggatgcagtggtagtggcttgacggcccatggtggatgctgcattgtgcttggg

SEQ ID NO: 667972 - DNA, 817 bp, Homo sapiens
caggcagtctcctttgtgtgtattcagaggcagtgatgacttgctgtccaggcagctccctcctgcacacagaatgctcagggtcactgaaccacgtgcttctcttttgaaagtagagctagctgccactttcacgtggcctccgcagtgtctccaactctacaccgcctgtgtctcgcccgtggccgagcactgatggctcaatgactaaggctggcaagagccctccgcagcaaacgatctactggcgccaggaaagcctctctctccctgccctctctcatgaggcacgagacaaggccaagcgctcatgtggagccagttgggccagccacagagcataagagggtttattttcagtcccctctctctgggtcagaaccagagggcatgctgaatgccccctgcttacttggtgagggtgccccgcctgagtcagtgctctcagctggcagtgcagatgcttgtatgaacgtaggaggacacatgttctcactgggaagaagcgagggcacagaacccaagtgcctcacctcgcatcaggaggcccgtgttccctggagtcagggtgaactgcaacagcttggctgagacctggggatgagataccacaaagcctgattgaacacagggtcgtgcagcgaaactaagcaggatacctaaagcctagggcagacaaagtatagaagtctggaaaagcaagacgaattgagacctggacagtctggccgtagctcagcacaagagagcggcggccataatggaggcctacaagacacaagggaccggggagggagcccgggtacgagcagacgga

SEQ ID NO: 667973 - DNA, 462 bp, Homo sapiens
  misc_feature (100)..(100): n is a, c, g, or t
gctttttctctccctgttttgttttgtaacctaaggaagcagacctctgagaccacacacagcagcgtcgcccgtccccagaggcaccccggccaggacngcaggagaggagacccccgttcctgcatgcgctgtcgcccgccacggtgctctccgcagggtgaggcaggaggggtgggtgggggcgccagcctgtcttaacttgaaaggccgggcattgaccaggaccgggggccaggtaaccaccaggacccagggagcccggccattgtcccccgggggggcccgggggtgtgccgggctggttcagccgaagggttttacacaaccagccggcaaaatccactttttccacctcggaccgcttgatgaaggtgtggtttgtgagcatcttcaggtccgcccgctccgctgggttcttgatgaggcatttattgacaaactcctggaagtcgggggtga

SEQ ID NO: 667974 - DNA, 100 bp, Homo sapiens
gaaaagggaggctggtaggaactgggtctctgggtagacctctgggagctcctccaggctgcaggctctggggaagggcatttgaagaacatgactgggt

SEQ ID NO: 667975 - DNA, 102 bp, Homo sapiens
gctaatacatggcttgtggccacacttctaccgttcattgctgccactgctatattggcttcttctggggaggagaaacacacaaaaccaaaccctttgctg

SEQ ID NO: 667976 - DNA, 155 bp, Homo sapiens
aggggtggtccactggctgacatgtgtggccaaaactgggggtgggggtggaagcaattgccaggtgggcggtggcagagcaatgttcacacagctggaggacacttgggggcagttgaagtaattggcagaggttcttcttctgctgcaggagg

SEQ ID NO: 667977 - DNA, 356 bp, Homo sapiens
  misc_feature (54)..(54): n is a, c, g, or t
  misc_feature (74)..(74): n is a, c, g, or t
  misc_feature (83)..(83): n is a, c, g, or t
  misc_feature (85)..(85): n is a, c, g, or t
  misc_feature (91)..(91): n is a, c, g, or t
  misc_feature (94)..(94): n is a, c, g, or t
  misc_feature (106)..(106): n is a, c, g, or t
  misc_feature (110)..(110): n is a, c, g, or t
  misc_feature (135)..(135): n is a, c, g, or t
  misc_feature (152)..(152): n is a, c, g, or t
  misc_feature (159)..(159): n is a, c, g, or t
  misc_feature (161)..(161): n is a, c, g, or t
  misc_feature (164)..(164): n is a, c, g, or t
  misc_feature (167)..(167): n is a, c, g, or t
  misc_feature (177)..(177): n is a, c, g, or t
  misc_feature (179)..(179): n is a, c, g, or t
  misc_feature (186)..(186): n is a, c, g, or t
  misc_feature (193)..(193): n is a, c, g, or t
  misc_feature (222)..(222): n is a, c, g, or t
  misc_feature (229)..(229): n is a, c, g, or t
  misc_feature (239)..(239): n is a, c, g, or t
  misc_feature (241)..(241): n is a, c, g, or t
  misc_feature (244)..(244): n is a, c, g, or t
  misc_feature (271)..(271): n is a, c, g, or t
  misc_feature (293)..(294): n is a, c, g, or t
  misc_feature (323)..(323): n is a, c, g, or t
  misc_feature (332)..(332): n is a, c, g, or t
  misc_feature (345)..(345): n is a, c, g, or t
aaattcattttttaaattcccgtttggcccctttttttgataaaaaagggccanattcccccttttgggccccnggtttttcngncccccnggnggtggggtaagnaaanaggaatgggtttcccccctgaggcnattaacccctttggaanagggcananccngtncccccgggantnaaggggngggcttnaattcccagggcttttttccccccccggnatccggntccccccccnanggncccccccgttttcagggggggcccccngtcttttttctcccccgcggannaaacttttttttgggccccgttaattttnccccccccnaaaaaaaaaaagnccgttttttca

SEQ ID NO: 667978 - DNA, 304 bp, Homo sapiens
  misc_feature (85)..(85): n is a, c, g, or t
  misc_feature (282)..(282): n is a, c, g, or t
tccatttgtttgggtattatttaatttctctaagcaaaattttatagttttcagtgataggtgttggacatattttgtaagattnatcttcaagtgactcattttttggtgttgttgtaaaacgtcaatttacatttgttcagtgttggtacataaaacagaattgatttttgtacattgatcttgtgttctgcaaacttgctaaagtaacttattaagtatagcaacttttttgtttgtagatttttttgtgggggattttctaagtaaataatcatgtcngtgaataaagacagttttataa

SEQ ID NO: 667979 - DNA, 160 bp, Homo sapiens
cataattaggggaagtatgacggggagaagctcccccagattggtcacacgctcccgaggccgtctcacgaccatctcatctggcgactcgcgcataccccggctctaggcctccgttcccaccaggaatcgggcggcgcatccccccccattctcatcc

SEQ ID NO: 667980 - DNA, 1507 bp, Homo sapiens
  misc_feature (12)..(12): n is a, c, g, or t
  misc_feature (154)..(154): n is a, c, g, or t
  misc_feature (231)..(231): n is a, c, g, or t
  misc_feature (246)..(246): n is a, c, g, or t
  misc_feature (253)..(253): n is a, c, g, or t
  misc_feature (258)..(258): n is a, c, g, or t
  misc_feature (274)..(275): n is a, c, g, or t
  misc_feature (514)..(515): n is a, c, g, or t
  misc_feature (534)..(535): n is a, c, g, or t
  misc_feature (548)..(548): n is a, c, g, or t
  misc_feature (551)..(551): n is a, c, g, or t
  misc_feature (561)..(561): n is a, c, g, or t
  misc_feature (570)..(570): n is a, c, g, or t
  misc_feature (580)..(580): n is a, c, g, or t
  misc_feature (607)..(607): n is a, c, g, or t
ggctttcctagnatccacactttcaaagagaaacccctccagaactcccaccctgacagtcccaacaccaccttcctcctggcttccaggggcagcccagtggaatggaaagaatgtgggatttggagtcagacaagcctgagtccagttcccngtttagaactcattagctgtgtgactctgggtgagtcccttaaccctctgagcccgggtctcttcattagttgaaangggatagttaattanccttacnttgcnaggttgttgtcatctnnagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagtcttccccaccctgggatctcaggagggcagcnncggagtggggaggccccannatgcgcgtggccnaangccaggtccngaggccaanagttctcccntgccatccttggtgccgtcctgccccnttcctccttcatgcctgggcctgcaggcaccagccacgagccaccacatgagtccactcggagtgccctgtgttcctggcgaaggcattccagggttgaatcatggtcccagcctcagcctgggacacctaggtggagcagagtggtctccgctctgaataggatccagggacctgggctcattcttcttggctcaccaatcactgcaggcctcatctttcccaaaacccactttgtctgggagggagtgggtccgcgctgctctgcagcaggggctgcgcgcagtggcacagcatcaggtgggaacaagtggcgtccacccctcatgtatctgtacggattctcaccgatggcgctcgccgacacacagccttcgacttcatttctccaaacacgtcagtcacctcatttattccttacattccaacaactcccccaacccaaggctggtagtcaacgtccgtgcctttacaaatccgtagctccgagcacagttccagttccgataccagacgcgcacgggaacctcccctaaaggtacttcccctggcctgccatcaccgccaaagcccgcccggcaactgacacaacaacctacacacatggccaacacccagcacacaaccccgcacctgcaccagcactgcaccacggacgcggaacccgccacttcacggaaccagcacacaccccacggcgaggccgcacgcaagaccacggaaacacaaggtgaaaaccccccgcgcaacgggccgagacacatggccccccctggccaatcccggctcaccccggcgccacgcccccaacgagcacacccccacagcccagcaccccgggcacccacttgtgcgcatacacagcggggggtaaacaccggaacccccaccgagtacacca

SEQ ID NO: 667981 - DNA, 416 bp, Homo sapiens
  misc_feature (410)..(411): n is a, c, g, or t
gccaaagcgtagtacccacacagtattttcaaccctccctaccccttagtaggctctagtgtttatgttaccatctttatgttcatgagtacccaatgtttaacttccacttataagcgagaacatgtggtacttggttttctgttcctgcattaattgacttaggatgatggcctctagctgcatccatgttgctgcaaaggacatgatttcgttattgtataaaaaaaccatacagctgcttagtattccatggcgtataggtgccacatattccttatccagtccaccattgatggggcacccaggctgattccatgtctttgctattgtgaatagtgctgtgaagaacatgagggtgcatgtgtctttttggtagaatgaattgttttcttttgggtactacgctnntggca

SEQ ID NO: 667982 - DNA, 710 bp, Homo sapiens
ctattaagccatgaaaagacaaggaagaactttaaatgtataataactaagtgaaagaagccaatctgaaaagattacatactgtattattctaactatatgacattctggaaaaaagcaaaactatggagacagtataaagataagtggttgtcagagttggtggcaggagggggcaagtgatgaatatggtggagcacagagaatttttaggcagggaaaatatgtagtggtagatacatgtcattatacagttgtccaaacccgtagaatgtacaacaccaagaaagaagtctaatgtaaactgtagactttgaatgagtataatgcatgaatgtaggttcatgtattgcaacaaacatatcactttggtggggggtgttgataataggggagtaggtaatgcatgtgtaggaacagtgagtatatgggaaatctctgtgccttcctcttaatttggctgtgaacctaaaaactgctctaaaaaaataaaatttttaatttagaaaaaattaaatagaaaaaaggaatcattaaggttagaatggcaatcagtaaaattaaacaaaacacagaaaagaaagaaaggaaagatgcattttgttagatttttaaaaatgagaccaaagctggttcttgaggaaaatcaacaaaaccgatgaacctctatctagactggttcgaaaaaaagggtaaagacccaattacag

SEQ ID NO: 667983 - DNA, 173 bp, Homo sapiens
tgcagcacaaggaaacgaggtggtctgaggctgaatcgggagtgtggcccatccggggggtgacccggggcccggtgatgggcagagccatcagctggtgtcgatccaggatgccccccgtgatgggagcccaaatgggaatttctcgacccgtgaagggagcccaaaggggt

SEQ ID NO: 667984 - DNA, 544 bp, Homo sapiens
  misc_feature (472)..(472): n is a, c, g, or t
gctgggcaaggtgatgagaatgctgggctagaacaccacccctgaggaggtgcagaagatgattaatcaggtgcacgaggcgcgcagcggcgcggtggactttgatgagttcctggtcatgatggtttggtgcatgaaggacgacagcaaagggtaatttaaggaggagctgtttgactttttccgcatgtttgacaaaaatggtgatggctacatcgacctggatgagctgaagataatgttgcagggtacaggcgagaccatctcggaggacgacattgaggagttcatgaaggacggagacaagaacatcgccggccgcatcgactatgataagtttctggagttcatgaagggtgtggagtagaggttgcctttcaccaaaggttgcctatgcccagccttcaattccagttgagtcctggggttggggagggggttggggtcccaggccctgagcctggccatgtcntcaaccccaaatcccccgactccctccccagatttgttttgggggatgcaaataaagcctgttttcccaaga

SEQ ID NO: 667985 - DNA, 429 bp, Homo sapiens
aactatgacggactatagttgatgatactgtatcgtctgcaggattttgccaaaggagagtatcattgctctagccacgaaaaataaaggaggtaactatgtgagatgatggctctgctaatatacctgactatagtagccatttctctatgtacatgtattaatcatatccaaaacatccagttgtataacttaacatatacacaccaaaaataaatttgtatgtactatactccttccacaatggtccagcattccttaaatcttcgttgcacattatgggtcatactatgtaagaggcaaaaacatgacttaagggaacattagagaggagtccatcttatatcaaagccctactgtcacatgaggagacaaccacagggtgtgtaccccttcttaagagtgccagccccctggccccttctttcc

SEQ ID NO: 667986 - DNA, 479 bp, Homo sapiens
  misc_feature (180)..(180): n is a, c, g, or t
acagactggatgtgcagcaagtggtcctggaaggaaagatgtctcatgaacaggagaaagagcgcttacccactcatcatctgacctcacatgtggaggcttccaggccaaaatgacgagggtggaggagtcattctgagccgaaatattagacacatatcaggattatgtgagcccagncagttctgggagcaggagctggagagcttacactttgtcatcgagatgaggaatgagcgtattcatgagctgacaggggtgatcctcatggaacctgtggaagagaaaaatctgatattgggggaaaaaattacgaccctgcaacaggaaaatgaggacctccatgtccgaagccgcaaccaggtggtcctgtcaaggcagctgtcagaagacctggttctcacgcgtgaggcctggagaaggaggtgcgttgggcgacagctcagcaggagaaggagggcttgtgtacgtgtcttggg

SEQ ID NO: 667987 - DNA, 163 bp, Homo sapiens
cgatctagccgatctttttcttgccacgactcgtaggcaaaatatgaaggctttaaaaaatctatcataataatgaaaaagaggtcgtctcccaagcagtgctgtccctcaaagaaaagactggttatgtggaaccggcacgtcgggagagattattctaagt

SEQ ID NO: 667988 - DNA, 243 bp, Homo sapiens
atcatccagttttctggggatgttggccctccctttgtggaaggttctcccagggagcagtaggtacatttttcctgagggagtttgccttcttctgagtctgggccagaatgcagtttctttctgagaagaatcatacctccttggctttatcgtggagcacagtttggacctccttgtcagaactctcacttggtctgctggtgttcaatttctctcccaagttgcatgataggagggggg

SEQ ID NO: 667989 - DNA, 223 bp, Homo sapiens
aggctcgctctctgtttctagatctccatgccgccgccgtggcgctcatccagccaagattctcctctctttggccccgagcatttgcgggtggctgccgtgtcgctcagtgggttcaccgtgagggctgtcggtggcaagtagggcggcgtctcgggaggcaaggtaggcggccagtgtcaccagggcagccgcatacgtgcacacgccgcagccgcggccg

SEQ ID NO: 667990 - DNA, 302 bp, Homo sapiens
ccatcggcaggttgccaccggcaggttgtactggcatggcaccaacatttgctcagcttctggtgagggcctcaggaagcttacagtaaaggcggaaggtgaagggggagcaggcatatcacatgacatgagagagaggtcacgtatccaactcatatcacaaagcgaatcgcactgagagtagggtcggaagaccggcatctagtgcttctcccctccgtcttgctcttccgtcgcggtacttcagtactcaaccctgtagtcctcctctactgtcccctctgctgctcccctcgactgtc

SEQ ID NO: 667991 - DNA, 685 bp, Homo sapiens
gaatcatacctgtctgtgaaccactgtgctttccttgaggggggcattgtaggttgacaccagcaaagactcagagtgacttgagcattggagaaccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaagcaggaagctttgcatatgcaatcttagagttgtgtccctttctgagtttcaaatacatcacaccttgctttctgttttgggagcaaagatgtgaattcaaattcccttggtaaccggcctaaattaaataatttcattctaagagaaatttggtatttttttaaaagtgaactgagcacttttttgtgtttcttaagagagggaggaatcgagaaaaatggtgtgcaattggtaaaaatattttgaataatatttccttggtggcctttaaaaaaccttatacctttctacattggcattggtggggggggtctc

SEQ ID NO: 667992 - DNA, 185 bp, Homo sapiens
gaagctgggagggaagttacgcttatttttttttggtctttggttttttttttccctttttcgggagaagggggtctcgtattggcccaggcgtgatctggttagcggacgacccccgggttcccccaaagaaaaagaacaacagcactaactaaccgacaaaaaacaacagttgctgggggggg

SEQ ID NO: 667993 - DNA, 949 bp, Homo sapiens
agcggattattggttgggggataccctggaaggtgaacgctggcgaggagggtcgctgtccacccgggggcgtgggagtgaggtaccagattcagcccattggggccccgatgcctctgttctcggagtccgggtgctgcggattgaggtcccggttccttaaccgtgtgggatccgggtgtcctcgggatgacgattctggcgtttcctcggggctttgagtgggatcggtgtcctctagcgatgagatttagcggtttcctctggggcttgcgggactcttcacctaattatccgaatctctgctggattggccgtaaccctgtccccgagcgggctcacaagggtctgaacggccacgcattgaggcaagacggtctcggttctgagccaccccggtgcctccttcccaggactgcaacgattggacggaaggcgggaacctagcgaggccttgattcacggatggtcccatctacttggtcgtgctcaacggtgcctgggggcatgcacaatgtagggtgaccttcgtctcaggcttcctgcgtatccgaaaacttcccccgacactaccttcggacataagtgcagagccaaactccttccccttactacttgccacatctccatgggcctgtgccttcatcaaaccgtctgcactctggccttccacagacatgcttggcgctcaggtgcacattctggggaggcccagcccagcttgagcctgatggttccctgagcctttcagctggcccagatgtccaaacggcccagcatggttgggaaaccccagagacccaagagcctgcccaatgtagggcccctctgagaacacgtgggcaagaacgcacacgcaggccaggaatacggggaagactcacccaagaggagccaaaccagaggacaccgcagccgcacacagcgagcttgccacacaacagcccca

SEQ ID NO: 667994 - DNA, 280 bp, Homo sapiens
tgaatagaatggaaagaatggaatcctttccattccattccattccattgcaatcgagttgattccactgctttgcattccattccattccattccattccggatgattccattccattgcattccattccattccattcccctgcactcgggttgattccattccattccactccattctgttccattccattccattccattgtattcgggttaattccattccattccaatgtgctgccccccttttaatactcaccaataaattctacttcctgtc

SEQ ID NO: 667995 - DNA, 916 bp, Homo sapiens
  misc_feature (470)..(470): n is a, c, g, or t
tggctgtaacagtgtttatgggatgatgattccaggctcctgctgaagcccgtgggtggggaggggcacagagcgaaaatggggcgtaagggaatgcttgaaggctgcctccgtgatgctcggctcggagcttccagaactaggcgagggcagggtgaggcctcgggcacacagccggcgcccagtcacccgggcccaagattggaggggcgggccggggcccttgcggcaggcactttgccaagggtggctctcacacttcacgcacacttcgcaccagaaacttcaagggccgtcttccaacaacttccaaccaggtgccaatgtgcactttagtgtgcaaaatttaattctcgagaagagggacacgcggggaaacacgagagagtctcgtgtggagaggcttctgtgaactcctctctcgagaagacaaagaggaacaagcacgagagacagagctctctcagaanacacccaaagagaagactcagagaagcgtgatgagaaacaacagagaagagaaacagacggagacggtgcgagtgaggagagacccggggtgtcacaatccccgcgtcttgggaacgagaagctcacaaggtctctctggggagaatagacctgtgtggagtgaggcctgggagtggtagtaccaaaaaccgcgtgatccacacggcgaccgaccaaaggcggagcagtgttgtggcaccgccgtggttaacagaagaccaattgggggcaattcttctcgcccagcgagtgtgtcacgaggagggaagtagagaggacgtggcccctggagaggggggcgcgcccatcgccgtggtataaccccgacaaaatggggagtgttcacctctgacggaaaaatcggattgagggggggacctggacaacatgaaggaggataacgtga

SEQ ID NO: 667996 - DNA, 954 bp, Homo sapiens
  misc_feature (191)..(191): n is a, c, g, or t
tgggggggagaaaaaaaaatggggggggagaaaaagggggccgggggggggggcccccccccggcccccccgtggggggggcgccggggggggtggctaccgggcgcgcgagagtatacacccaccagccggcgacccaaagaaatagaacaccatcgcgctctcaaaaaaacaatcatataatacacgcngggggtgtgcaggccccagcccgaccacaaaccacacgcctcacacaggaggagcgggcacgagaagacaacgaacttggatgcaccaacgggggagcaaatagtgacgcacaaaaagaaagaggtgcgcccccgacgaccccgccgagcggggggggcaacagaaggcgaagactcccaccttattataaaaaaaaaacctcgagagggcggcggccgcagcagggagagcgccaccaccgcgatcagtatacacacccaacgaggagtagcgaggagggcagccaccaacactgcggatgcagcggcggtgatctacacacaacaccgcgtcgtgcgcaccaaagtggtgtggcagaacccccccgcttgccagtagtaaaaaaagaccgacagacaaacaactacgaacgcacgcaggagctgtggtggcgggaccacgccacgccatgatgtgacgtcgcacgcgagtggagcagcgcaggtagaaacacgccgccagttaccaacccggagagagcgagggacgccacgcagcggagagcagcgcaacaaaatgctgcgtgcaagtaacaaacccagccggggtgaggcagaaacagggggacgagccccctcctcctaaaagaccagacacacaaaagaggggcgggggccgccccacaaagacactcccggcggggggggacaacgactaagactaaacgaacctactttgtcaacaggggcccctccacagaggaggagcgactaaacaccgccg

SEQ ID NO: 667997 - DNA, 169 bp, Homo sapiens
  misc_feature (109)..(109): n is a, c, g, or t
  misc_feature (114)..(114): n is a, c, g, or t
acaggacccaacgggcccctggtggcctgggggccaaacccctgggcaagttgggcattggcccttgccttcggggaccttctggggtgtgagggcaaagggagggttnccatnaaggaacttgggattttcaatggaataaataaaacataaagtttattcttgggga

SEQ ID NO: 667998 - DNA, 409 bp, Homo sapiens
  misc_feature (58)..(58): n is a, c, g, or t
cactgtgcacagccatggcttggaatgatgaagtgtggatacgctgcgagttgccctngccatcgcgctccatcaggccagacgaagggtttccttcaccagcgcagcaaaggggaacaagccctactttttccccacaaacccccttttgcgggaaatttcctcaccacgcgcaggaactggcggcaggcccaatccagccccccaacctatgcggaatcgtatttcgaccaggctagacaccggcggccccccccccaaatcgtgaatcttctcgtccgtggcccctatgcgggtattgcggccgccataataaatcacctggcgccccaaacgggggggattcccctgagacacgtccggcctccgaacaacaaactgggcttttcctcgttcccccccccttatg

SEQ ID NO: 667999 - DNA, 201 bp, Homo sapiens
ggtaatacgactcacatggtcccaggtctcaacgtccaggctaactcagagatttgatggctcaacatgcataacttgaattcaatagactttggctggtaataaaacagatgttttttagattataaatattaaatcaacttaatttgaatgagaattgaaaactgatccaagtaagtttgagtctgtattacctgctgg

SEQ ID NO: 668000 - DNA, 336 bp, Homo sapiens
caggagaatcgcttgaccccagcagatggagctggcagtgagccacgattagcccgggccacagtgagtgagacctcggtctcaaacaacaaacccaactgggacattcttcttgagttaaacaagacactttttattctgaatcagcttccacatcattaactattttctgcacaactggcacaagtggtttttctttttaagtatactaccaggctagctcctgagcctttccctttattggaaactttaaccccactgttaatctatacactgcaaaagaccaaggatgcacttcaacggacaattactcagtgtatagaaaggaaaaaaaaa

SEQ ID NO: 668001 - DNA, 665 bp, Homo sapiens
  misc_feature (10)..(10): n is a, c, g, or t
  misc_feature (13)..(13): n is a, c, g, or t
  misc_feature (40)..(40): n is a, c, g, or t
  misc_feature (72)..(72): n is a, c, g, or t
  misc_feature (92)..(92): n is a, c, g, or t
  misc_feature (110)..(110): n is a, c, g, or t
  misc_feature (112)..(112): n is a, c, g, or t
  misc_feature (117)..(117): n is a, c, g, or t
  misc_feature (135)..(136): n is a, c, g, or t
  misc_feature (142)..(142): n is a, c, g, or t
  misc_feature (151)..(151): n is a, c, g, or t
  misc_feature (164)..(164): n is a, c, g, or t
  misc_feature (167)..(167): n is a, c, g, or t
  misc_feature (179)..(179): n is a, c, g, or t
  misc_feature (181)..(181): n is a, c, g, or t
  misc_feature (188)..(188): n is a, c, g, or t
  misc_feature (202)..(202): n is a, c, g, or t
  misc_feature (222)..(222): n is a, c, g, or t
  misc_feature (245)..(245): n is a, c, g, or t
  misc_feature (278)..(278): n is a, c, g, or t
  misc_feature (291)..(291): n is a, c, g, or t
  misc_feature (294)..(294): n is a, c, g, or t
  misc_feature (313)..(313): n is a, c, g, or t
  misc_feature (333)..(333): n is a, c, g, or t
  misc_feature (346)..(346): n is a, c, g, or t
  misc_feature (436)..(436): n is a, c, g, or t
  misc_feature (517)..(517): n is a, c, g, or t
  misc_feature (533)..(533): n is a, c, g, or t
  misc_feature (559)..(559): n is a, c, g, or t
  misc_feature (568)..(568): n is a, c, g, or t
  misc_feature (621)..(621): n is a, c, g, or t
tccccccccnganatgctttattacatggtttcatcagtnatcaatgaggggtccctatgcccatgcgaggngacaggaacatctgtgtggnacatggcactgttccccncncagcnacgcagtcagaggggggnngggggntgaatgggngcttggcttcccngcngtggggcaggcncngagaacncagcagaaagaaangaaagcctggcaaaaagggnggcaggaatgttcaagcatcggngacccccatgttctgcagcctgttttctagggngacgtctcttgcngcngctttctttttgctgcccncatgttgcttcttctgcttntttgatggctccngcccaatgggcgcaggcttcacaaaggggatcagttcttgcagtcctggcggcatgaaccccttcaatttctcaggcacagtgatgcccntctctgtttggtagttctccaggatggcgcagatgggacgggtagtggcgcacatgggagcattgagcatatggacaaacnccaccttgtccatcancttcttggtttgcccatatcggattngaagccggngagcctggtaatccgtgcaattagaacaggagaacaactcacggaaggctccngagcccggaaaccaggcctccaggtcaagcttcttactggcagc

SEQ ID NO: 668002 - DNA, 205 bp, Homo sapiens
tcgatatataatacctgagaactcctgtactatctttaccacttcctgtgcatctgtaattatttccaattacaaacttagtaaacaaaaaccaactattcagtaaaaccaacatgggctgagataagtaaactcgtaaaacccttttggtctgggtaaattattggggatatacagggagactagggtaaaaaccttgtgacat

SEQ ID NO: 668003 - DNA, 314 bp, Homo sapiens
tgccgagtacttgtgatgaaggcttttctgatactcaattctgtcgcatcaaggttgaattttctaggatttgcttcgactatgcgtgggtccaaaagtcaaggtaaagcaatctcatcttcaaaagtctaacaaccagcatcatgttaaaccaaagaatctcgcataggcaagcaatcgaatctggcccagcctttctgaacacatagtcaacacgaccttagtcattctcaaactttccctgcccacggccagatgaggatccttgtgccccaaggcagagatgacctgcctggtccactacagtctcacgg

SEQ ID NO: 668004 - DNA, 294 bp, Homo sapiens
ggggctttccccccccggggggtttttcccattttttccaaaaattgggggccgggcccgggggccgggccccttccttttttttttttagggtgggggggtttcgggcccccaagttcccccggcgggtttttttccgttttcccgcttccaagtttagtttttcctttcccccccgggtttttgccgtttggccccccccccctttttccccccagggggccccccctttttttttgggggggggccttttttcggggtttcccccatttttttttgggggcccccggttta

SEQ ID NO: 668005 - DNA, 892 bp, Homo sapiens
cagggccgtaggcagccatggcgcccagccggaatggcatggtcttgaagccccacttccacaaggacggcagcggcgcgtgccacgtggttcaaccagccggcccgtaagatccgcagacgtaaggcccggcaagccaagggcgccgatcgccccgcgccccgcgttgggtcccatcggggcccatcgtgcgctgccccacggttcggtaccacacgaaggtgcgcgcggccggggatttcagccctggaggagctcaggttggcctggcattcacaagtaaggttggcccgggacccattcggccatttcttgtggattccagcagggaggcggaaacaaagtccacgggagtccctgcagggcccaacggttgcaggcggctgagggaagtaccggtccaaactcattcctcttccccgagggaagccctcggcccccaagaaggggagacagtcctggtggaaagaacttgaaagtggaccaccccaggttgaaccgggaccggttcatgcccctgtcgggaagcggtctatacagaaggggaagacacgctcagaggtcattcactgggcgaaggagaagaatttcaaacgccttccggataatccttccggtatgggcccggtggccaaacgcgcccgcgggttctttgcggcactttgcggggcaaaaaggacgccaggggaacgccggcagaaccaggattggttcgaaaagggaaagacatatatggcgctccgtgggggactgtgggatccaaacaagacacgaaaagatagagaatacaaccgacaaaagaacagaaacaacaaaagggggccacgcgcacaaaagatctcccggaggcaccaaaatatacggcccccagtttgaaagggggccccaatgg

SEQ ID NO: 668006 - DNA, 1097 bp, Homo sapiens
gctgtactgtaggctggttgttaatttggccgaggcagctctccgtcatggtcggccgacgctatctcgcgctcttgttcatgtgcccggcttgtgcttctttgtccccgtgtctgaggtgttaactgcggaggccccgtgcctcggtccccggactatgccgtgaccccgggtgccatgaagcaggatgggctctggcgcggctggccgtggtggcggacaaaggcgaaaccgcgccggggaggagaacaagaacccccaccgcgctggcccccaggatgtggagatgaagaggaggcagcgacgggtggcgggtcaacgggggagtgcatgacggcaagacggcgtgcggcagcgtgtgagcactcccagcgagagctggacacagtcaccttgtgagtgacatcaaggagcacgtgaaacagctagagaaagcggtttcaggcaagggagccgagattcgtgctgcgggccctgcgggatctgccttccacatcacgccgctcaaccactatgttctgtataaaggggctgtgcagggcttcttcacttcaaaataatgccagctcgaggactttttgctccccttccctggaagagcccattggacacaggagggctgatttacagttcccgtccccgcgcgggagaagagctgcgtcgacgcccctccttgccttgaaggtggaagcctatctccaaatcctcgtggtcatcttcatgattaaccaggcaagcgctacaaagagaggcagcaagaaggatctcttgtggtcttgtcagaagatcgtactcagagcggcggggcctaagactttttagccggcaagggtttactatatacggccggggtctattagtcttgacgaggtgattttgttcgcagtcttcgtgcccggcggaggcaagtcgataaggcagcgggaggcgctcttaactcgtccgatcctactacggttacagccgtgagtgttccattttttcgacggcacacagggtgcggcccctcaccggagaggccgggatataggggaaacaggacgccagcttcaggagcctcggtggcacggagagcacgtaggcactttgtcgcgacc

SEQ ID NO: 668007 - DNA, 606 bp, Homo sapiens
catgctaatcttttagtattttttttttttagtaagagacagggtttcgccatgtcggccaggctggtcttgaatctcctgacctcaggtggtccacccgcctcggcctcccaaaggtgctggcattacaggcgtgaaccaccggtgcctggcgaagtctaaaataagtgatctactctctagcttacagagaccaacatgtgatgtctggggatatcagatggtactctctgcttatcccgccagacactgtattttatgcatcatgtctaggatacagtgtgaaaattaaaagtttagagggcagatgcaattgtggagtgacctgccaataaagcaggtgcagctatagaagcgcataggtatatccttaatggtgctctccctgggcttgtctttgtgtttttccctattcagagctccttaaagtgataaacctccagctttctaaatctccaaccattcacaatcactccagctcatcgctcagtaggcggaactgctatgcggtgcgaccttcgggctccacagagccgcgttacgctctgctcagccctaaaagtatacacttgcggctcaccgacaagctcggcatttaagaacaat

SEQ ID NO: 668008 - DNA, 413 bp, Homo sapiens
gttggtcacaataggtattagctgttaatggtacaggatgacgggggattattattaacttcttgcatatttcccccattattcttagaaccaggggacctgggattctttgaggttgacaatggagtagtactcccgattgaagcccccattggtataataattacatcacaagaggttttgcattcatgagctgtccccacattgggtttaaaaacagatgcaattccgggaggtttaaaccaaaccattttcaccgctacacgaccgggggtatattagggtcaatgttttgaaatttgtggagcaaaccacagttttatgcccttggtcctagaattaattcccctaaaaatttttgaaatggggccggtttttaccctatggccccccctttaccccctttagagcca

SEQ ID NO: 668009 - DNA, 314 bp, Homo sapiens
acagaaaaccaaacccctcattttctcatttatcagttggagctgaacaatgagaacacactgacacacgggtgggaacaacagtcactgggccttttttggggaggacggtgtggggagaacattagagaaaagagattatggatgctagtgctttataccttgctccctttgctttcttgttctccttttcctttagtgtcaactcttttgtcgttcatatcacacttgtttccgtagttctttctttccacgatcttcattggcatgctcatctatttgtctttgccttttgctgatcctgcaaattttgg

SEQ ID NO: 668010 - DNA, 444 bp, Homo sapiens
acgaatatctacaatatattgtacagaaaaaaaaaacatgtacagtatgctctacataggggtggagggagagttcctttcattatatactgatttggtaccatttgaatttaacaccttatttatgcattttcctcttcacaaagaagtaggccaggcacagtggctcatgtttgtaatcccagcactttggaaggtcgaggtgggtggattgcttgagcccaggagttcacgaccagcctgagcaacatggcaaaacccggtctctacaaaaaaatacaaaaaattagccaggtgtggaggcgtgtccttgtagtcccaattacccgggaggctgaggtgggaggatcacctgagcccaggaggtctagactgcagcgagctgtgattgtgccactgcactccagtctgggcaacagagtgagaccctgtctaaaataatat

SEQ ID NO: 668011 - DNA, 164 bp, Homo sapiens
acctagaggatccccagcctaagtgaagaggagataaagatttgggaatctataagtgaaggaaatcccacctgtgcaggaggtcaagttctgtatcttcaaaaagtcatcagaatacatggattgaagagacttccgaacacgtgctatctcttgctgctgct

SEQ ID NO: 668012 - DNA, 215 bp, Homo sapiens
tcgcgttgcaggccttcatcttcatgatgctgacgctggtctatgtcggccaggcgcacgacaagcactgatcgcctgaagtcaacgagttccgttttttctttccgtccgtcaactactctctcataggagcaatcatggaaaacgtgttgggtcttgtcgctctggcttgcggtctgatcatcagcctgggtgccatcggtgcctgtatcggt

SEQ ID NO: 668013 - DNA, 434 bp, Homo sapiens
cgtaaccatgaatggcattaacatgagttcagatcaatatggatcaaatatccaggattagaggaaaagttgctccgctacagcccacgtagaaaatgcactagagataggctgacaaacagtgcaaattagtaagtataacagcatataaagaatgactgggtggaatcagccacaaatgaacacgtgtaaacaaggtgtccttaggcgacatggcagttagacatgggccatttcatgaaagcgtcattagttgcatcactgtaggcaaccttgcgaatgcagtcagccagtgcactggcttgcagggaccgtccataagagtctgtttagttagcaaggctttggcagagggtctcgctctctatctctctctctctctctctctctctctctctctctctctctctctctctctctctctctctcctcgt

SEQ ID NO: 668014 - DNA, 1574 bp, Homo sapiens
  misc_feature (1244)..(1244): n is a, c, g, or t
gccccccattatgggtccgcctatatatttttggggggtggtcccaccccttgtgagtggggacccacacaagtgtgtgtggtgtgcccccacagaaagagacccgccacagggcccgtgggggtttatcccccgcgctggttcctccgcgggagaaattgttccccccccccggggggaaggatattttcttcgcttctggatgaaacccctccaacagcgggcgtggttccccggagcagtgtctaatttattgtgatgatgtgggctccgttgttttgtttcgcacccccggctgtgttcctcatgatgtggatgtttctgacgcctcctccccccccttttctgcttgagtagattaccaaccgtgtgttgttccccccctcctatataattttcctgcgtccgtttttctcccctataaaagttgccccccccggtgtaaattgtgtcgcccccccttctgttttgctcgccgtataaacacgacaccttgtctgtccccctatcccccctgcaaaagtcttttaactccttcaataatatattctataaacaccaacgttttcgttctcaacaaaagatccgccgccttctccaaccagcgggagaaaattattattatagaggacacccctcgttcttcttctgagaagacctatatatttatctccttctggacgcccccgccggcaacatatccaacatctccgtcttaatgttgtggcctcctgtccatcttgtcacgccgccccttcttcgtcacaactattctcctgccttattatcccggcacattgccccctcctcttatgacaacatggtaacaccaccacagcaacagataaggtggtgtccacaacaccgcaggtttcccccctctccccccttcgtaataccacacgtctcccacaatatctcaccctgtgtgggcgccgcaccacccacagctgtgggggttgatctcctgtagaacactcttattctgcgcgggtgtgatcacccctccgcggcttcttttctcgcgcgccgctggagcagctcatgatatttcttgttgcatcacatcgtctctctcacacacaatactttttctccccccacctctatattgtctctatagagacccacacgcggcgagaccctctgcgagactctctctctgagaacgcttgtacacacactctcgaggttatagttagtctctctctcgcagattttaaaagcgcgcccccacatctttnctaatataatatatgtaacacttcacccaagaactctttttgcacactctcactgagagctgttccccaccacattataggcttataaaaccacagagatgcaaattttccccgagacgctttataaacccaaaccacctcttcaccccctacaccgacccgcggggtaaaactatcggtcacaatgctttgagaaatctgtggaggccacaccaccacgtttcacatgccccatcgtcctatgagaattataattccccttaaaaatttttgaaaatatagggcccctattttccctatagcaccccctttaccccctttagagcccca

SEQ ID NO: 668015 - DNA, 878 bp, Homo sapiens
ggtcctaaggtgaataggcgctccccaaggtgtagaactgagcgcagcgatgaacctggacaggttggtacacctgtgcatcagttggctgtggaaccggcatttcttcattggcccataggcccggagatcatggcatcctcgggtcaatcatccaatctatcagaacatccatggcgcatggtggatgactctgccagcagagtgtagtggcgggtgtgtgcatgatcctctgtcacattcgatcgtgcgaacctagacatccaaggccgtggacggtgcaacaggcacgtttcggcattaatggacctaatatcttgccccaatcatcccaattgtgcaggctggtgagtcccttgcaaagcattcaatccctaggttaatccaacccccaaggcgtcattccatcggtgggcccaattgcacagctgttgcgcttcaaccaaagcagacaagcattaggacgaaaggaaaaagatggcttaccggggctctgaagagggcccatgagggggaccccgcgcgttaacaacaccctgggtgaggacatgagtcttggaaaatgcacggtgccaagcaacagtgtgtatcacgaccgaattgcgtacaagggaggaagcaaaccattgttggcggttggtgaaccctataactgtctcaaattcaaggcggtattgaggagtggatcgtaccggggcggagatgggatcaggatatcataggcaagaggcccaggtgcatttcgccaattggatacatggcattccttaactacaattcctaggacataccttacacccacgtgaggtgccattattttgaccccatgtgggtgatgtgccccttggggtatcaaaaaggtttgcatgaacgggatt

SEQ ID NO: 668016 - DNA, 163 bp, Homo sapiens
  misc_feature (81)..(81): n is a, c, g, or t
  misc_feature (97)..(97): n is a, c, g, or t
  misc_feature (100)..(100): n is a, c, g, or t
  misc_feature (102)..(103): n is a, c, g, or t
  misc_feature (109)..(110): n is a, c, g, or t
  misc_feature (112)..(112): n is a, c, g, or t
  misc_feature (114)..(114): n is a, c, g, or t
  misc_feature (119)..(120): n is a, c, g, or t
  misc_feature (122)..(122): n is a, c, g, or t
tttgagaaacatttaataatgtaatgtgtttgtggtacagggctgagtacagatgcacaggaggccatagggtttaggcanaaggggagcacaaaanttnannattaanngntnctcanngngactgacagtcgctgcgatacgcgaaggacctcccctgcgc

SEQ ID NO: 668017 - DNA, 448 bp, Homo sapiens
  misc_feature (23)..(23): n is a, c, g, or t
  misc_feature (75)..(75): n is a, c, g, or t
  misc_feature (115)..(115): n is a, c, g, or t
  misc_feature (229)..(229): n is a, c, g, or t
atgtccattagttccttggcctnccttaggggaatccttttccccttatccccctcccccatcctgaaggggatnccccctgtagtagagggatatccatgtaccttcctttttnaagttcaccttttataataatatttttccccccatgacagtggttccccaactgggggaatcactctcccaggggcatttggcagtgtctggagacatttttggttgtcacaanaggtggaaaggggtactgttcgtgtctagtggatagaggccaaggatgctgctaaatatcccacaatgcacaggacagtgcctgcaagaaagtactatctgggctgggtgcagtggctcattcctgtaattccagtaatcccagcactttgggaagccaaagcaagaggagcacttgagtccaggagttcgagactagcctgggaaacatatagaccct

SEQ ID NO: 668018 - DNA, 314 bp, Homo sapiens
gtaacatcaaccgctagactgatcaagatcaaaagcgactaagcatgcagcctaggcagtaatgcaacatcaaaaagctagtgactatccacagccccacggtaaacagcagtgatcaatcatcatcaataaacgaaagtttaactaagctatactaacccaaggattggtcaatttcgtgccagccaccgcggttcccactgattagcccaagtcaatagaagccggcgtaaagagtgttttagatcaccccctccccaataaagctaaaactcacctgagttgtaaaaaactccagttgacacaaaataaac

SEQ ID NO: 668019 - DNA, 340 bp, Homo sapiens
tgagacagagtctcgctctgtcacctaggctggagtgcagtggcgcaatctcagctcactgcaagctccgcctcccaggtttacgctattctcctgcctcagcctcccgagtagctgggactataggcgtctgccatcacgcccggctaattttttggatttttagtagagacagggtttcaccggggtctcgatctcccgacctcgtgatccgcccacctcagcctcccaaagtgctgggattacaggcgtgagccactgcatccagcccaccccacccagtgttttgacaaatcctccaaggctttctgatgcacatggatgaacccattgatacact

SEQ ID NO: 668020 - DNA, 1048 bp, Homo sapiens
  misc_feature (34)..(34): n is a, c, g, or t
  misc_feature (43)..(43): n is a, c, g, or t
  misc_feature (47)..(47): n is a, c, g, or t
  misc_feature (523)..(523): n is a, c, g, or t
  misc_feature (572)..(572): n is a, c, g, or t
  misc_feature (575)..(575): n is a, c, g, or t
  misc_feature (722)..(722): n is a, c, g, or t
tgcccactaactgagggcaattgcagattcaaanagctttttnactntttaacaaagatgtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgataacagcaaagtgaagaccttgtacagaatgtgttaaatttcttgtacaaaattgtttatttgccttttctttgtttgtaacttatctgtaaaaggtntctccccactgtcaaaaaaatatgcatgtatagtaattagaacttcatnccnccatgttttcttcccttatctcactgtcattgtcctaaaaccttattttagaaaattgatcaagtaacatgttgcatgtggcttactctggatatatctaagcccttctgcacatctaaacttagatggagttggtcaaatgagggnacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaatttata

SEQ ID NO: 668021 - DNA, 109 bp, Homo sapiens
acagggttgggacagttggaattgagaactagttagagaagcagagaatccaaatatttaatgggtagatgatgtgagggtgcagtgaggaagatcatggaaaactaag

SEQ ID NO: 668022 - DNA, 285 bp, Homo sapiens
gggggccgggcgggcacacacttgtggagctataaatagtggggcaggtccttctctatcaccagggctcctccatgggtccgtagcgcttcaccacgcagccgttcttgtcgatgaggaacttggtgaatgttccacttgattggcatttcccaggtatgcccgttgcccttggcgttggatcttcatccactatccacagcgggtgtggcgtcgtccccagttcacgcagtatcttgctagaacatatcgcaatttgacgttgtagctccgacggcgaactct

SEQ ID NO: 668023 - DNA, 163 bp, Homo sapiens
ccgtgatgtaatccccaaccacagtctctacaaaaaaaaaaaaaaaaaaaaaaaaaaattaggggggtgggggaacacgggccttaacccccagtaagggggggggtggggtggaggtcccctgggcccccccgtgggggggggttggcgggaccccttgatt

SEQ ID NO: 668024 - DNA, 105 bp, Homo sapiens
cattgcgtttagaatactatcttatcgatccattttaccaagccccagaatcaagagagatgcagttatatattttaacaaaaagtctggggaggtaattggcat

SEQ ID NO: 668025 - DNA, 167 bp, Homo sapiens
ctgcatcagcattccccccaaggccccccatccccagcagctggaattatagagattaaaggcacacaccaccacaactggctaactttttttgtatttttgtagaaacactgttttgtcatgttgcccaggctcatcttgaactcctgggatcaagtgatccgctc

SEQ ID NO: 668026 - DNA, 323 bp, Homo sapiens
aagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctc

SEQ ID NO: 668027 - DNA, 266 bp, Homo sapiens
tcattctatcagaaccctgaacagtgccaagtgttgtctctttgttgtcagagagttagaaccctcatgtgcgctacggagctacaatggacttggggatatgctgtgctggtacaggcaaccaggtaagcaattcaatttgctagaaccaatgacaaacagaccccgtgcaactacgatgaggcaaggggcactcactagacttcagctactcatcatgcatccagacagactgacaatcactttgtccaaaggatgaatcagtt

SEQ ID NO: 668028 - DNA, 188 bp, Homo sapiens
  misc_feature (62)..(62): n is a, c, g, or t
tttttgatgggaagaaaaggtacatgtttccaaagaggttttatgaaaagaataaaaattgncttcttgcttgtacatataggagcaatgctattatattatgtagtccgttaaccctacttaaaagtttagggtttttttttggttgtagagtggcccaaaattgcattttgaatgaataaaggtta

SEQ ID NO: 668029 - DNA, 1167 bp, Homo sapiens
agcggaggcagtagcaggaggtgcgcggaggccactcgactggcgctggctggcctgagagtcaggagcagagaacctcatttacataacggccgtccctctgtctcctggcgaggggtcggagtcccgaccctcgtccaacttgagaatctgtatgcggtcacgggtccaggtacactccgatgctagtgctagagccgctgtgtgctgagagtctgagaagagttggtagaaggctggtcccgggagcggattgggtctggggagttcccagaatgcggcattataagaacctggagaatcttgtggccgcaggcggacgactgaagtcgctaggtaagttgtccgtggttgctttggtctctgacggtggactgttacgtttgactcacgacgcgacgttgcatcatgcgcattgagtttatgcgcgcatgcgctgagatcgtcttcaggcttcggcccttctgtcagagttcccagtgcaatggatcgttgactgctgtggggaaacccggaggcgtgaattcgggcagaatccgaatgccttgggggggccatcgccacctgtattggccagctcggcggatcggaggggatccgttatcccgaaagcgaaagcgaagcaaatgggtagggggaggtaatctgatcgggccctaagcgaatcgcaaggtgtgccaggcttccctgccattcgcgaagcaccgccccccaaggaatttaccaggtggtgaccttaaccaagcgggtgagaacaaccccggaagaaccgactgatcctagaatacctgagggccagatagcagccaccggagcccaatggacaaccccaatgatggttgtgaaccgcagtaggattatccgcccgaaagacaaaaagtgagaacccagtcgcttgtccagaacccggccgccgaaagtgaagaggtgcttggccacttgtgggcaccgtggcgacaatgtatccgtaatgggtaagttgccctgaccaagcattgccaatcgttcatgtgtgaccttaatttggacacacaaccacgcttgcggccccgatgtgttacgcaaggaagacttggcactgtaagtgtgcgaacatgagacgcaagtgggccaagagaccccagcatataaggagtggctcaagggtctaatgcacgggtaacgcag

SEQ ID NO: 668030 - DNA, 194 bp, Homo sapiens
acgctcagctaattttttgtatttttaatagagacgggattcaccgtgttagccaggatggtctcgatctcctgaccttgtgatccgcctgcctcagcctccaaagtgctggggttacaggtgtgagccaccgcacccggccggatctcatcttttgagcaaagcaaaacaaaacaggacaaacagggcaggct

SEQ ID NO: 668031 - DNA, 299 bp, Homo sapiens
  misc_feature (208)..(208): n is a, c, g, or t
tctcccacctaagtctcccaagtagctggaaccacaggcatgtgccaccacacccagttaatttttcatatttttggtggagatgggatttcactatgttgcccaggctagtcttgaactcctgagctcaagcagtccacccacttctgtaatccccagcactttgggagaccaaggtgggaggatcgctttgagtccaggaagttgnagaccagcttgggcaacatagtaaggccttatctttgtaaataataataataattaaagtaaataaaattaaaccatatcgatgaattatt

SEQ ID NO: 668032 - DNA, 454 bp, Homo sapiens
ttcacagtcctagggagtgatccctagtgtcatacacaactgtgaagttaagggagatgaggactagagatgatctactgcagtgcttctcaaagtggggtccccagaccagcagcagcagcaccaggagcttgttgcaattgcagtttcttgagatctactccagacctggtgactctgggagctctgagggaagggcctagcaatctatgttttaacaaggtttcccagtgatcctgatgcatgctaatgtttgagcaccacagctctattgtgttaattgataagtcactggtgatgcagcaacttggtgaaagtaacttcataaaatttacaccctgtttgggcaaattttaaaaatgtttcgtgggactgttaaagttttattctatttgtttagaaatttcaaatgttttattttcttttgcaataaaaatgttgttatttaaaaaaa

SEQ ID NO: 668033 - DNA, 266 bp, Homo sapiens
ccagaaactcgagaagccccagaggcaacagactgagtccccacggctggtatattggccgatatagagctacgtgtaaccaaaacaggaaggcacggctataaaaacagacacaccgcccaatggaacagaactgaaagcccagaaataaacccaagtatttatggtcaatcgagttaggacaaaggggccatcacacagcgcatgacggctcatgtatgcaatagacagtgttcagaaaactgggtatgcataggacagagacc

SEQ ID NO: 668034 - DNA, 307 bp, Homo sapiens
ttcgcggccggtcgactttttttttttgagacagggtctcccattcttgcccaggctggagtgcagtggtgcgatcatggctcgccacagcttcaacctcccagcctcgagcaatcctcccacctcagccacctgagtagctgggattacagatgtatgccaccaagtccagctaatttttgtattttttttgcagagacagggtttcacgatgttgtccaggctggtctcgaacccctgggctcaagcaatccgcccacctctcaaagttgctggaataacaggcatcctaggagaatttaaaatg

SEQ ID NO: 668035 - DNA, 125 bp, Homo sapiens
tgattttattaaacactcaagagtatacttctcaaaatcacagaagagcctccaaatacaagtgttagaaggctcttctgtgatttgagaagtatactcttgagtgtttaataaagtttttttcc

SEQ ID NO: 668036 - DNA, 156 bp, Homo sapiens
ggctgggcatggtggtgcatgcctgtggtcctggctgcttggcagtatgaggtggagcccaggagtcaaaggctgcatggagccatgatcacggcattgtactccaggctgggtgacaaagtgagaccctgtctcacagaaaaaataataataata

SEQ ID NO: 668037 - DNA, 533 bp, Homo sapiens
tggtgcttggtcttttaattattcttatatgggtcctaccaatgtgactctttacccaggcccattgttcctatgcgcatggctttgtaggcattcacatcatatgtctgtgtcctgaaaatctcaattaatttctccttcctattccttttccagttgctcgtgcctcatttctctcagaaatttgaaggcattgtgatatattattttattggttggggctctgtgtaaaggttcctgggcaggagaacattgcatttttgactttaaaataaagaccaacattcgtgacactagggtaagtgcacagaaaaaatacagtactcagacaatcatggcaaataaataccccatacagatgaagttatctcaaatggtaacaatatttcttagtgaattcaacacttggtaggggacctcctatattttatatacctttcgcggtatacaggtggttgagatttcatataagagaaatttttttggtttcacagagatttagagaggttatatcttacaaaattctataggtc

SEQ ID NO: 668038 - DNA, 1147 bp, Homo sapiens
  misc_feature (217)..(217): n is a, c, g, or t
  misc_feature (221)..(221): n is a, c, g, or t
  misc_feature (227)..(228): n is a, c, g, or t
  misc_feature (236)..(236): n is a, c, g, or t
  misc_feature (248)..(248): n is a, c, g, or t
  misc_feature (265)..(265): n is a, c, g, or t
  misc_feature (296)..(297): n is a, c, g, or t
  misc_feature (321)..(321): n is a, c, g, or t
  misc_feature (323)..(323): n is a, c, g, or t
  misc_feature (326)..(326): n is a, c, g, or t
  misc_feature (333)..(333): n is a, c, g, or t
  misc_feature (343)..(343): n is a, c, g, or t
  misc_feature (354)..(355): n is a, c, g, or t
  misc_feature (358)..(358): n is a, c, g, or t
  misc_feature (368)..(368): n is a, c, g, or t
  misc_feature (373)..(373): n is a, c, g, or t
  misc_feature (378)..(378): n is a, c, g, or t
  misc_feature (384)..(384): n is a, c, g, or t
  misc_feature (390)..(390): n is a, c, g, or t
  misc_feature (398)..(398): n is a, c, g, or t
  misc_feature (400)..(400): n is a, c, g, or t
  misc_feature (405)..(407): n is a, c, g, or t
  misc_feature (411)..(411): n is a, c, g, or t
  misc_feature (804)..(804): n is a, c, g, or t
  misc_feature (836)..(836): n is a, c, g, or t
  misc_feature (842)..(842): n is a, c, g, or t
  misc_feature (847)..(848): n is a, c, g, or t
  misc_feature (855)..(855): n is a, c, g, or t
  misc_feature (906)..(906): n is a, c, g, or t
  misc_feature (926)..(926): n is a, c, g, or t
  misc_feature (941)..(941): n is a, c, g, or t
ccaataggtaataccaataaaaagatataagttatgaaaatagttaagtggaaattgggacttgaaatgtttaagaaatgaaaagaaaaaatcactggggcacttaaaaatatatttgagttggcagaagaaagtatcagcaaatttgaagatagatcaatagagattaccacatctgaaaaaaagagaaaaagagaatgaataaaaatatgcagancttnagaaanncatggaanaccattaaatanagcaatgttaagtttantgggaatacttgaatgaaagaagaaagaagnnaaaaaatatatgaagaaataatancnaantactccncaaatttganaaagaatattnntcnttatatccangaagntcaanaaggtncatatnggataaananaaagnnncatncagacacatcatagttgaaattttgaaagctaaagagagagaaaatcttggaagcagtaacagaaagaccacttatcacctacaagagaatactgataagattagcagctgaattctcatcagaaacaatggaggataaaaggcagtgggatgatatattcaaagtgctgaaagaaaaaaaaagttaaccaagaatcattacacagcaaaactattcttcaaaagaatagttgaagacaaaatgaatacaaaataaagtcattaccagaaaaaacaaaaacagaatttgttgttatcaggtccatcttacaagaaatactacagattgttcttcaggctgaatgtgagtcacacaggacagtaattcaaattcacagaagagacaaagagcancactaaaggtaattatataagccattataaanaaaaangtatnngtatatntctcctcctttcttctcttaactgatttagaaaggaattgcataaaaatgnaaattattgtactgctgagnttatatagaaatgtnatatatattaacaggaagcacaaaaatatggaggagggaatacgaactcatataggactaaattttctatatcccactaggaaataagtcaatggaccttggagtgagtcaagaggtatattgtaagcttcagaccaaccagtaagaaaataagtcaagaagtaagagttaaagatattctacatgtccttatcaacaaaaagcat

SEQ ID NO: 668039 - DNA, 179 bp, Homo sapiens
aggtcgctctagagctcccctctcgctccaccgaacaggtaagtctgtgtgaggtgatctctgtggtggtgatcgaacgacgtgaagctgggagtgactgtgtgacctggtctcagtggtggtgaccacagaagatcaagctacgagtactgtgtggtatgtgatcggttgagcggaga

SEQ ID NO: 668040 - DNA, 114 bp, Homo sapiens
aacaggagaggcctggagccatgcgactaaggagaaagaaatcgggggttactgagagcagatagtgccttagtgggtgcagagacttttgtggaaattgtcagcttctcgggg

SEQ ID NO: 668041 - DNA, 849 bp, Homo sapiens
ccaggctggtctggaactcctgggctcaagcggtcctcccacctcggcctgctgagtagctgggactgcacagatgcgccactacacccggctaatcttttaattgtttgtagagatggggtcttggcaggttgtctaggctggtcttgaactgctgggcttgagtgatcctcccgccttgggctcccaaagtactgagattgcggtcatgagccactgctccgagcccaccctacctctttattcccaagcttttctgtctattctgttccttccctaagtacgtctctttttttattttttgtttttttttgagatggagtttcactctgtcccccaggctgaagtgcggtggcgcgatctcggctcactgcgacctccgcctcccgggttcgggcggttctcttgtctcagcctccagagtggctgggattgcaggcgcccaccactacacccagctgattttgtatttttggcggagaccgggtttcatgatatggtcaggtcaggagatccacccgcctcggctctcaaaagtgctggaattgcggcgtgaggcaccacgcctggccgggtgcatcttttactaactctggcctgcttattggtgatatctgctctagtgccaaaaggagaaacactagagggatgtcagcctattggtctgttcatttaaagttctttcttagcaccaaattaagtctaatttaactaaaaatccactttgtgctttgtggcattgtgtcaaggaattccccacagggtccttatgggcatatagcccaggccctctacagaaaagggctccttgtattaagaaaaggcaattttgggtataaaccgggtatt

SEQ ID NO: 668042 - DNA, 136 bp, Homo sapiens
ctgatgtagcctgagatagcagtacagaatgaggagcagcaggcctagcggagttgatatgcagggcgatggggctggcagagctggtggagcctgctatgcagtagggggccttcaagttcccgggaacaccctt

SEQ ID NO: 668043 - DNA, 1118 bp, Homo sapiens
  misc_feature (609)..(609): n is a, c, g, or t
ggacgcgtgggatcgcgacggccgccctttttttttttgttttcacataaatttacacaagcactttataaaagggttacacagaaaacaccttataagtgcataaattaacacccccccacccctcaaagtgggttctggaaaaatgggctgcatttatgtgaaacacctgtctgtgcgtacctggattgggcgctgggattgttgtggtgggggcctggcagaccaagtgaggctgtatgtacgctagtgggctcgttgtgtcgtaggtagtagtgtgtcacagtgtggccatgaccttgtgttcggtcgctggcagggattgccagtgctgtccaggatgagtcttgtgtcaccccttgaacctgtgcctgactcgctaaggctccaaagtgtaaacacttgttgacccctctgtctggttgacactcttcccattagtatgcccatgttgtaggccctctggggtagaacaccagaggcagggcacagtcgcaccaccaccctgtgctgtgggccctatggggttcccatagtgctcgtcgcatcgcaaaagtgggtccacacgaaaaaggggttccccaacggggcaacactctcagatgtganccgcccccgtgggagaccccgcagaaaacgcctccgctcccactccccatattaccctcccactgtgcccctatcagtccttgaagactccccccacgttagaaacacaccgttcacccgttttcacacgcgtcgacaacctaccgccaacaacaaacccacgcgtctccctctaaccgcgcgttccacgccactgtgttgcccgcgacccgcccctcctgggggacgcggcgcggccccccgtgctccccttgcccccctcttgctgcctcctttcgcccccgcgaacgggctgcgaaacacaattgccccagaccacacacacggtcggagagcgcccccatccaccgcccaccgcttcgcgcaaggcggcaacggttacacccacccccacggcgaacgacacgacccgaacgacacaacgaaccgacagtacagcacacaatcaccccggacgccccccacaagacaccaacgctacacccccacgcccagagaacaacaagcgc

SEQ ID NO: 668044 - DNA, 331 bp, Homo sapiens
gaagctgcccgccacagaagcctccatgatcgttcgccctaaacccaacgtcctgggtatcctgttctccctcaaaggctccattgccaagcgcattgcctggcgcagcctgctggtcacgctgttggcctcggtcatcgtgctggtggaaaccctgcaccccgcctatttttccaaggtcaacgctacgcccttcaccttgttgggcctgtcactgtcgatcttcatgagttttcgcaacaacgcctgctacgaccgttggtgggagggccgcaagcaactggggcaaatggtcattgacgtgcgctcgctgattcgcgagacccaggtg

SEQ ID NO: 668045 - DNA, 874 bp, Homo sapiens
  misc_feature (532)..(532): n is a, c, g, or t
tcacggaagagttctccgctcccagacatgggtccctcggccttcctgcctcgtgaagcgcagcagacaggcatcgtggtgaagtgtgaagatgacttccctaaggatgacccgtccaagtccggtccacctcacatgccttcctgagagtatacagagggtctgggcagtgacctcacactcgttggctggggaagtcagactaggaccggtgtatccaaagtgtagagacaaggataggtgagtgtaggctggtagggcctggtgtaccatattgtatgacgtagcagcctaccgcatggtgcgcttgtgtggcaattcgttggggactaactcgtggcacaaacccccataccgatgaggccatcccggtatccgtgtgcgaatggaacttgtgctgttgtagtcgtcggagactacctagtcgacggttgactgcaaattggcagagcgatgagcggttatactactaaagggaagtatgggccagtatacattctatgggacactgaagcgcgctttatatcaccanaggtttacccttgccgacaccgacacattggtggcacgcgatttgacgggagttgtgcgacagtgagaagtcacggctcttggaacgtacacggtcgaacctttgctacgtcaattgacacttgaacacggcataggattagcatatggcgcaagaagggttcacttactcctggttggatacgaataatgtggcgcccccaatctaaccctctaagaaattggacaggcccttggacttattcccttcttagggcggccccaagaaatggaaggtgccccgaagtccttggaatgggaggattcccatggggtgaaacgcggggatggcgcacttggtgag

SEQ ID NO: 668046 - DNA, 520 bp, Homo sapiens
tgaataagttggactcatgtcctgtattcctaggacattgagaggccaaggctggtggatagcttgagctcaggagttcaagaccagtccaggcaacaaagctagaccatgtctcaaaaaaaaaaaagttacaattttatattttactttttcaagttcttttatgaaataccaaaggcagaaaactctgtgacatacaatgggaaatctccctctataagacatcttcccatttctctttaataatgagttcatagattctcctacctgttactcttatccaacacttttcccccagcttgtccacaggttatctacataagatgttaaattttggctgataataagacttgtcctcagcattaatttcattggctaaagaaaggtggttaattccctattgagcctctacgggctgctagtggttaccacttcttatccaagagttgctttcagtgatacactggtaaccttttatcagaaggatctgtggaagcaaaggcccatatttgtagtattt

SEQ ID NO: 668047 - DNA, 731 bp, Homo sapiens
tattccccccggtggggtttttactcgttcttcccccccctatttttccctccccgtgggggtgttccccccgggggtccacaacacccatgggaattggcggggtcctttttgttactaatcgcggttccactacagggaaggggccctttttttcgtagtcacctgtacacggcgcgtggttcccttgggtacatatctcggctccctacagatggtgaggctcatagcttgtgtgccctgctgacccgctctatggtcaagcactgtggcttcctactttacccatgtggaactattttagcacagtatccccgcatcccccttgagacctacaccagacacataaccctagatgctctagcactagaaatgcaccctttaataactccatttaggggtctacatttagccttaagtctctagctctcgagctctttagtacagtcgcttatcaatcacctttcctggtctatataccttgttaacataaattccttccagactaaaccgaagatcgttcagcaactgtaaaagaaattacttcattctatcttatgttatttcttcgcccacaccttcaagctaggtttctctaaaaaacatacacataaagcattacacaggaaaatacacagaacaaaccttcgtacgagggaatcacctcataaagtactatgtaagtgtccaggcacggtggttcacaccgtgtaatcccagcactttgggag

SEQ ID NO: 668048 - DNA, 115 bp, Homo sapiens
ctcatgcagtggcgtttcccaaatcaggcagcttcccaaccagggcttctcccacccatgggctgtgtcatccaaatccactgggtcaccaattttcttttcaacacatcaggtt

SEQ ID NO: 668049 - DNA, 668 bp, Homo sapiens
  misc_feature (137)..(137): n is a, c, g, or t
  misc_feature (139)..(139): n is a, c, g, or t
  misc_feature (198)..(198): n is a, c, g, or t
  misc_feature (393)..(393): n is a, c, g, or t
tcccccccccccccccccacctttttttgttgtttgtggaggagaaaaaaaaaaaaacaccacccccccccccttctctcttttttttttttggtgggggggggggggcggggggggaaaccccataaaaaaaaaancngccctcccccccccccgcgggcgggcgggggtttttttttttttttttctccccccccnaaataattttatttctccccccccccccccacaaaaagagagggagagagcccccccccccccgcgcccccccctttttttatataaaaaacgccgggggggggggggggccctcccccccccccaccaaaaaggggggtgttttttttttttttcccaaaggaaaaagaaaatttttttgggggggggtgtttncccccccgcgggttttaaaccaccccccccgtgggggggggggggggttttttttttttgcgcgctcttttttttttttttttttcttccccccggagggagaacctctccttttttttggggggaagagggggttttttgaaaaattttttttccgaggggaaaaaaccccaaaaccggggctagggcccttttccccggttttcccgggaaaccaaaaaaacctgtgtaataaacccaacgcccgcaatgtttctgcccatcactggataaag

SEQ ID NO: 668050 - DNA, 89 bp, Homo sapiens
tgcgcttgagggggggtgtataagtttccccttttaaggtttcgcccaatttcattgcactttcctttcaataaagttgttgcattccc

SEQ ID NO: 668051 - DNA, 132 bp, Homo sapiens
ctagagcgacgcttaatacaccaccactgattcggaccagatgtacttccatcttcagccagagcgtcagcagcaacttctggtggccatacgcttctcatagaaagtacgaagttggcgtccatcgtccac

SEQ ID NO: 668052 - DNA, 750 bp, Homo sapiens
  misc_feature (418)..(418): n is a, c, g, or t
gggcacttcgggcgccgcaacagcagcttcgagagctgtgcccaggagtgaacaaccagccctacctctgtgagagtggtcactgctgcgggagactggctgtgacctactactatgagctctggtggttctggctgctctgaactgtcctcatcctctttagctgctgtgtgcgccttccgcaaccgagagctaaaactcaggctgcaacaacagcagcggcaggggtgaaaatcaatttgtgttgtggcctatcatggggcatgcccattggggctggtcctttccctaccggttcatgtttgaccttcgtgaggtgactttgatgccctgggtcagctaccagtggccctcccaaaaacgagaacccaaaatcgtctcacattcccttttccacacattcacatttcaaagtatnttttccctaatataaaaactaagcacccctacaaaaaaaaagaaagaacaacacaaaaaaatatttgttcggggggcccgtgccacccgaaaagaaagtcttcaaacaccattgcgtgggggcgccgcggccccaattggtaagtgtcaccgttgcccaaagcgtgtctccacaggagaaacccgcgcgccacagacagctgcgcgtggtcttcccccataaaaaaaacggcggggcggaccccgcgtggctcttgacaatcccgagtgggttcggaggcctagcgctccttcgaccagcgctccagcgaacgattacccccccgtggggtg

SEQ ID NO: 668053 - DNA, 150 bp, Homo sapiens
cggagtttgttagagttgtaggctcgcgacccgcatcatccagtgctctacccctacggtattcgtcgaggcactacacaatagtttcgcggagaccagctattcccggctgattggccttcaccctaacacactcatcgtactttcacg

SEQ ID NO: 668054 - DNA, 270 bp, Homo sapiens
acgccataccgtattaaaagccaaagattaagagaaaatttgaaagcagccagaggaaaaaaatgacatattatataaagggaaagaatgacaaaaataatgtttgacttcttataagaaataatactgtcagaatagaaaatactaacattttaagttgctgatggaaaaaaaaacctgtaaatcaagaatcctatagtgagcaaaaatatctttcaaggcagcatattaaataaatgccttgaaaaaaaatagagcgaatgtcttttg

SEQ ID NO: 668055 - DNA, 291 bp, Homo sapiens
cgaggggtcatcaattatgacaaggaagtacttccaatgattactacaattttacaaaccaatgacagtaagatgaacagagaccattaagtaatacaagcggagaccgaaaggggtactgcgcgtcccaaaggtgggaaatgcatatcgcgacagggaccaccaggattacttaatataagactgacagcgtattgcgtatcccagagccatctctcgggaaacagctacgtcagaatgcaaccgcgaacgacgaaaaagaatccatggcctggactcccacatagacac

SEQ ID NO: 668056 - DNA, 723 bp, Homo sapiens
tcctcctgccttagcctcccaaagtgctgggattacaagcataagcaccacacctggctggacaatcaaaaatttaaaggggaacccaaaagctaagtgggaaaaggtacctaaaatgggaactagaatttctaaaggttctgggaaaagcctcctattaaatggaatggtttcctggaaccatggtaattaggaatggattcctggccaaagacctgacatcaaataagtgattgacattaccagcaatggattttgaaaagcgcaaaaatactattaacctatataaccatttaaaatttaaaaaattgtgttccaagtacctctatattctgagctataagaaaccttatagggcatctgaggatagatttccagagctggatggatccctatggactacctaaactgactttctgtgcactgcatggattcttctaaaaagtatgtgacttatttccctaccctattaagactaaataagtggaacatcatagagctccttatttataacagccattcttttgataagcactcttaaaaggagacctgagatgcttaaatattgtactactggggttatcatgtgaagatttcttaaagggtagtattggtagtttaaaaaggctttggcttatgctgaattatacatgttggaccaaaatggtcaactctacttccttgtctctatttttgctctatttatattagcttcctcggacc

SEQ ID NO: 668057 - DNA, 494 bp, Homo sapiens
gctgcctgctgttattatcatgagtcctagttaacctgaagtggagaagacaacgatacgcaggatgacataatgtgtaagggcgcagactgctgcgaacagagtggtgctagcgcctaaacatagtgtcagagtacggattacgtgggctatttactgctagggggtgtaaagcggatgcgtaagacagactcctgctacaactatagtgcttgcgtggagcaagactagagacctggggtgaagccttctactggctagaggggcgtcacggggtggagacctaattaggctgataagcctgctgctgctcagaggaggcctagtagtgaggtgaggcttggattagcgtatagcagggctatttgtagtgggtctcatgagttggagtgtagaataaatcatgctaaggcgaggatgaaaccgatatcgccgatacggttgtataggattgcttgaatggctagctgtgttggcatctgctcaggcgtact

SEQ ID NO: 668058 - DNA, 436 bp, Homo sapiens
  misc_feature (282)..(282): n is a, c, g, or t
  misc_feature (300)..(300): n is a, c, g, or t
  misc_feature (304)..(304): n is a, c, g, or t
  misc_feature (311)..(311): n is a, c, g, or t
  misc_feature (391)..(391): n is a, c, g, or t
  misc_feature (398)..(398): n is a, c, g, or t
  misc_feature (401)..(401): n is a, c, g, or t
gttgccgagcttcaccacgaactgctgctgctgcgcttgctcctcagtcctagcgtcatcatacacgggttcctggaatccgggctgcggctgtcttccgagatgcacggaatccacgtctgtgtagcacctggggcagctgtcaattaaggcgagtcctcaggagttaaaaaatgaatgctgaactcaaagtgccaatgcaaaaagattaagttggtaatgactctggatcttgaattacttccgttacgaaagtccttcacatttgtcaaactgagctantatatttaaggccttccnaatncttctanctcttccaaaagccttctgccttagttttttttaaattacaccagtccttttagtagctttttgatgtgattttaaccancttcccnttntagcttcaagtattcttctattggcccttatcgag

SEQ ID NO: 668059 - DNA, 122 bp, Homo sapiens
agagacagagtttcaccatgctacccaggctgatcctcaaactcctggacacaagtgattctcctgcctcagcttcccaagtatctaggactataggagcatgccaccacacctagctaatt

SEQ ID NO: 668060 - DNA, 106 bp, Homo sapiens
gtcggactccccgatcggtctttacctacacaatacgggggcttcgatgagacattctcaacacctttctttgtgctctaacactcttcgctcctgctttgttttt

SEQ ID NO: 668061 - DNA, 427 bp, Homo sapiens
  misc_feature (282)..(282): n is a, c, g, or t
  misc_feature (300)..(300): n is a, c, g, or t
  misc_feature (304)..(304): n is a, c, g, or t
  misc_feature (311)..(311): n is a, c, g, or t
gttgccgagcttcaccacgaactgctgctgctgcgcttgctcctcagtcctagcgtcatcatacacgggttcctggaatccgggctgcggctgtcttccgagatgcacggaatccacgtctgtgtagcacctggggcagctgtcaattaaggcgagtcctcaggagttaaaaaatgaatgctgaactcaaagtgccaatgcaaaaagattaagttggtaatgactctggatcttgaattacttccgttacgaaagtccttcacatttgtcaaactgagctantatatttaaggccttccnaatncttctanctcttccaaaagccttctgccttagttttttttaaattacaccagtccttttagtagcttttaactgcagcaactttaatatacgctattgagccaacaccgggcgggatcctcta

SEQ ID NO: 668062 - DNA, 747 bp, Homo sapiens
  misc_feature (93)..(93): n is a, c, g, or t
  misc_feature (189)..(189): n is a, c, g, or t
  misc_feature (236)..(237): n is a, c, g, or t
  misc_feature (241)..(241): n is a, c, g, or t
  misc_feature (259)..(260): n is a, c, g, or t
  misc_feature (300)..(300): n is a, c, g, or t
  misc_feature (313)..(313): n is a, c, g, or t
  misc_feature (352)..(352): n is a, c, g, or t
  misc_feature (461)..(461): n is a, c, g, or t
  misc_feature (479)..(479): n is a, c, g, or t
  misc_feature (499)..(499): n is a, c, g, or t
  misc_feature (516)..(516): n is a, c, g, or t
  misc_feature (546)..(547): n is a, c, g, or t
  misc_feature (564)..(564): n is a, c, g, or t
  misc_feature (679)..(679): n is a, c, g, or t
  misc_feature (685)..(685): n is a, c, g, or t
  misc_feature (695)..(695): n is a, c, g, or t
  misc_feature (715)..(715): n is a, c, g, or t
  misc_feature (720)..(720): n is a, c, g, or t
agcggcgttcgcgcccggcggcgctccaggtgctgacagcgcgagagagcgcggcctcaggagcaaggcgaatgtatgacaacatgtccacantggtgtacataaaggaagacaagttggagaagcttacacaggatgaaattactttctaagacaaagcaagtaattcagggcgtggaagctttgaangaactgagcacaattccattttacaaagtttgctggagacactgaanntgtntgaggaaagatgatgaanngtaattcggtggaggagaaatcaacacatgatccggaagncactggagatgtnggagctcggcctgagtgaggcacaggttatgatggcttngtcaaatcacctgaatgctgtggagtccgagaagcagaaactgcgtgcgcaggttcgtcgtctgtgccaggagaatcagcggctacgggatgaactggccaacacgcangcagaaactgcagaagantgagcagtctgtggctcaantggaggaggagaagcangcatctggagtttatgaatcagctaaacannactactgatgacgacantttccccatccgaggacaaagacactgattctaccaaagagcctctggatgaccttttccccaatgatgaagacgacccagggcaaggaatccagcggcagcacagcagtgcagncgcggntgcccagcanggcggctacgagatccccgngcggntgcggacgctccacaacctggtggatc

SEQ ID NO: 668063 - DNA, 824 bp, Homo sapiens
gacaatggtgctctgaaaagacatctttgcatgttcctacatccgcctccttgcacgcagagcccgcctccgccggcgctcctccgcgacgaggactccggaagatacatcgccagagtcccctgaacctctcgctctcttgttcaatcccctgcatcggactcaacgggcgtgacaccaccactgatcagaccgacagcccgcaagacaccagtccaaaaaataaccaccaagacactataaagagacaaagacggacagttcgtcgcaccgaggccacacacatgcgcaacacaccgccccctgccaacacgcggacactgcctgaacaactcgcggaacaatcggcgccccaccggacgacccctgaacaccacgcacgcgtacaccgaccaaccacagcacagcacgcgcgggacacgccaccgaccccccgacggcaacacaccaccggcgccaccccgcacgacacacgcaccacccctcccccaccaacggcaccctacacgccagcacacgcggcacacgcgagcacgctcgacacgacacggctccccgcgcaccctgtcacaaccacacccacggccacaacacccgcccgcaggcatacataaccaaccgacacacacgaaacagctcacccctacccaacaaaaccaggccaccgccacataatcacccacacattcacgcacaagaacttacaccgggccccctccaaccaaacagccccccaccacccgacccccgcccccccgccagcacacagcacccccccaccccacccacacccccgcacacccccccacgccgacaaccgccca

SEQ ID NO: 668064 - DNA, 1165 bp, Homo sapiens
actgctactgtgtaatccaacttgacaagtagctgttggctgctggtcccacgtgagggatgtgcttgtacacctggctgtggccataagtgagtgctgggctttcctagagtgagctcacagccctgagggagtgcacagagaagcagacaggcccttggtgataatacttgtgcctggtggaagtgcagagccctccctgagtgcccaggcctccctgagtgacagtgggagtcaactacaggagtgggtggtatggacttcccagaagaaattgaacgtgcagcagcaatgtgtgtgttgcattacaatgctcgcatggagcagtgtgccttgtgactgcagagtggaggcagtggctaggatctggtgactcggcttgcaaggcctgagtgacacgctttgacagcagtgtggaggcatgtggaccacgtttgaaggcagcgggcataatgacatggtctgattatgcaactatatggcaaatgaccaacccttagttcctagtatagacttgagtgacaaaggcgcagcatgcacgtaactcaggatgacccaggttgagtgtccgcttggatagtagtgaaccacaatgtgagcagcacattgggatctggcgctagactatgacttgaaggcactatagtgtactattaccactacataagacacacattaatgcctgtaaacgggtaggcccacttgagacttttgcactccaaagccaaggtgccttaatgataggcattggggagacatccccagagtcgcaagggtgtcaacggaacgcggcaattttccacaagtgaattgacagcacagtaagttcataaacagttcgctatcgctgaacaacacaccgtatgacatcataatatcacaagggggcgcgttagagagggagataaaaggaggatgggttccaggagaaattgaagcagtatagtttctatcaaaatgagcacgaaaggtactgtaatagtagaagtataagagttaggtgtgtagatgaggagatattcaaagtggaggtgataaataacattgagagtaatctaggaatggcaagaggtgtctagaactgtttacgattagtccagttgaatagtgtgtttacaaggcggtaataggcagtatagtagtcacatgtagttggggttagtaa

SEQ ID NO: 668065 - DNA, 1742 bp, Homo sapiens
  misc_feature (316)..(316): n is a, c, g, or t
  misc_feature (898)..(898): n is a, c, g, or t
ataggttactacaaagtacacatagggatactcggactaaaatcttaccccgcccgtttatcaataacattcacctctagcatcaccagttattgagaggcgacgcggctgactcctgatggactatcactgttctaaacggagccagcagagatagccccttaacccgtagctaacatggatacgacatagagtcacattgttatccctctaatttaaatgggaacttagctatgtaatggttctcgcaacagccagagtgatgtcaagtaactgtctcatttctatacctatattaagcccagtgtgcacaaantatgacccctgacacacgctgtaaagaagtgcacggtggcagtgcaccacacagtcacaatcactgcagcacagtacactctgtgatgagccagccctttcacaatatcattataaatgcaacacacatagtaacccctttacaccatacatcacgactagtgatcccattcatatactacacacatatacatcatagtgctcattacatagaaacatttatccgcgttatggggaggtccaggactcgtccgggccagtctaagaaaccacaaaacctttaccgttagtctagataacaattgccttaaaatgacgtctctacctaaagcttcgacaacgggcacaaacctaacattaattatgtccacactagcaatcctcaaataatagcctctgtaatcgaatagtgggattccaaagggtctaaacgcctcagaggggcattcacaacctgaacgcgagagtgcccctcaaatctctctaaggaacgctcccccagttaaattctagaaccaaaatctcatggggggcttttataagccggaaactccgtcgagcatatgtgctacgggaactcccncagtgcagcaaataccaacaagacgttgcggttggcaatagcctagggggaacctattaaacaatagggtctcacagtatctaggtttcaaaaccagatttttacaccaggtcccgataacggctcggaactgcttggtaagtttttccaggaacgcacgaggacgcttcaaattacccaccggttgggcggcgcattctactaaatacttaaaacttcttgagaaacttataacactatacccggctcgtttaccgcgaaagcacgggggggccatacggaatgccacacatttcagggtgcctacccttttccaacacaaaataggcgtggccctgtatccccgccggtggacaaagcttggacatcaattgcaatccccgtcaaaagatcctaaggaaccttaaaagtaaccccacgaagacgccaaaagcccaaaggaaacaacggggcgcttgggcgtcacggagacacacccaccaaaccagggcgacacaaccaacacacagcataacaactacccgctactaacaagcaccaccaagaaccgaaaaagcgggcgggccgcggcaactaaacagagaacccccacgaaggaggggaggcagacacactacgacagacctaccgcccgatctctggatccgaccaagacggtgccccacaacaagaaggagctctccaaagaatagacgagaccgccgacgagtgcaacaaaccattcagcagagccgaacaaaactacgaacgcagggaacggagcagcaaggcacccccccatggcggggggatctacgacacagctcacacgacacaaacaagcgacccacgacacaaagcaaca

SEQ ID NO: 668066 - DNA, 253 bp, Homo sapiens
agatgaggtgtgagcagcggaacaggtaatgccagagcacaggctcgcttgctcgttggaacgggtgttggcgacttccttcctctgtccggagaggcacaggtttcgcccagtatccagccaaaggctccctcacagggcgctgtacactttttagtacaacgttttgtacatttttcgaactcaacaaccttgtttcaactttaattaaaaattgctcactgttggggcacagggggggactcttcttaga
